United States Patent 10,900,036 (RNA INTERACTOME OF POLYCOMB REPRESSIVE COMPLEX 1 (PRC1)) - sequence listing, part 17

SEQ ID NO: 34692 - DNA, 2763 bp, Mus musculus
actgtcaataattgttctcttgacagggtgggagctcctaaggagctttctttgaaagatgaagttcatatgtattgtcagtgaactctgctaacatagagcatcagtagtgcttccagtgtgctaccagcctgcatggcccacaacaagatccgcacactttagtgccagtacagaatcatccacagtgttctccttaagaaaggacagcgtgtctaactacagaaatccgttttctagggatagaaatgtacacactattatgtttctgacctagagtacagatcccctgggaatttgtaggatccctagaagttgtctgttaggcaactgtacattgttcgttgttcctcagtacacagtccgtctcatccactggcattctgggggtcgcgtggtttggctcccctcattgtgcggtcacaggcttgctgcatttgtcaccgacaccagcatttcagaatagttctttctaactctctagacgtgttaaacatgtgaatgcccaggactttgttttgaaagttgcattccttactgggtttgggatgtggcacctctggcccagcttccctctggttttctcggcccatctcaccctagacagtggagactggtcaggcagtcctgtgtttagattgagttagattggcatttcattccataaatcatgatgatacttgagttttgtacatttgtatcttttaaatactccgtaggagacacaggagatttcattccatttactggatggttgctgctctggcttttttggattagagtatcttttatttagagcaaaggaagaaatctttcaagaggctaaagtcctgctgctgtgactgctgtgaatttgtgaaagattaggtttatggcagtctttgtaattaaatcatatagttgcattttaaggttatatatttagaattaaagttttaagaacatgctcatatttggagatagtctacgaggttttctttatttcccagattgaccagagagtaacaatgaagtccaaagcagatatctggaaacaccaatacatgcaaaggtctatgagaacttgggcatctgcattaaaagtgcagacctgactatcagagtgtccggaaacctgatgggtgccgccacgtggcatacagatgtgtagatgtgttggcagacaccttttttaaaatttttttgtagccttagtcatcttttttgtcaaggaggcaactcattggcctctggaagactacaccagccctgaacactatccttagcagcacagatggagggatagaggccagtgccacagtgagtgagacaagttgcttctgtaacttcaggccttgcctgaagagaagtgctacaaggtccaggccaattttgatatttgtggattagtttgtcacacgtagtgtttgctcctgaaactaaagtctcttttataaatactaaggttgattccttagaacaacttctttattaataacatcctttgggttcagaaatgtcagaaaaagtattttaaagatagaatcataattcagattattggtataattatgaaaacaaactttagatgaagtctaaagtgatttactgtatgtagcaccagccttaactttggattcagctattgaacagctttgcccacatgtttctctaattctgtgggggcagaaatcggatggcaaatcactgtgagccaggttacctcagtgtcgtccgcctcgtgtgtgacctcacaaacacaggaactgaatgttattttcaagtgttggcatggagcgttatggtcatggaagtggaactgccttacacattaaacataatctcaccccactagaactttttcagccatgtctccagattttagcttttgggcgaaattccacggtttggttagattgaagtagatgttcctagatagcagtctaggagctcagctagaagctccaggggcatccatcatgttcttactattactaataaatctaatctgagccttatttcttactgagttcagtttcttttaaaacatacatttatgtattttaaatgctgtttggagaagtccctgagacagttccaagggcagggcctgcacatttcttacaatggtaaaacagtttttaaaatgtagggtcaggtttaaaaaaaaaatcccaagactaattctgtgcagaggagggacgtggaaggtgagcagagcaggagagccggttgtcagtttggaagcagcagtgaattcagagaaggttcctgtaaagtccatttctctgttccagccctattggtcacccattcagtatgatggcaaagtgtcacctgagcagagagtgcaagaaagtaataaagaaagctgaagtatgtcagaaagttacttccaaatggttagaggcatgtgatcgtcagtactgtgtgttacggaaatgtcaagaatgaagtattttaatgtatgcaagataatgttggtgtgcacagagggtcttttccttatctgattagtactgttaatgttcagagatttaaaaaaaaatgattgtttttacagtttagattctgagatagcgaaacctgattttcaaccatgccctgcatgagagacgcatcctaggaagtcttagatcatacctttgagttctttaatttatagagtgttttttatgttttaatatttttgtgaactggtgtaaattgttaatgcatataagcttgtgtatttttgtaaatagttttgtgatttacttcttgccccctgtgtaaatatttaca

SEQ ID NO: 34693 - DNA, 1151 bp, Mus musculus
tggagcggggccgcagagggtgaccaagccttcaagaatgcgtgcagaatcagacggactttcccgagactgtggcagtagccccggcatgccagggacaggctcgccagccattcttagcagcggtgggctgaggccctcgccccgcgcgcgcggaatagctggagcagcgccgccgggccaggctcgcccgcccttcctttcgcttttgggagacgggcggtgattggctgcagatgctaagccccgccccgccgccccgccctcgccgcctcgccgagtgggcagggcagcggctgggaccctgggcctgggctcggtgaggaacgccctaaagcggaggcgagctgcactgcgccagcgccggccagccgtgcgagcgagcaagggagcgagcgccccggacggaggagggagcgagcgcccgggacagaggagcgagcgggcgggcgaggcgcgggcgaggctgggacctaagcgcgctctctgctccgccaagtgccaacttcgcgcggactggctgggcgcgcaccttcccgcggggcggtcagcgggaatttgagattttagggttgcgctctgtccccttccactgggttcaaaaatccccattaaaaagcaaaacaacagttacagcaaacttactctcatcccgccggccccctcaactccgggcaccatgaaggcggccgtcgatctcaagccgactctcaccatcatcaagacagaaaaagtggatctcgagcttttcccttccccgggtgagtggcaacagtgaggcccccaccccagctccgggtccccttctgggctgcgctgctccctcaggagcactggatgcagaagccaggaggactgttggtggcccaagacccttggctttttttgggggggggggggctgggtgtatttattttcacagctgtgtgttttgtgactaatgggaaaacgcttatagaatttccagctccctaattccgttgtttgaattttcccacataagcgagaaacttctggtaatattccttaatgttagcaaggggcctgacactgtctctaagatcacccccaccccgtcccaactgtgtctccccagtattggagcttgatgggaggctcttgtgaagtgctgaaagggtgtctggctagct

SEQ ID NO: 34694 - DNA, 1180 bp, Mus musculus
gcagaagtaatgagtttctaagcagctaagatcctgtttacatgcaaatatcagcagtgacaagaagagacacggtacaagaattacgcaggaaatttggtgtaaaacagaattccctgtaatcaaatctttggggtggctttgtaatggtttggctttccacaacaagtcaacagttatatatgttgacaccatctgaatggctctgccccagagtgaaccctgacttcagtagatgccatctgtctaggaaggaagaatcttctcacaaaacaaaggccgagaaggtgtttgcgtatgtatgcttatctcttcagaggacctgcatataaatttcagatctgtgatatttaggcctttgtcattaactctcaaaaaacccagggaatattggaatgtaaatatttctactattagtctgtgaaccctttaatatatattgctctgttatttttttttaagatttatttatttatttatttatttatttatttatttatttattatatgtaagtacactgtagctgtcctcagacactccagaagagggagtcagatctcgttacgtatggttgtgagccaccatgtggttgctgggatttgaactcctgaccttcagaagagcagtcaggtgctcttacccactgagccatctcaccagccagctctgttatttttagaattaactttaaaccttgcaatgtagtgaatagacgctactctctcttatccaaagcgtcatagtttgaatgagagatgtctttgaatactcggtcttcagttagtgatgctgcttgggcaaactatagaacttttatggggtgaagccttgctggagaaaaaacgacattggaagttggaagggggagggggagagctttattaagattattagattattaacttattctacttcctgttctctttctttctctatctggaacaaatatggtctgccaggttcctgctctgactagcatgccatgtcttccccaccctctggaacttcttccccaagagccttctggaactgtcagccaacataaactcctccttacgttgattttggttgggctattttatcacaacagaaaacaaaataatatattcagaattttttccaaagactcttctttagaacaattttacagcaatcctggaaggttagaagacatagaca

SEQ ID NO: 34695 - DNA, 1154 bp, Mus musculus
ctccctcactggaagtctgcacttctcaagcagaagggttaagcctctggggttgcttgcagtgataggcagccactgatgtctttttagtcagtggcctttgggccctggtcttcagtgtcagcactagggtttgtttgtcctctggggtcttttttggcacatgtcagttttgtttatataaaatgaagagactgtctctctgatgatgggtttaatgaaaggcactctgctttgggtgtgggcggtccaggattatgtggtaactattgtctgttagttacctggatattttatttttctttttggatcttgcaaggggaaaactacaagtaacaagttttataaatttaatttaaattgttacaggttttcatgttcaggacaaataatttttcaaccttcgatgatatccttgcagcagtttgttggtaaggtgactttcacctagggcagctgttgcatgccaatttttttttttgtgtgtgtgtgtgaaaacacttcagaattgaattaaaagatgtaaatttaaaattggttgtgtatctaatatgccccaggttcagtaaataaacaattctttttaaaaacagtaaaaaaaaaaaaaaaaaaaaaaagaatgcagacataggattcaatcagtgtgtatttaaataacataagcatagatgtctaaattctgatgcatgttattcaatgaaagtcagtaaccttgttctcaccacatacaggcagcacacagattagaggtctaaactatggttcatgatccttccttttcaatgtgagattaaaacacaatatttttgtacttctagagaaatattaaaattacaaaggatgaccactgatggtataattatagcaaagacaaaataatcaaattgatttatctagagtctcttctataaaaaataacctatcatttgcaaacaaggatttctcatttatttttctgagtgcccttttgttttcttcttttcttttattgctctagataagacttcaaacactatattagaaaggagtggagagaatagacactttccttttctttgatcttagtggaaactctgaatttttctttattagcatgatcgttattatatatatacaggctttattatatttaggtaaatttcctccatgtgcag

SEQ ID NO: 34696 - DNA, 1220 bp, Mus musculus
tttctaaagacagagtgctacccctcatttttccctggctgtctccacagggatcaggccataatgtctcccaagaggctatcgccatcaagcggatgctagagatgggagctgtcaagaacctcacatacttctgacttggatgggagctgtaacaccttggttccctactttgccatctgagtaggccctgtctacagcttagaggttcctggtgccagtacaatccaattgaactcaccctcaatggagagggtgttctggggctgtccaggtctccagagaggctatgcccctgcctactttggtggatttcaaatccagacagggtagtcacaccgaggctacaggagcctggctaaaggggggggggggggtgctgttactgtggcatcccctctctcagccagcacaaagagctgttttgttttgttttgttttgtttcgttttgttttgtcttgtattgttggtggtggttggttgggttttgtttgtttgtttgtttttgtttgctttgttttgttcttgagacagggtctgactgtgaaaccctggctaatctggaactcactatgtagaccagactggtcttgaactcacagagatccaactgcctttgcctcccaagtgttgggatgaaaggcatgtactacgcctggccccaacaccaagagattatttaacattctatttaattaaggggtaggaaaatgaatgggctggtcccaggatgttcatgaaagggacacaatacagtgttctgcccactttttaataaaatttacatgtgattggcctgttaaggcccaattctagagctggcctcccagaaagatggaggcatcaagagtgggagggtgtcctccagagagaggttgctacttcccagcaggcatggggggagcattgacaagggggttccacctagaaggggcctcaccttgaaaagaggttgtaaaagaccattaaaatatttttttttctaaaatggaagcacttgtggggctctgtgtcctttcagattggggagaacattgctgagggtgaaattacagcagaatttttgagatggtaccaagggtgagcattgccatcctggtgtgcctagggtgagcattaccatcctggcagagcaaacaagcagtcagagcccagatcagccctgtcttcagacacccagcctggcatcttgcagcccaagggactaaggaagggagga

SEQ ID NO: 34697 - DNA, 1199 bp, Mus musculus
gagaagaaagagccatgcttccagggtgaggcagagagacaggcctctaagatttttggcaagtaagtaccagatgatggaacagggtacttaggactgagtggttttgcctcatcactaatgggctggagggtagatgaagctggaagaaggacaaagaccagctactatagtcaggggcctgaccctgttccgtcagattaatctctttctcttccctttgctgtatagccgttctagggaacagcccatctttctgcagcttaaggattatttttgggtaaagacgccatccacctatgagctgccctttgggactaaaggaagtggtaagttatttctcagctccgtgggcaagcatctcactgactatgaactgctctgaaggactaatgtgcttaatgacttgttctacccaagcaagtggacagacagttcaaggtctgatcttgtgggccacgttcttggatgttgctatccactggctccatgtctgggttcttttgcccaggctcaggtacctatgtcaaggagggagaatcttgggagtggaatgggagcagcctttagaatgctgatgaccgtggtcttctctcattctatttcttctgttccttttttttttttttttttcctgtagaagaccttcttctccgggtgctggccatcactagctattctatacctgagagcataaagaggtaaggagatattcttctcattataatctggcaccttcacttcccctgctccagtttgaactcatcatggtctagtgccttgcctttggttcactgtggccagtttgacctgccgtagcctgcctgtctccaggagctattggtactctaaaatcacaacgacttagcctgagcatctagatgccagagtacgcagaagctgctgaaggtattgccatggcaacagacagacctgggcaacaggcaaggaagctgtgtcctaggatttctcctcccctcttctttctggttttttttttttttttttttttttttttttggttccttttaagacagggtttctttatgtagcccaggctggatttggcacttcttcagtgccaagttacaagtgtgtgccaccttgcacagttcttgtgctggggtttcttgtggcactcctctcattatctctttgctatgcgtggcttgcttgtgtttcatattgaggtacaagac

SEQ ID NO: 34698 - DNA, 1099 bp, Mus musculus
ttatttagttcagatttggaaactgaagtaagcctcagatcaggtggccatacctgtgctacctctctggtactagtctcttggcatgggacatcatagtggcaagaatatgtgggtatacgatctaatgaaaagatagaaaagtggagattttggaggtcaggcacagactttttattaaaaaaaaaaatctgttttcataaaagctaacagcaaggggaagggtatagagtgttctacactacactgcactacactgacctctgtgttctaaccacaatcccacaaagaaaaaaaaaaaacactaagtccttccaagaatagcaccatggtggctgtcttagtcggggtttctattcctggacaaacatcatgaccaagaaacaagttggggcagaaagggtttattcagcttacacttccatgttgctgttcatcaccaaaggaagtcaggactggaactcaagcaggtcaggaagcaggagctgatgcagagaccatggagggatattacttactggcttgcttccccctggcttgctcagcttgcttttttataaaacccaagactaccagcccagagatggtcccacccacaatgggccctcccctcttgatcactaattaagaaaataccttacagctggatctcatggaggcacttccccaacttgaaggctcctttctctgtgataactccagcctgtgtcaagttgatacacaaaaccagccggtacacatgacctaacaaccttccaggagtgtgattgtttgaaggagaatggcccccataggctcccataatttttaaagattgatttatttaatgtgagtacactgtcactgacacaccggaagagggcatcacattccattacaggtggctgtgagcaaccatatagttgctgagaatttaactcaggacctctggaagagcagccagtactcttaaccgatgagtcatctctccagcctggctcatatattttaatacttgatcctcagttggtagaactgtttggaaagatttggaggtgtggcatttttggagagtgtgtgtcactgggattgtgctttgaggttttaaaagattttcatc

SEQ ID NO: 34699 - DNA, 1123 bp, Mus musculus
ttggtcactgtctgagtctccccagcactgtgccagggatacatccctttcttcaccatcccttaaaccaggcctcttccccggtgtctctggacatggaatgagcataggcacaaagacccagaccagtggaaagtgatgaagtgggagcctaggactgattgtagcctaggctgcttcactacctaaacagttcagctggcatcccaggcatggtgcccaggactggcctccttcctggtgctgatgcagagaaatctgaccagagccaaggcacagaacattctaggataacctggcccaaatttattgacttgtctattaacctgttctttaatctggccttatgttcttcctacttttcttctcatggtagaagcttttgaagtattgtgccattaaaaaggcagctttgggggctggagagatggttaagagcactgactgctcttccagaggtgctgagttcagttcctagcaaccacatggtggctcacaaccaaccatctgtaatggaatctgataccctcttctactctgtctgaagacagtgacaatgtactcacatacataaaataaataaatcttaaaaaaaaaaaaaaaggcagcctcttgagagtgtttcttagatcctctgtgggaggcatcttgtttgcaagctactatcctgttacaggagcagtggttctagggaaagaaatggttctagttagcttctataaacctccagcttctgactaccacattcagtctatagcaggattcagagtagctttctgactggatcatggagctttggggaaagaaggagccaggatctgaagagccacactgagaagcttggatttcacctcggcagaaacccagcagatttttaaatatggaagcaacatgatcggattttctttttaaaaatctgtctggctagggtgtagcccagtggtagagtgcttgcttagcaagtggatggccctggatgtgatcctcagcaccaacagagaggagctgggggaagtcactggtccccttgaagagaacaaagatagcaaagcaggaagcaggctgtagacaaaggctgtttagtctacttaacagataacagtcttggtgggaaacccgtgga

SEQ ID NO: 34700 - DNA, 1179 bp, Mus musculus
ccatcagtatcatcatggcagggagcatggtggcagcagaaatgatgcaaaagaagtatctgtgaactacatcctgatccacaggcagcaggcagagagaaagatagacagacactgggcctagtatgggcttttaaaacctcaagacctattcacagtgacacacctcctcccacaaggacacacctccaaatccttcccaaacagttcatcagttggggactaagcatgcaaatatgagcctacagggccattctcaatcaaaccaccattttgtgtctttgtgtttatctttgtgtctgtttatccaggaaaacttgttctgcagctgctcaggagacatcagacagacacagggagagtctcctgaggggagaaacatgggaggaagtccagctcactcatagctctctgctttgccccaaatggcccatcagtatatgttgattggaacactagagctagaacccagggtctcatgcatactaggtatataccctgagctaacccttcctgaagggcttaatttttaatttcctccctgcaggtttcatcacttcatctaccccaatgaagaccccaactggggaacatgtagtcttgagaaggatcaacaatgtccatgtaaatcccaagttgtattgtgctttttataaagtggagggcaagaagggagataatctactcagatgtcggtcttctacctgcttacagcactgataaaagttgggcttaaagggaaataaacatgtcaggatccattgtgtgcccttatttccctcacacacagcccaacttccttccttttaccctctggttcctacaggtgaaaatggacaagagcctggagtatcaaccagtagaatgtgctgtagtgatcaatgctgcaggagcctggtctgggaaaattgcagagctggctggtgttgggaagggacttcctggcaccctccagggcaccaagctacctgtggagccaaggaaaaggtagctaccgtcagggcagctaaggatgaaaaagaactgttacaaaagtttaggatgtatttgtgtgtgtacaagtgtggtctgggcagagggttggtgagtgttattcctgcaatgtcataactcacctgatcgtgacaggtatgtgcacttatggcactgcccacagggaccaggtctggagacaccgtt

SEQ ID NO: 34701 - DNA, 1212 bp, Mus musculus
gtgtcctgtctcctgtcccagctttaccccttgtccttacctggtgtctgtctgtctgtctttttttctcacggggtgctagaaatgtcccagaactcccttgttgagggcaggattatatctggttatttcccaaacgtagtccaaagtctggttttgctgtggatgtagcctgactgctgaaacgctctttttccaggaacggggcggtaacaactctttcactcatgaggctctcacactcaagtataaactggacaaccagtttgagctggtgtttgtggtaagtgggggtatgttagaaagacaagttatgttctcaacagcatccccactgatgaacctaattaattgtgggtattgtgtatgtgataaagtgatagaaaaaagttaggaatgtggaggggagaaagcaagcgacttctgggtaagattgtaagcttggctctcccggggcaggaaacctatctctggaggcttgggttgagttggcttccttccattctgggctggcatgtaaggagatctattggctccgtctccttccataaacaggttggctttcagaagatcctcacgctgacctatgtagacaagttgatagatgatgtgcaccgactgttccgggataagtatcgcacagagatccaacaacagagtgctttaagtctattgaatggcacatttgatttccaaaatgacttcctgcggctccttcggtgagaggctttcctccgttcaaagggaaaattttcatgatttaagagtgcctgcctgtcggtggcgcatcaatatttacatgggttcaaaccagtcacattttgtagcttgtttcttatagtccttttgatatgtgggatctttttcttaagtcagagttgtcctcttgtatgggtagaaagaccaactagtctcttttctctttagtgaagcagaggagagcagtaagatccgtgctcccactaccatgaagaaatttgaagattctgaaaaagctaagaaacctgtgaggtccatgattgaaacacggggggaaaagaccaaggaaaaagcaaaaaacaacaaaaaaaggggggccaaaaaggaaggtgtgtttgagtttcctgaccctgctagggcatacaagatgttagcatagtattataaaactctgtggtactctttgacattgctagcctcctttaacttaatgctcaccaccctatcactccc

SEQ ID NO: 34702 - DNA, 1411 bp, Mus musculus
catacatcacaagcaaacccatcgtctttgtgggtactggccagacctactgtgacctacgcagtcttaatgccaaggctgtggtggctgccctcatgaaggcttaatgtggctcttgcctaataccaaatcgccgcttgccccaagtccctattcctatatcaagaatgtgctttagagtatgtgagcaacttgtcttcagtgtagtacaaaggcagagtgaggggagctttggagacttgcagctccttctaacccaatcctttgttcagccctacctccttctgcaaggagggcctaatcatgttacaatcactgcccaatgaccctccctcttcctactcaggcatccccttcactctgcctacagactccatatcatagctttgaccaatggttgaaaaacccaacacctggagtgttgctaactagtgtgatcacagagccatggtgagataaggagcagtttgaggtcccagctctaatggcttaattccagagccagctctggatcttaatggcatctatctagaagaatacagcttctgggtccctggtgtcaggatgacagccacctcactgtggcagtgatggtggcccattcttaattgctgctaattataaatctggtgatgaactctacacccgattgttgccccaaagcatcagttaggccttgttacaaatgagtgaaaggcgagtgcccacttctctcagaaacacggggagcagagttgccttccaacctgtgcctgctcccaaaatctagatggaagctttgcatgtttccttcctgggagaaagggattgttgagaaggattcctgttgtcccgtacccaccccaccctcagcctcctgggcaggtcctggcttttcctcattctcttctacagtgcctggtagacaagtgctacgttgaagaacacaaacctcttgttaagacttgtcctgtagtttggtattacagatgtgctactagtgcaataaggtgaaggctgtctgcccagagaaatacataatttatataagaaaataaatttcataaagaaattgcctcttaggttcatattattttatacaggatataaaataagaatgctaactcatactaactatatagttcttgagcttctttttggcaagggcatgataggaactagtagtgctctaaggaattgggtaagtgcctgtcctgagaaggatcaccaccctatgatgaaaatagaagaatgccagtttttaacagtaactcttcaaagtagagccagagttctggcaagtaaatgaacaagcttttaatacagctcagttatgtaaaatactgtacactgtaaaagatctagaaaactagagcttcaagtcatgttttaaaaaagccataagctcaattgaaaaaccaagtggagtaca

SEQ ID NO: 34703 - DNA, 1234 bp, Mus musculus
ccccgccctcgccaagatggccgcgccctgcttgcgtacgcctggtgtccagcttttgagtatgagttcgcgtcccgggagattgttcactcccggctcctggtcgttttgttccagcgctacttcctctaggcccctgaatgctcagagattggcagagaagctccgagcccagaaacaagagcaaaaggcaaaggaagtgcgggtgagtctagagagactcaacttccgagaagcgatgctctcacggctttcttaggtgtggggtgtggtaggcaggtcctgtaacagcaagtacatcaatgttgagaatattctgtgtggtagtcggaataccgcacttttgctactgccagacccaccgcgtgggtatgcagataagacagatggctatgtatggtcccaaaggaaacatgagtcaaattatacagtacagtcattccacggatttccacctaaatcgcacttaaggccattcccagcgcttcactccttcattaagctttttccacctttctctttccttaggtgcctacaaaccccgttcagcggagagtgcaggaactagtgcgattcacacagcagctgcagcgagttcaccccaatgtgcttgctaaggaactgagccgaaggattctccaccaggacaacgacctcgtggtcattaataaaccctatggtctccctgtccatggtaagagccatgtgggctaaggagagaaacctgctgctgcttcctcttccatctagggtcacccctgaagctttattcatgagacactcttgaattcaagttaattaaaccttattatcccatgtatgtgactactggtaacaaaccagtgtctagtccccacttgcagatacctgacagtgagctgtatgcagcctcccacaggaattattgcagagagatacagaagctcagttctgcactgtgggctgtgtacagccacccacaagaatcgatgcggagaaatacaaaaagttacttgctaactgttattttccatcaaagtggttaaaacaaaacaacaacgaaaaaggagttgggagccagtgtgcgactgccgccccaggtctaggggaggatccggtgttcatgttcagatcagtctcagcagcagcaaaacttcatttcaaaatgagagaggtagagagacaaggctgggaagaggaaataatacacacggttgcggtacacagtaaccccagagggactggaacttaatag

SEQ ID NO: 34704 - DNA, 1126 bp, Mus musculus
tagaattcatgatgataacaaagagtatatgaactagcttagtacttggaatgtcgggtgataagatagtggttatgtgcacacgtgtgtgtgtacttggagaagtcagggttctttttctgtcgctccctattttattgacatagggtgtctcacagaacctgaaactcactgattaactagctagcctccagaatctgctagtctccatccccttgaacaccggggttgcaggcgtgaactgctataccctggctttccatggatgctaggattctaagctcatcagcatgcatgtgcaccaagcactttacccactgagccatctcctcacccccttttgtttgattggtttggtggttggttgtttttgataaaaagccatactttgtaactttggttggcctggagctggctacatagaccaggatggacttgaactcccagagttctgcctcccaaatgctgggtagaaaggctggtaccactctacccagtgctggtttttaaacatttatttgtgtttctgtctgtctgtctgtctgctgcctgcctgcctgcctgcctgtctgtctgtagtacttgggcatgtgcttgtctattcttctccttccattttgtaggttccagggaatcaaactgagtttgtcaggtttagaagcaagcagctttatctgctgagccatctccatagctactgacttgttttttgagacaggtttcatgtagctcagtctggccttgaactttgatcttcctgccttctgagtgctggaggcaccataccttgttctgtagcagtgttttttagagcatattcctttaaaaacagacttgcagctttgaatagtatgcatgttaaaaaatttttttttagtattcctttgaaatgaatttttatttcgtgtgtgtgtgtgtgtgtgggttttggtctgtgtaccacttgcttgccagaagagggcattggatccctggaattggaattacagatggctgttagcggccatatcagtgctgggagtgcattctgtgctttcatcctctgagctatctctctccagttcatgtttaaaattttaatagtatctaaattgctctccaaaaatgttgtgtcagtttcacctct

SEQ ID NO: 34705 - DNA, 2164 bp, Mus musculus
atcactctgtgtcttccagggtcttccgtggcagtaggaacttgtgctgggtcccatcctcaggcctgttcagttgtggggaggagggttgcccaagccacttcacatttgtcaccagtcattcctagatggaaaactgtcacttctcccgtgtcatcagactttctgggaacatttagaaatcaaccatagttgtgatcatttgtttataatagccaacccaactgacagattttttttgactgccttccagaaaaacactaatactgatttattttctctctggcctggctacgaatagtgatcagtcttctaggtttcaaccagccagtgttgttatgaacacggaagcatgtaaagtctgtctggattattgtattatgtagacagggaaccagactcagaaagaaaattaattccttcatggtccactgctttcttaatttacaaaatggttgtcatgagttctttgcactgcttgcaagggtatataatacaaaaatgaggcttttaaagtgatagtttgaagagaaagctgttacacgcctcaagaaagagaagggctgaagggacctctgagtgaagctcttccgttgatcctatagtacttgtgatgctcaactacttggagactgatatttgtgtcacttctaacatagacagtgtcctggaggatctgagtgagcatgtgtgagtcaaccttctgccactatagcaaaattcctgaggtgattgtcttataaggacgcagggttatcttggttcccaagcttagttctagtttgtgattgaatagacctgtagctttgggcctgtgttgagggagcacatcatggtggatatgcatggcagagcaaaatagcttataccacaaaccagaagagggggagaacgagaagaacagagtgtacaagtccccctctcccccaagagcatgcctcagtgatcagaagacctcacacttccctgctcaagattctaccatctcgggaacatgttgtcatgggactcagaccttgaacacagagatggataggcctttggaaaacagtatccaaaccaaagcagaatgccgggaaaggcttagtttgaagaaagggtttgagggcatttttggatagtttttctggtcgctgtcattatgaacagtaactgaggcttcagtcagcaggatccatgcaagcagttactggtctctgagtgacaaggacatcgcggctgcctttggaaggcttttcatacaaacgtgtgaaatagaaaccccaggtgctacaaatgcatttcagtaacttgaaccaggccctgatggatcacagatctgcttttgaatggtgtatcccttgggggggggggggcgcgggggggggggacaacaaaattattctctttatgtggaatcagacaattccaggatacattttgttttcatttcccacaaattgcagtgaaagagaataagatactgtactaatcaactttatatacatttgtcagtattcccttacatatgtctgtatcttttataaatagaactgtttgtggaaatgtactgtttcagcaggggccactacgcaagcgttccttctgaaaaatgcagtaaatagaattccatagctgggtagcgggctgctgtagaagcgagttctatgatcctggggttcatggccatagtataagagatatgcagttagttttggaggtagtttgtagccttacatcttgacttgcaaagtacggtgtagagacctactgtgtgctttgccagttgagttgaaacaaagttgtctcagagtcggggttttggaaagcgggaaacaaatgtctgtgggcagtcagttgttcactgtaactcatgaaacaggtatgctggctcgagccttaggtcagaactgcttttaaagattgaatttgacatggggcttgcccatgaggaagatgaaattcctttacctttagggcaatctcattgtggactgctttatttatgattagtaacgctgttttaagtgttaacccttttattgtattttatttataaaaatggctttatatattgagatatataaatataaatataaatctatataattgcctttatatttaggagtttgagttctccttattgtgagtttctgtgaacttttgtgccctgcacagtcaccag

SEQ ID NO: 34706 - DNA, 1104 bp, Mus musculus
gggggaggggtcaccagtcattccaaaatggaatggtgcgcatttgtggagaaacgattgtttattagccccctgttttctcatctgacctccacaacaaatagagtaggcatggaattcccggccgacaagtgagctagagcctgctctggagcctactctacctgacccatcaccacgccccctttacctgctttctggaagtgttatggttcactctccgtggaaccagtccagaacgtgtgctgttgtccacccctgctgcagctggtggggcttccctctgtccacccgcatctcagactggcagagctctttaccaagtacttcatgttcgggaatctctccttgatactctacccttaccctcacccaatcccaccctttcctaacctcatgaagatttaaccatcaactggcccactgaccatgaagctggtaggggctcttcgtggttcgggagagcctttgttcagcattaagcttccctagtcctagtaaatcatgtctccttttcctggttttgttcaccaattatgtgactggctctggtgacgggtgctgtacagggtacaggttaattgtgtcattctaaactgttgaggtgatctcattgttaaacggttcttgctgggttctctttgtacagttgttactccaggctgatcacgtcacatctctgcgtcagctccagcactaccgagagactgttcggaactgtcctttctttacctgtattgctcgctcttacagcattggccctgcgatgcatgccttgtgctatattgaaaaaatatgttttattttccttaaagttgtgctgttatgtgtgaagttgtacatactctaagtgatgtagttttgacaggttttatttggttggcatgattttatattaaaagagaatgctgctttcacgtgcagtcgcctgtgaagagggatacatacatacacacacatacacacacacacacacacccctggggacacagagtggcttgtgactgagagtatataaatgtcctatttggaaatgttccagaacctctgccttgttgttctacaaaggccctgtgaacacccaagggcccagccacctctccc

SEQ ID NO: 34707 - DNA, 1132 bp, Mus musculus
tgtctacttacagagagtgaccctgcagaagatgggcatagccaaggtagggtgctgtccggtacagctgaagatgctgccatttggaagtccggtggttgtataactccaggtgacattgcccgaggcacttggaccaatcccctggggcccttcccagtgaagttgagcatttggaaaccccccaggccaggtgcatagcagggtcacaaccccaagggtggggagcacggcacaggagggctgcccttcagggggatctgggtagagaggtgggtgagaaggagctgaagcagctttccttgccagtgcccagcaggcctgacccaggtcagggtgtggagaactggggtgacaaaggagaaggaaataggcaagtagtgttggtaaagaaatgctaagccttcaggtccaggaacaaggggttaaaggctaggcaattcaaagctcctgctggatcccacacccttggttttcatctttgcccctgggcagctggcctcactggcattgcagtacccctctctgtgcctcagtccaggtcttgagaccgtggggacaacgactttgggaaaggactgtggaagcctaggagcttctcgtttcccagcctcttcccacggtctcccctagcctttccctagttctcccccacagccaacagtttgacactgttccccaagggggctggagatggcctgagcacctggctcagctccagatttggctgccctccccacccaacactcacagtagatgatgagctggacagtggtctgggtgtgggtatctaggtgcctgttgtgagccaggcaggtgtacaggcccgtgtgggtgcggctggcactggcaatgatgtaggtgggcccagtgtggatctgagagtcatcacggaaccacacatagtgactaggtggattggatgcagccaggcagctaagtgtcacctcctctctctcactggcccagaacccatcttcagagaatcccagtggttccacagtgatcacaggcttgtctggaccatctggaggacaaggaagatccatcacctcgctccacccttgccttttcactcgctcgtgctattgctgctgattctcttcacccattccaggagcacatggcacac

SEQ ID NO: 34708 - DNA, 1154 bp, Mus musculus
ctgctgtgtattcttacccttgtttctccttagcatggctgttgaatttcctctagtcttatatgactgtaaatttgaaaataccaagtggatttatgatcatgaggttcaggaattcaatgttacccacctacaacagctgtgggctaatcatgctgttaaaactcacatgctatatagtatgctgcaaggtctagactctgttatggtaacatgtgcagcaggaacaaagatggatgaagcaacagaatggagaaacattcaaccccctgtcataaagcacacgagtgcctttgtagaaggagtgaaaatgcgcacatataagcccctcatggatcgtcccaagtgccaaggactggaatcccggatccggcattttgtgagtagaggcagaattgagcacccacatttactccataaggaagaaataaaagccagaagggactgtgctgacaaagaagaaaatactgttgtagagaatccaagtaagagggtttgtataatagatgcagaaattaacagcattgcataatcctaggaagcctagcatctctaacaggatccagggagcaataaccagttaaaattctaatgatggcaaaagggcctaacaagttgttaaacagaaaaggatgtattctctaatccctgtccaaaagagtgatgaaatgaaagacgcaaaaagcacttgtcagttatatgcacctggaaatccgtgccttgtgttcaaatccattaaagtctggtctacaagtatatttgttctttttcaaggcaaatgtgataactaataatctcaaagatctttgccaaagtgtcttacttcctaagaattcatcaactaaagatagatagatgcattctgtgccaggcatgaagctacccagcatccacctaactcaaggctgtacaacatgttttaacgaggcagctaagtacagaggcagagaaactttttagtaagggtaggagtaaaaacttttaggttctgaataaaatgatatattgaactcatcttaggaccctttagagttgtgaaaacatttttgtttcttgttgaccaagttctggaaggttcaactttgcagaacttgagacagaagaaagaaaaaagttttgagtctcaaggtgtggaggcaaacacctatactccc

SEQ ID NO: 34709 - DNA, 1195 bp, Mus musculus
agtgacataatatgcagtctcatgtatgtattgaatttagtggcttaatgaaggctatttacatgcagaaagctatctgcattcatcataatatacttgattctttcagccataaataaattgaatataactgtattatttaaaactctagctggaggagtcttagatgagttggcattgctgtttgctggcattggagcagtagctaagttggttggttttgtgtacgaggatggttaagagagtcactgagcacagtttacatggtcagcactgctgttgtgagaaacagtgttaactcacttgtcactttctgtcatgtctagacttgtgttgaggtgtgtcacattctcagcctactttgtgtgataagcaaaaacataatgggaaaagctttttaaataacaggtcttagctttttaaaatttggggtttcaaaaacaacaagagatgctgaaaagatgttaccttttactttggtcagatcattacgtatgctctgacatcttaattttctatacttaaagtctgtattagaaatatctgtataagtatatacataattaaaatgtagctcagaaatatgattcaacagtggagtttttttttctggaaaaaatatagtcctattgtatcagatttattttactttattatggctaatattctaaaaagaatgtttaagctattttaaattcttgtgcctcttcccccaaaggatatttaaaaatatgatcttatattaactttatattctttcttcgtaaattttgccttaaacattgtgccttgttttattagaatctaattctggcttttgtaacaacattttattttaaacagacatttacttttaaaaaatccttataatgcttgtatttgctatatcactgcttatctgtttattgaatttattgaatacacaactccaaacattaaaaaaaaaaattaaaacaaataagacaaaagtgagatatgcttttggtgaccttggggggtataattgcccattttgtttttaaaaaaattttcagagtgagatgagcacattcaacaattccttgtccctttgagttataaggaattccagttttatgtttgataccaaagtccttacaaaatgaaatataattggccagtataggatggtccattatctgtcttaatgactttaggcaatcccatagcattaaag

SEQ ID NO: 34710 - DNA, 1102 bp, Mus musculus
taataacacacttgagtttttattttcccagtgcctatagctaatagatctgtgtcccctctcttcaaagaaaccggttatatatcaacactgttaacaagtgttaacttgtttgtctgtaaaccatatgtcaagttaagaatttgatactttagtttttggtcataatttttaattccatttgatctaaagataggattacatattcaaaatagtttcattcagaaatttgaggatgaattttcttttcagcctaaatttgttgtcaatgggacctgttattcagatgccttttgaaatggccatatgagtgtgtgcatttatgtgtatgtgtgtgcatgtgtgtatgtgtgtctctgtgtgagggtgcacatgtgcttgtatgtgtttacatgttctataactgacaatgttttatgatgtgctggagttcttatgcataccaagctatgcatagtggctcatagctatgatcccagcacgtgggatgctgagccaggagaactgctgcaaatttgagaccaacctgaagctgcatagtgagttctaggttatcctgaacaatggctatgttcagagatacgatggccaaaataattttagttatgatactaaagacttaaaaagtggtaaattattttattgaagttaaatcctgttgctttgcaacttacattaagaccagcagctgctcttgagtcttcaaagttgtggaagagatgtctgaaaggagatggacttgtttaggaagagaggagtgatttttggtcttgaaaaaacatccacatgttggtatgaagactcattttaaggccatgcatatttggttttggaatccagctgtggctctcactagctatgttactttagtcaatttgtaattacatggaataaattattaaataatgttatttctttatttgtataataaaggtgattccatctttcctaacttcccttctctttcctgagataaggaacaactgtacacatgaaaacaccttgaagtaaaggactgtaaggtgttgaacctgttcctctatagctgagtagatgatcctctcaaaatgatttaagggttatgaattgcttaaatgaaaag

SEQ ID NO: 34711 - DNA, 1149 bp, Mus musculus
gagggttagccttcggtgtattgagtagctttgattccctgctagatcctccaaataagctctcacattcattatcttgggggttgagattttggtataaactgtagtgggaaataaacttttaacccattatactttatatcttattcttaactaccttgaaacttataacccagaggtttattttcatgaagtataaccattaaattaaaaaatctcaacacttcctttggggttgttggagattaaacccagggcccaatacctgacaggcaagaattctgtcactaagttgtatctccatctttaatatgatacctttgaaaagagtaagtttctatgaaacttagcatgaaaaccatattgaattactgtggagaaaaattgtattctttttatgttgttcattttccttttatgtgcttatttttcttgacatatttgttacgtaactttatgaacactcaaaaactgtaacttgttttatttttagaattgccgtgggaccagcccagtgatagctgtcaggaatattctgattggaaagaaaaaaaaacctatctcaatccttggaaaaaaattgattctgctcctctgggtaactaactgggttgtttgaaagtattgatcctgtgggtaatagtgtcatggtagttgatttttttcttaactctctcccccccttctccttcttttcttcctcctcctccttcttttctgacttttttcttccttcttcttctctgtagtccttttaactaccttagaaaatgtaagtcaagagggaggaagggaggaaaggagggagggaacaactctataattgtggcatttggaaatacacttttaaaaatatttttaaaaaatctatatatcaaatgtatactgtatgtatattagttataagtatatgcttttgcaaaaggtaaatcctatttcataactctttagttgtgatgctcagcatttttccacatctttaattatgggcctggatcatatttttaaagactgatggtactcattatgtggatatattttactctttcaatttagagatttaggtttctccttaattttacttttatagaagaagtatgataagtgtccatgttacttgatgcttgtgtatcctttatttgattaaag

SEQ ID NO: 34712 - DNA, 1169 bp, Mus musculus
ctgtgcttggagtcatggcagtgccttttgtggaagactgggatttggtgcaaactttgggagaaggtgcctatggagagtaagtttgagtcctcattttaattttttattgcagtgtgtgtctgtctgtctgtctgtctgtctgtcgtgctatggtgcgtgcacctgtggaggtcagaagacaacttgcaggagctggttctgttgaaggtttggagggatcattaggcctgacagcaagaggcttaacctgcctggccattaccatggtcttcctaatttaaatattacctgtttgtttgctttagttttccacctgttgtctgagtacacactttaaaaaaagtcctttatttcaagtggcaaagagcatggatattcgcatttgtacatcaaggctctgagtgagtgaagcacatccacacctgttcctcctcttttgtgatggtagacattgaacctagtgcatcactcatgctgggcttatgctctgccatgagctacatttctaggcctgtaaaacaccaaatttcttcttacatttgtttttgttcagatcaaaatcttgttaaattgcctaggttggccttgaacttgtacactgtagcctcccaggtaggtatgacaagcctgtgcttgacggtccaatttcttttctttcttttttttttttaattttacttttataaaattttcttttataaaagaattgttttcctaacaaatcatgtgtcttagaattttaaatgagataatgaaaagaccctggcggcatcctgcctaatttcagatctccacactcagctgatcctggttgtatttgtgttcttttttttttttttttggttttttgagacagggtttctctgtatagccctggctgtcctggagctcactttgtagaccaggctggcctcgaactcagaaatccgcctgcctctgtctcccgagtgctgggattaaaggcatgtgccaccacgcctggctgtatttgtgttcttgagcaagctttatgtgcctttgtttcttcatctgatgatagaattaatggttcttaccttaaagatgtgttcagtagttggctcaggcatatatgcatgagattaataagtgtaaagtaatgctgttgtattactagatcatgtgtatatgtgatgtattgtagactt

SEQ ID NO: 34713 - DNA, 1197 bp, Mus musculus
tttcattgtttccttattttttgtatccaagtcccttttcttagaattgacatttctctattatgagacttttgtatgcttggcaggcattctaccattatgccataagtctagcctagttaaggaatattgattgtgctccccaacccacctccttttttttttttagataagatcacacacactcacacacccttggctcaggctgaccaacctgaatcactttccctggctcaacctccctagactgaggttatagatgagtcaccattaagtctactttgctgtttgttttttcttgaaagcgagcatcttggttgggtatctcctgctttatctctatagtgtggtgggccaccgtgcttgtttaagaaagctagtacaggcaaatagtcgtgtgtccccccccccccaaaaaaaaaaaaaagatttaactggttctggagcctcctgttcaggcaatattggtgactctcactgcactttcccctcacacatccgcggcgatgtggttttttttccccttcgtttttttttttttttttttggtaagactaaccctgtataactcggattgccttgaactcaagatcttcttgcttacgcttcccaagttctaggtctacaagcatgcaccaccacacttgctttccttcgttttttttttttttttttttcagaattccagcagcagttgctagcttctcaattcgaatactaaggggggcacaattgagtttacagagcactctgtgtcgcttagtttgagccttcctccctggggctccgaggtcaagagcaggtcggtttacgtacttaacggtgcagcctttgcaggctctgagtggcagggaacctgggttcttggcccaactggtggcgcagtctggatggaggcttcggtgcctctgtggagcaacgtaaggcgtggcacacgccccgtgccatttccatttcattcggactcagagatcagttctcaccaaagcagtcgtcaataccaaatctggtcagcttgtgtcttaactacggccacatcagaatttcagccagtattagaaggaagggtccttgcgcggtcggtctactgaagtcgctcctctgcagagcctgggataggacaacgcgcgccggcccgctttacggcagaggtgtgcgcttttgcgacagcatgacgcaagcaggttttggcgggaa

SEQ ID NO: 34714 - DNA, 1226 bp, Mus musculus
tcatactcaatgcatagctgggtatagcattccagactggcgctctttacattataaaggcactggcccactgttctaatgttgagaaatggcagttattttgatgagtatttgtctattctttgccccagatcttttttgcatcttttttgtgggtgttcactgtcctgggtactctggattttcatgtgtgcatagtcaaatttttctgtttttttttttttttttttcaaacagttatatatggattcctccaattctctgataaggctaattaaaacgttcatattttaggcaacatggtatgacacttgaaatatttaaatttttgtgtttgggtgttttaccacatatatgtgtatcatgtgcattcctagtacccatagaatccagaggaagacatcagattcctggcactggagttatcgacagttgtgagttgccatgcaagtgctcggaattgaaccctttgtaagaacagccattggttttaactgttgaattaactccccagtccatgatgaagttatttgagtgtggggctttctgagtcagttttctaatagtttcttagttgctcttctttattctacctttttggagatttcctcagctgtatttgtggtcttgctctgttttcccctccctccctccctccctctctttttcctcccttcctcttccctccctctccccttttgtatgttgtgcgtaggtttaagcccagggccctgtgcatgctaggtaagcactcttaacagtgagcaacatctcttaatttcaaccatatttaaaaaaaataacttttttcttttctgctttcatatttctaaagtcttaagcactcttgtttagagatctcttttgtcccattgttttgctgcctttccaattaaagacttttccaaattcttggctgactgcttttttcagactgggtggtctaaagtgttatggagaatgtgtgcatatgctttttaatgtactatgatcaggctgggctggcacactgagaagttgttgatattggtgttagatttcctttttcttccataatatgtgttaactttccttctttcttttgtacataagattcaggatttctgtccttttattcaaggatattggccaggctgttgcctttctaggttaaagtagaaaaggaaagcatattggttcaactctcagtacatacacttaaatttaaatgctattttcaggatagc

SEQ ID NO: 34715 - DNA, 3255 bp, Mus musculus
tcttcagacacaccagaagaaggcatcagatcccattacagatggttgtgagccaccatgtggttgctaggaattggaactcaggacctctggaagggcagtcagtgctcttaagccccaaactatgagtcatctcttcagccccaaactatgttttctttttgctgaatttatgatacataattatatgatgtcatgtaagagtgtgttacatctcttatatgagaaatgattgaaccacatatctagagaagcagaggcaggggaattgagtatgaggtcagcctaggctacatagtaaagccctatctcaaataataggaaaaaaaaaaaaaaccgaatgattgaagtcttttggtcaatgtcaaagttagtctatactggttcttagaggtactctaaaaggctagattgacagtaggtaggctttatctcatgctaatttattcacatgccaaacatgtgtaatcctttctgcttacagtggaacttgtagatctttccaagttgacctttcggtaaatactgaagttatgtctttatgttgcaggtaaaggacctggataatcgaggcttgtcaaggacataaacgtcacattgtgccctgagcattatgcttcgcactgagcgcgtcatgttgaggacgctgaagatgttttttatatgcagtttataagaacagccggatggggttagaattgtctgcaagttttgccctggacaatatgggctgggccaagtgaaatgatttttataattctgagcaggttaccaaatgaaatgttatggctttactttggtcaattaaaaggggggggggattttttttaaatgtgccttatttgttttgacttaaattggctgatacgaggatcacagaagtgagcggatggaagaccatatccatgctctaggtccccaaatgaaccagataggagcatttttttctcctatcagcaatctcaaggactagctctggttcaacaaatgtaaacaacaactttgtcacacttttttgttttttagcacccaggtacaatgctttccttataatgggtgcttaataaatttttatcaaatgaataaatgtttctgggaccagaggagtgctgtttctgggcaagaaagacagctttcttgctgttatgtctatgttctcgatgtctatttctttagaagctctttggctttataaggacagaaagttgctgagtattcctgatctcaccagtatcctttcaaactaatggcagttattctttttctaagtagaaatgtgaagcaaaagtgactaatccagtagttcttaagatcagtgaaacatcaatcctagaggaagacactcctccaacatcaggttgatgatcagtagatgtttctggaatcagatgtcattatgtggacctacatgaagtttaggcattcaatacttcactaaacctaaaacatagtaaatggctctttgctcattttctctagactgcactaaatctcttagggttatccaccgtgagcttctgtttttcttaatgtcagtctgctgtgttcatataccactttgaggcttgattacttggttttgaatcccttgctaaatatatacataggaagtgggaagtattgctactagcaggtactttgatatcattgccagtctgactgcaagaaaagagacttcaaaaactacaaagcacagagatcccatagatattttgtgtcaggataaatagctttctgttctgtataataggatatttcatgtaatttacaacatagggcataatcactgatgtatataaaccatcttaaattaattatagtgtttctatttaagaaaacaggaggaattatatgacttttagatagtcacagtggtactcaatgcatatgtgcttaggtgtacttgtatacctaagggcttttccttcaaaccggtgtatgtactgtgtattttaactgtgggtgaaattttagatttaacagatgatttgatatcctatatgtaaatacattatttgatttatatacagaactactgcctagtgggaaaggttaacctgagacttatcaatatgattaacattacaggttattagtaagctttctctatagtataaatgggatacccccttttcatatcattttgactcctgggatcttgatattttctagtctacaaagatttttaagttgatttcattttcagttgtagtcttcttagtgtaaaaaaaaaataaatccacctcaaaagcaacaataaaatttcacacacatgcccacccacacacccagccagcactcgccagagactcttgcttccaggtctggtgaacctcgcactgtgcctcctgcctgatcattagtaacttgctttgttatgttttggtgttttagtttgaggtaacattgatttcttttttctttctttcttttttttttttttttttttaaccagtggctttcaacattgtgcgtcatgttctctttggcaaaccattatctcccaaagtatttacattgcaattcataacagcaaaatcttagctatgaggtcacagtgaaaatacttttatggctgggatgtcaccacaagatgatgagctgtattaaagagtagcagccttaggaaggttgagaaccactgccctatgttttgtgacaccatttttactatcatctgttactgttctaattactttttttttttttttaaagactgttccatgtagctcaggccagctttgaactcaagatacagatgatgctagctttgaactcttgatcttcctgcctctacctcccagttgtgggctactacagctagttaggtactatttttcctatatattttaaaggaaatactttaattttttggtacttgttatctttcctgcttccttaccaccccagctagttctccctcatttgtgcccattttctcatactgtgatcaaacctattcgttaaacaactttgggtgttttgagacagtatcttttatagctagggctggctttgaattcctgattctcctctctctatttgccaaatgctggtattaagatgtatgccaccatacttagttacattgggtttttcagaatgtctttgatttttcagcttgaaataactcttcaggtttgttgaattatattattttactgttgtatttgttgatctttgccattttcattgatttgccatgtcttagtatcttcttatatgtaggggaaatacatttctggagctcttctc

SEQ ID NO: 34716 - DNA, 2287 bp, Mus musculus
taggtttaaaggtgtgcaccactgtacttggcttccagtttaactttttattgaatgcttatgaaggcttagaataaaatattatagtacagatgcatttatataaaagcttgaagctatgtagcctaggcttgtcttgaatgcagaaaactcttctcttagctttccagtgctgggattatagacagtcaccactgtgcctagtttccaccttgtattatattcttacagcacttctaaattggtaagaatcatacttcaagtgcttatttaagtaaatgtggctactggctacttcttgcagtaccttagccctatgtaatttgtaggaatactttcagtgtggcttaagactggaccagtaatagcatacaatttcatcaattaacaatttctaataaaagttttatatttttaggaagtgttttgctagcacactatcctgtctttacagttgaatgatagcattccttattaggaaaatacgatggaaatttctttagaaatagtgatattttcagtgagttcctgagaaccggcagcctttctcatgcagcagtgcattcatttttttctctagatatcaacaagtttctttggatggtccggattggaggaagcacagagacaggaagacacattaaggagaatgactactatactcctactggggaattccgtgttgatcgtgagggttctccggtgctgctcaactgccttatgtacaaaatgtgttactaccgctttgggcaggtctacacagaagccagtgagtgtgattcataatgctaacagcaatagtaatagctgacacatactgtgttttccatgctctgtgcttagtattttaactcatttagtcctcacagcaacccagaagataatttaaactaatgttaatgtcatttttatatttgaagaagttgagcccacaggttactgaactcttgctaataattatgtgataattaggattcaaactcagtctgcctttaagttctgtgctttaaaacattatcttttattttgtgtatatcaacaaagaatatctcagtgtgagaaagaataaaagaaaagagtgctttttcactatttagataagtacattgagaaggatttggtcaggttaaatcctgtctttcagatttttttcttttttctttttttttttttctttttggtttttttcgagacagggtttctctgtatagccctggctggatgtcctgggactcactttgtagaccaggcctcgaactcagaaatccacctgcctctgcctcccaagggctgggattaaaggcatgcaccaccaccgcccagctagttttgtttcttcatcagggaaaacttttgcagtatatacaagtcgtggacttgtggtccatggaagggttactagtgctagatctttggataacagtcctcaggagtagagtgccttaaaagtcatcttgtagatttagaagacagacgctacatggaccctgccaagcatcacattggacaggactcaagtagggtagctcttgatttgccctttctatctgatgctcttccttacagactctagtcaaagtgcaggctgggaaatagtgcagtcaaagtgcagtcagtgcagtagatgatatgcagctccatctctttaggaatcaacttgtataatagatgttttctctcgttgcttttagagcgtccaccaggctttgaccgtgttcgaaatgctgagattggtaataaagactttgagcttgatgtcctggaggaagcgtataccacagaacactggctagtcaggatatacaaggtgaggagatgctgcaggtctcagaagttgctcttgtacttatagatttgtttgttctagtaatcagtttcccaaatagggacatttttaataaatggcacctggtttcaaagtagcttgtaagtcacttgaagtgttagttatttatttgagtgtgtgtgtgttttcaactttgtggagttgattctctttagttttgtatcggttcatcagacctgtatggcactttatctgctaaaccatctgaccagaccaaaatactactaattatattttttgattattcttagagaggagacatcccagttggtgattgttatggcaacatttctttttctttaaaaaaacattttttactacatttttatatgggtgggggagaggcatctttatatggggaggtgggtacgccatgtattgaggtcagagtacagcttgtaccgatcaattctttcattgtgatggatcctggagatcaaa

SEQ ID NO: 34717 - DNA, 1190 bp, Mus musculus
attctttctggcattggtgtttcccaggtgctgtccacatatatgaaaaatctggacataagtcgcccagacaagaagagcaagaagcaacaggattctacttaccctattaagaatgaggtgaggggctggagtgattgctcagtgcttaaaggcactgactgctcttctagaggtcctgagttcgattcctggcaaccacctgtggctcacaaccatctataatgggatctgatgccttcttctggtgtgtctgaggacagctacagtgtactcatataaaaaaaaatcttataaaacaaaagaatgaagtgaggtttaagtaacatgttgccttggaaaaaatgtgtgtgcatgcatgcatgtgtgcgtgtgtgtgaatgtgtgttatttgcttatgttcaagatcaatgtcttgagtggttagaattaatttatgcagcctaacatattttgttctcacataagaagccgtgtgtgttggcttactgtacagttcttctttctataggtggcgagtgggatgatactggtcatggctttctttctcatcacctacacgtttcattcgacttgggtgaccagtgaagcctattcttctccctccattgttctgtctgctcgtggtggggatggcagtaggatcatttttgatgacttccgagaagcgtattattggctccgtcacaatactccagaggtaaaaatttgggaggagttgggtacttggatagtggtgaagacacttgaaattgtagtaaatctcacaacttttacatggatgggaagcttagaaaaactaaatattcagaaacttcggtttttttttttttttgagacagggtttctctgcatagccctggctgtcctggaactcactctgtagaccaggctggcctctaactcagaaatcctcctgcctctgcctcccgagtgctgggattaaaggcatgtaccaccactgcctggctagaaacttagtttttaatacgttttaaagaccaagtgtcttctagagtagtggttcatgggtcatagcctctttggtaaacctgcgtttctgaaaatatttacattacgtttcataacagcaaagttacagctatgaagtagccatgaaaataattttatggttgggggtcacaacaacataaggagctgtattaaacggttatagcattaggaaggtt

SEQ ID NO: 34718 - DNA, 1167 bp, Mus musculus
gctgggattaaaggctttggatcagatttttttcatgtattcacatgtgtaaagatgtggaaaaggacaaaggtcttataacttcttgtagcagcatttttttaaaagatttatttattatttatttttatatgtaagtacactgtaactatcttcagacacaccaggagagggcgtcagatgtcattaagccaccatgtggttgctgggatttgaactcaggacatttaggacagctgtcagtgctcttaaccctgagccatctctccagcccgtagcagcatcataatatatttcatacttaatatatggtataattaaccatctcttctgctaggcataagattatttgtgttcatttggtttgtaaaaatattatagtaaacatctttgcatattttttctgacagattcctagaattacttactgaggtaaatgtgtgaagtcatcctgccataatgaagatattttcccttgtagatgtctgtttacagggctcagctacttacttttctttccctcttttgtagttggcctctattactgctttagcaacctgtctgatgctcggatttttatcatcatgtatggtgtgaccagcatgtacttttcagctgtaatggtgaggaattcactcagttttagcaaaactttatccctgacttgggggtcttttcttttccttttgtctggctgaactagaaaaaaaaatattgaagattatgcaaagctccttacagttgttaacccttttttggaatgcaaagagactcatattctgtttgtggcgactaattttcttgggctcataatcttgtgttaggtacttcattgaatttggagcagattaaagaaagacatttgcatggaactgctgttacaggcagtagtgagccacctgatgtggatgctgcacaccagactcaggctgttccccagaagagtgggaagagtaagcactaagcctctggggtggactttagtatcttaaagccttgagtatattttctcctgctttgttgttaaggcagagaagattttatgtaacgttatgatatatcttatctacttcagaatagttttttatttttatgtgtattaattagtgttttgtcttagtgtgtgtctgtgtactgtgtgcatatttggcaccttttgaggtcaga

SEQ ID NO: 34719 - DNA, 1068 bp, Mus musculus
tagcctaattattgcactgacaaaaatactccgaatttaaaaagaaaaggagtgaaattctgtaagtataatttactgtagtaaagcagaacagccctttcccgcctcagaattttactgaaatgtaatgctgtgggctggtgacatggctcagtggatagaagtgctttttgtacaatcctgcactcctgggatgaaatgagtagctaaaatagttcagccacccagaagcttggaggtaaactagtctggaatataaagcgtggcagaaacaatcagggaactcctgcttcagacatggcggatggcgagaactggttcccacaagtgtcttcttacttcaacacttctgcacacactcagacacattacacaggcacactaataataaacatgagatggaatgttagtaattagcattttagcttagtgttttagggatatatgttaaatattgtctttttttttctttcaggaaaaatttctccctggacagggcgtttctactctctgctggatccctcttatgctaagaataacattcccattattgcatctgtttctgagcaccagcccacaacctggtcttcctactattttgatctacagctccttgtcttcatgtttccaggtctgtcttgcattttgaagtgaccataagaattagtctttgaatccaaatatattaactattctcttcattttttatatatttttacataattttattacaatactacaatatattttgtatttgtattataaaaatattacaatattataaaatactacaataattttattatatatttacaaatgtttttatttacatgtatggatatgtgcacatgtgtacagttctctgcagaaatcagaagagggtattggatgccctgcaggttaggggcagctgtgagccatcccatgtgggtacttattatacctaatactcagtaacatatttttcacccaactcagttttcttcttggcttgttgaagttctatgttgagtttttgtagttaaagcaatttgttattataaaaacagtgagataagttaaaaaaca

SEQ ID NO: 34720 - DNA, 1236 bp, Mus musculus
gagccatctctccagccccatattttcaattttaaaattttcttttttcacctagttctctttgatatggggtcttatgtatccttggttgttctctcctctgctgaggatgacctgatcctcctgcctctacttcttgagagctgggattgcagatgtgtaccataatctatgcttggcaagctctctactaacctagctacatcttagccctctgttttttttttttttagtctgctaataaaaattttcaaattctgtattactgtacttcctatgggtatatgttggttttctcatatttttgttatattttccttaaaatttctctttcctaatacatattttgtataattttacatctgtctcttgactttctttatatctctgcttctccttagattttgtgtgtgacataattagtttcgcctatatttacactgtagcttggtatatacagttgaacatgttgtgagtggtgctcaaagggactgttctatcctcacaggtctcttcatggggaggctatgtgttcctgatcaacttgattcctctacatgtcctggtgctaatgctgacaggccgtttttctcaccggatctacgtagcctactgtactgtttactgcctgggcaccattctttctatgcagatttcctttgttggtttccaggtaaacctgagactttgtagaattttctgcagccaaatgtttctgagtagcttcttagaatggcttctcttaaaaacatgaattacagtttgtatttgaggctgtttttaactgaaacagcagaatcattggttattagaatctgcttctaatagcatgtcagtatttgctgtatgctctttgaatttagtggctctttggcttgagattgtgtgaggaggaggaggaggaggaggaggaggaggagagcctgtttagttaaacaaggttgactttaataatcaaagtttaaatttcaaaaaaaggttaaaattccagcccttttagtggaaaagatcccatttagtagcagtgagctctgatcatcttaatggggccagtgtgagctcttgaaacagtaaagcttcgaggctagcctgatctacagactgagttccaggacagccagggctatgcagagaaaccctgtctcggataaaagaaaaagaagaagtaaagcacaaaccttttacccaagttccaacatacagttaacaggacactgtgtgtgtttggtttcttgt

SEQ ID NO: 34721 - DNA, 1235 bp, Mus musculus
ggttttgacagcttatgtaattgttggtattattttgaggcagggatgtagtccaagctaatcttttgtagccaaggatgactttgaatgtctagtctttacataatcttaccaactctcaaattctgggattataggcatatgccactttgcttggtttatgtggttccagggatcaaagcagggcttcatatatgctaggcacatagacacactactagctgagctacatccctaattaccttccttttgtattttctgttttttgttagttttagaaagaatcatgctcttacttaggtttatcttttctttgcctatttctgctgagattacaggcctgttcgactataacagcagctcatatgatgtattagtctcagtgtgtttgtactcagtgttaggtttgatgtttttattcagaattgactttgaaggttttggctttgttgtgtgtgtgcatttctagcatctcttaacaaccttgggaataattgaatgctctcaatgtgctcctgattagacagagtagacttgtaggtcctcagttatcttagaggcatgtcagtgttgacttctactcttccaggatgcaggagctgggcttcttgctgctgccatgattgctgtagttcctgggtatatttctcgatctgtagctggctcctatgataatgaaggtaagatttagaatgctgaaggagatgtgtttactttattatctactgaagttttacaaggtgctgaatttaggtacatttctattgcttagcaataataaaactggaattggcgagcagattagaattgggcgggaagggatcttaggtaggtactctcctatcatctggtctagagaggtagctgggaactttaaaaacttaatatttattgcttatgtacctgcatgcaagtatatccatgcttttatgtacaggtcagaggatatttcgcagctttcagttcttttctatcatgcagttttcaaggattgactttaagtcattagatttggtatcaagtgcctttacagactgagcaatcctgtcagctctagctgggaacctcttttatttatttatttatttatttatttatttatttatttttaaagattttaaaattttatttatatgagtacactatagcagtccttagacacaccagaagagggcatcagatcgtgttacagatggttgtgagccaccatgtggttgctgggaattgaacttatg

SEQ ID NO: 34722 - DNA, 1161 bp, Mus musculus
atatttgaaataacatgaatggactttgttagaagtttaaacactcattaggaagttcttgttattatgtggttaactttttcttcgttgttcatttggtgttataccaatatctttataggtatttattacttagaggtttctatgtgtccttgtgtgctagaggaagaaaacgtatgctagtcagatctactagttcatgcctcagaagtcttgtgttttgggtgattgaattcttttgctggctttgttatctaccacaggctagcctcttgaagtgtcctgtctgagtgctttgttatggacattagatttccagttcatttccttcagagaaaagcagtgctgtaattgatacaagtgtgagatagaagtagagacttaagttaatataaatgattttgatggcttaatttttggtagtaaacttttttcaagtaatgcagtatccctcagtgtcataatctgaaaaacaaactcattgcaaagtaagacatttgagagcagagatcccggggacatggttcttttctttcttgctctaggtactttaattatcggactacccggtttctggctgaggaggggttttataaattccataactggtttgatgaccgggcttggtaccctttgggccgaatcattggaggaacaatttacccaggtgagggggacaggatttgttgtgtttgtaaggatggtgtggtgtttgtatgctgtgaaacagctctttctgtttgcttcaggaaacttgtaatttcattctgattatagatttccaaaagttgatcttatgaaggaaatgtgtgagatagtagagatggggggaggggaggatttcttacgcattctggatctctgaatccttaatagagaagtgtagacacttagtaaagttgctatgatagtatttctaatggttggtcaagacttggattgatgctttcttgttattttcttaccaggacaacctaatgggattactttttcctgtttcaggtttaatgatcacttctgctgcaatctaccatgtactccatttcttccatatcaccattgacattcggaatgtctgtgttttcctggccccgcttttctcctctttcaccaccatcgttacgtaccaccttaccaaagagctcaaggtaaaggatatga

SEQ ID NO: 34723 - DNA, 1145 bp, Mus musculus
taaaaatgggcaaaatcacatgaaagatggccaaattcagtattaggtaaatatgatctgataggctttgtgtaatacaacagttaaaagtatcccatttaagtgaaaacatgtagacacttttgtcagacttgtagtgtctcttctaggtggtgagaagtggatgaagatttcattcaagaactattttgcgtcttctgactccagtgctaaagaattgtagcttccccataatgctgctgtttaccttctcttgttctgtaatagcatgccactaattacaatattcattctctggattttgtagctttttctactcgtctttttgctgtgctgagatttgaaagtgtcatccatgagtttgatccgtgagtacctttgctctgacattatttccttctagagatgttgaagtttgtgcgttttttatgtgtttatgttccaaatagttcttcagtggtggagatttttttcagcacatttaaaggaagactttgtcaaggtttccaagtgagtcttaagatctcaaaaatgtaatagactttgttgttaagccttgaggtctggctaggctaagagaaatctggctttttattttgaccaagtgcagtagtgcaccttaagggaaagagtcctggagtacatttaaatctagaaaggatattacaagtcatgaacttgagatcataacttcttttccatttatttatatagtagaaattgggcttattattaaattctatggcattaaaaatattaaagctatgagagcatggtattgtgacaaatgcctatcatcctggactgtatagtgagagtctctctcaaaaaattaaaaaaaagccaatacaaattaaaatttaaaaaatttgggcttagtggcacatgtttttaatcctagcacttgggaggagaggcaggcagatctctgagatcaagaccaggttggtttacatagtgagttccaggccagctaagccttcaaggcagtaccgtgaaatcctgtctcaaaagaatgaaatgaaacaaaaaccagtgtgggctggagatggttaagagtacacactgcttttgcagagggtccacatttagtttccagcacccgggtaagatggctcactaccacgaggcctctgacatcttga

SEQ ID NO: 34724 - DNA, 1682 bp, Mus musculus
tcttttgaattctgctgcctatgtagttttaaatttcaaacagtcagataagctgtaataggcttaaagcggttattttgatcaactggaagctaacgagtgatttctttcagtcttttccagttgcgcctattctccttggtggtctttttaagcaacagacttttccacaagaccgtctacctgcagtcagccctgagcagctcgtcctctgcagagaaattcccttcgccacatccttctcctgccaaactgaaagctgctgcaggccactgagccctgctgtcaaaggggtgggtgggactgggtggaggatgtggcagctcttttctctgttttcctccccctgccgtggaaggcagaacccactgccaagggccctctgcatagtcccttgtctttgaattggaatcttcctgactccagtatatggatttttaccaccaccctaggtctgtaaggaccagagttttccagctgtttttttagcacttgccagctcctgtgcctggactgattgatttgagtacttttttccccctttccttgtgtcatttaccctcccacttcctcctgccttccagcacccctggatgaatgggctttgtaattttaactgttgtattttgtgaatttgttgttactgtttttctgtgaagcacatacattgtatgtgggaggtaaaggggcattccagttgctccagtcactccctctatagccatcactgtcttgttttctgtaactcaggttaggttttggtctctattgctctgctgcagaaaaggaaagaaaggagtgggggaaatggagcctgaagagttggggcagatagacctcagccaaactggctgggttttgaggagtcatgttctttcttccccttgaaggggaaagagttttttccactggtccatttaaagtttcccagctatggggtggtaccagttctggacaagtgccactgcatcatagtatgctcggagaatctgaaccttactctgaagatgaaatttactgttggccactgccaggtcagactggtgttttaaggaatactgggtgcttcatataggaactgaaggggtaaacttactaaaccattcaacctgtgattggtgatgttttcctgtcattttaagagtcgacacatgggtgggggggcagatgtaaaaaaacttgtacaattttaaaatatcacaattaaacgtgagctggtttcccaaaatatgtataatgtttgatttctaaatcacatccttgagatatatatatatatatatatatatatattttttttttttttcatagattgaatgactttgtcttgaataatctgcttataggtttcagaaattagggttgaaagatgttctcaggctgagcttgggtcatagtgttataactgtatttacctttttttttgtggttttgttcattgttcaagtgtgttcatttctactgacatatattaggaagaaaatcctagatttcaatgtattaaagccactctgtagttaaggaagaagttaaatatttgattattatatagaaacctgtaataacaatagctaagccaggcagtggtgatgcacacctttaattccagcacttgggaggcagaggcaggcagatttctgagtttgaggccagcctggtctacaatgtgagttccaggacag

SEQ ID NO: 34725 - DNA, 1214 bp, Mus musculus
ctaggcactctacacatgtgacacacacacatatacccacacatatgcatgggccacacatatgcatgtgctcgaacacacacacacacacacacacccctcagaaaaataattaaaatctaaaattaaccttatcacaggattttttttaaagtacaaaagctaggaatggcggtgcacacctttaatcccatcacttgtgaggtaaagacaagtagatctctgagtttgagggtggtctgatctacataacaagttctaggacaaccagggctatatagtgaggctttatctaaaaaaccagggaccgagtgattcccagggcccagcaaaaggggaccgagtttccagagccctgaagacaaggggtaacacaccaaaatatagactcatttttcattccaccttcattggccgagcagctgcaaagaacaaaggccgtatctcccgatacctagcaaacaaatgcagtattgcctcgagaattgattgcttctctgaggtccccacaagtgtatttggggaaaaactccgagaacaagttgaggaacggctgtctttctatgagactggagagatcccacggaagaacctggatgtcatgaaggaagctgtggttcaggcagaggaagcggctgctgaaatcaccagaaagctggaaaaacaggagaagaagcacttgaagaaggaaaagaagcgactggctgcactggccctggcctcgtcagaaaacagcagtaccccagaggagtgtgaggaggtacatgaaaaatctaagaagaagaagttaaaaccccaggagaccctacaggaaaatggaatggaagacccacctgtctctctacctaaaaccaagaaaaagaaagctcccaaggaggagttggccagtgaccttgaagagatggccactagcagtgcaaagagaaagaagtcctcacctaaggaggaagtggccagtgaaccagaagaggcagcaagcccaccacccctaaaaagaaaaggaaattttctgaggagcctgaagttgctgctaacttcacaaagagcagcacaaagaaaaagaaaaagtcccagaaaacacaggaggattagaacggacctgcttggtggaaggacataccttgtggtggcagctcctgcccatgataaaaccccaataaaaaaacacaaaaccggggctggtgagatggctcggtgggtaagagcacccgact

SEQ ID NO: 34726 - DNA, 1530 bp, Mus musculus
caaatttgaggcctcaattggaagagcaacatgggccacccctgctgggtacccaacttatgagcaagagaatggaagcttccatcacagggagaggcaaagcctcctgatctaactggtctagccccaagctacattgccactaaggaagggtacagaaaactctatgggaaggggctgctgagcaccaagcatgggaacatggcagacttcaaggcctgagctctgggaactgcaatcagaaggaatgggctgaaagcagaaaggaaggacaggttcagactcttgcttgtttggattccaaggcctggaaaaggtgcatctctccttcccatgttaaattataaacctctgtaattatcctgtacctatgagggatttcaccttgtttcaaaggtgctgggcctctctctctctctgtttctgtctctgtgtctgtctctgtctatgaactattctttctgtatttctccaagtaggaccctgttgatctatcctccactcgatcctgttgataactcagccactttgaagcattagtgctgcctttgcagagtcaaggcttggatggggtacgggagctgtcataagtactaaatgtaggggaacttgctctcgggctcttgaccgtgtccaccctcagagcccagtaccttccttgcctcactcttaagatgcctcagtggatgaagacatcagggtcagtttggtgaagactaaggtgttgtatacaactgcaaatgccagtgtgaattaagcactgggtgctcaagtcatgacagctgtcctttaagaacaaacaggaagtggctatgggaagaacttaaccctgaacataggtgccaagtttagcaagaaatgaagataccactggaaacatctgcgtaactgctactgagcagttgctaggagacaccttgcagccaccctctgcctggtgttctgatgccccttccttccgctcttgagtcctggttcacgacatgccaggctgactcctggcatttccgcctgacctctaagctgcccatcagcaccaatacagatttcctttgccaactgtgccactgcttatccttggtagggcctggcatagcagcagccatggggctcgtgaggggcagtaaagcattgtcacatgaacaacaaagattggtgttctggggctgcgacagctgtctttcccagagggcattgctcatgacattgataacactgtgcaatccagcaggagcctagacccccatacaagatacatccattgcatttactaggatgttgtgtcagtcagtgtgttagctagatacactggcctcagcaataaaatataaagctcacttgcctggttctcactttagtcctgcaggaagcagtcagtcaggcacatcttatcctcaggacctggtacagggcaggggctggcacatggtagtctgctcagtgttcacaaatccctcaagaccagaaagactgaccttatgtggaaaggacagactttaaggcaaagctgtgttacttctgtaggccact

SEQ ID NO: 34727 - DNA, 1208 bp, Mus musculus
gagctacagctcagttctgcttgcacacttaagtgagactaacggctatactctgcaaagttcaagacatacagggataggaatctttttaccacactgcactctagggttatttacgttttagatcctcatcagtggaggcgaggtggttctagagggtgtgtctggtagcacacggaaagacacctgacttctgtggctgatggaggaccctcaatagatgttctcttctattttcctagagtgtggtgactttagatgctcccccacccccaagaaccaaagtatagttctgctgaaaaaatgttatactgaactctggggctcacagagaaaatgaaagcatcatctcacctcagaattaatggtagagctgaagagttgcggtgcccacagcagtcattgatcgtatttttactttgttttatttgtttatttggttttgttgccctaggtgtggaagccaagatcctgggtaaaccaagcaagtgctctgctgctgagcactgttggcagttttagaggtagcactgagcgccaaagggcaatggttcacacacacacacacacacacacacactgggcctctcagtggccagatgaactgactgtgaagagagctgcctcctgtgaggacatctggatagagggagagctagaaactgcttggcatgtaagaagcatgcagtaactaaaggtgactctctgtaggtaccaaagatcattatagacagattttaaaccagtgcacattttctgagctaaacaaaacataagctgaggtggggacaacagggtaaggacttacagtgtgaaagaaagttagaaatgaactctgtcacacattactttcacacggccctaaggagagcatcgaaatagatgtgaagatagcagacagtcttggactcttcacctgtgaagtacggataacaggatacctactcctctgattgctgaggtttaaacgggaaagtgtctggatgggtgccaggcctgcgttaagtcccgaagacttaacaagaagcagctttactgctaaatgccattctataaacttttcatactaatatataccatggattactaatctgtctttttttaaaagacaaatgaaccgttagttcccccatgagacgcactgataaaatgagagacagaaaagcatgtagcttgtacagcatcgtgttgctgacaaatgactgagc

SEQ ID NO: 34728 - DNA, 1151 bp, Mus musculus
cctaagatactttgtattgacttttatttctataggcctcacacagttttttgtttgtttgtttgtttgtttgttctaagtctggttttctgaaacaggtgatttgacttttgtgagctcaagttagtaaaatgatgataaaatgaccattgaatatcattacaaaactttaagtcgtttagtttcagtctatatatagaagtttcaagattgatgtcttagggttgtattgctgtgaagagacaccatgagtacagcaactcttatacaggaaaacatttaattgaggctagcattcagttttagaagtttagtccattatcatcttggtgggaggcatggcaacaggcaaacatgatattgagaaggagttgagagttctacatctcgatcaacaggcagcagcaggaagagtgacactggacctgacttaagcatttgaaacctcaaaccccaccccactgacatttactccaacaagaacacaccttctggtagtgccactccctggtaaccagcattcaaatctatgagcctatggagaccattcttccacaaacccccatagaggtgaatgttcttgaactgcagtctggtcatatgttaacagtggcctgtggtgccatctgtgacttatagaagtctcagagtaatagcattgatcaagaagaagcaagccacctgtcacacatgatggtagtgtggtgaattctgtttgaagtgataaatgtgctttggaaggaaatctggaatccaagtttcttgttttgttcctaaatttgcaagactgttgtcctggctagttttatgtcaacttgacacaagttagactcaccagagaggagggagcctcaatcgacaaaatgtctccataagatctggctataggaaaacctggagggcattttattcactggtgattgatgtgggagggctcagcccattgtggatggtgccactcctgagctggtggtcctgggttctataaaagagcaagctgagcaagccagggggagcaagccagtaagcagcaccctccatgacctctgcatcagctccccctccaggttcttcccctgcttgagttcctgccctgacttcctttgatgataaactgtggtgtggaactgtaagcagaataaaccctttcc

SEQ ID NO: 34729 - DNA, 1165 bp, Mus musculus
atttttgtagtgagtgtgttagaagtattcctagccttgctatatataattcctctaactagtgtggaaatgtttgccctttacccaatgccttacttatcctaaaataaaaagatacataggtttctttttttttcctaagtgaacattctttgaagatttgagagagatcactagaataaggagtaaatataaaactatttgatggccacatatcagttatttcttagaataattgaaacaaactggttctttaatacacatgtgcattctacattaacttaatgtgacagttagctttcattgtcaacttgacacaatctagaatcacccagggagagagtttcagtgagagaatatctgtattgggttggcctgtgcacatgtctgtggaggatgtttcaattaagttcattgatgtggaaaggcacagcccactgagggtagcaccattccctaggcaaggggttctgaactgtaacaagaaaggagaagtcagattgattacaagcaaggaatcacgtgagcatgtatgcatttatttctttctgttcctggctataatgtgagtagctctttgaatttcctgccttggttttcctacaatgatggactatagcctggagttgtaagatgaaataaaccactattcccacctctacctcaatccctgagttgcctttgtcagggtatttttatcacagcaacaaaagaaatgatatttaggatattttagaaggctttttggatgaaaaggaaatctgagaaaaggctagtgttagtttaaagtgaggtaggaatagaaaagattcatgtaaataaggaaataagagttttagggaaactaggtatggagtcttataggaaggagtaataaaaacattaatgcaagatgaataaaggtaaggaatgtacttgctcaataatttctaagtatatttagatatttggcattttatgtataaaagatatatataatttaaaatagatttgattaataaaccttaaatcaagtcacaaagttaccaagttttaccttagaatattggcagcaatattgtaaagcactgtcagtagattaaagtctccttcgcaagtaatcctcttgtccgaagtctggcatcttttaataatagagacctgatttcctgttggaacagcagtg

SEQ ID NO: 34730 - DNA, 1166 bp, Mus musculus
tgtttctcattgaagattttgctatcttggtttttaaaaataactttttaggtagtatataattaatatactacattaatttcattatgagatttttatgtatattgttatgttttgctctttattgctctcttctactgtatccttcttccttttgctagcctgcctctctttttctctctccctacttttgctctctctaaaacctagattctttagaagtgaaaatgtggtattttgtttcttttcttattatccccttgttcttctctccttcttagacctcctcttctttcttaatcccctttcctttcatattgtgtgtatgtatgtggtgctcacatgcacatgtgtgtgcacagattttgtgtgtaaatagattttgtatataagagaaaatgtgataatgcatttgtttgagtcttgtttcatttggcatggtgatctctagttccacccatgtgcaaatggcatttcattcctttttatggattcctttttatacaattccaatgtgtatatctatcatgtattttcttcattcattgataaatcttaggcaggcctgctatcctggctactgtaaatagtgagtagtaataaaacggctgtgtcactctctgtgacatactgacttggtttcctttgggtgtattcatggaaatgctatcgctagatcactgttagttctatttttagtttttgagatacttccagctgatatttccatagtggctgcagtttatgttctaccaaaaatataatggcccttccctcttacatctttgccagcattctgagtgggtttagatggaatctcagagcagtttttctttttttaatgtgcattttcatgatacctaagacttttgagcatttgaaaagatacttcctgccatttgtattttttgttttgagaactgtctgaagttcatttgtccttttatttatttacacaagatcccctcttgtagggtgtaactttttcagttctttatagattccaggtaacaatcctctgccaggtgagtagccagctgatggcttcttgtgctatatagaaggttttttagtatcatgcagtcccatttgtcaattaagtcttagaagtatcttctgtgctattggactgcttttaaaaggttctttaaaaccttgaagtgttt

SEQ ID NO: 34731 - DNA, 1206 bp, Mus musculus
gcctcatcacctccctcccctcggggtgatctctccctgacccgaagcttctctctgcctttgtgggagtggaggccagactggttggaagatgctgagatcagccacacccagaggctggggagggggctgcctccctggcctcctgattctagggcctcttcccagcgaagttggctaactggtgctgtgcccaaggctggtggtaagtatctggctgactggctaacattaattaacaattaactaactaactaattaacaattaaccttaattgagaagtcctggagaagaaccaaaagggagcttggggttttagtaactctattctccttcaaattccagattcctcctgaattgtccctgagaaggccagaagagcacccagaccactctcctgtctgtcccctggctttctcacatgtggaggtcttggcctatgcttctctgtaatagaagtccaccgtcactaggcttctggagagctctgtcattgggattgttaaaataaatgaaagcaaaccaaaatatgatcacgggagtcttggattcccactgagaacaagacagcatcttcaggacagcagactctccacaaccagaacctttggcctaagtaagcctggctccggagctcccacctaagtggatcatggaaagaagggaagccaaccaggtcttcaggaaggacagaaatgttttttggtgagggctatggtggaggacctgtggaagagccctctcatatctacttggactcctcccttagaggccagctcaaccctttccccagtcacaccatgcaaggaaactaaaggagaaaggtcgtggatgcagtgggccctatacagcgtcacagtcaatgcttcaaagtgagatcaatggaggagactgaaggaaaggacgcagggaaacagggaaccaatgcgctattctcattctaccgccactctgagcttaaggaacttaattctataaaactgtaaagacgagttctgtgacatcattccttgggctctattttgggaagggtacctgcagaggtctaagagttacctggctagagacagaatcaggccttcattgttactcagagaatggcctcatttctttctggcatgcaattgaagggaatgagatatacccagcaagtttaaatgaaatgtaaagaagaggagtaggtgggtctaagggtctgtagatct

SEQ ID NO: 34732 - DNA, 1200 bp, Mus musculus
accaactaaagccaagcgtttaaatatgtgagtctgtggaggccatgctaattcaaacagcctcaccagggccggagctcaaggaaggagtctgtaggacctgaagcagagaccacacaggagcaccacatactggctggcttccttggcttgctcttctacctttctttctttctttctttttttttttttttttttggtttttcgagacaaggtttcactgtatagccctggctgtcctggaattcactctgtagaccaggctggcctcgaactcagaaatccgcctatctctgcctcccaagtgctgggattaaaggcgtgagccaccacgcccggctctctacctttctttcatagttcaggtgtaccttcccagggatagcaccacctacagtaggctgggcccgcctatatcaattagcaattaagagaccgccttacagacatggttacaactagaggcatttcctcaactgagtttccctcttctcaggtgtatctaggtttgtgtcaagttgatacaaactgtgactgaatgtataaaaatttatataaataaattatagtagtgttattgaaaattaaaaatgtggactttggaacccaatttaaaaaatattgcattaaagctaagctttagaaggctgaggagttagctctgtggtagagtgcttgcctattttctgtaaggccatggagtcaaatacaaaaaaacctggtaatgaaatgtcccctagctctatccttttagaaaactgtgtgaatgtgatctttagcacagaagcaaagagtcactgagagcagtcatgagctagctagctgcccagggagtaaagattgtaattaggagaagtacaacgctaagtgtttagaacctttgacccaaaaacaaatctctaggccccagtttttagaagtggaagttagaacagtaatgtggaattgccatcgtgtccctattgatagaaatgcaaaaaggaaatgtgcaggggctggagagccagcccagagagaagtttacagccacctgtaactccacctccagggaatctaatgccttttctgatctctaggtacccatagagacacagaaggctgacatacacaagtacaccgtaggcatgcactcatgcacgcaaatgaagcaaatctgaaaaaaatccagtaatgcctttgtctttagttgtgcaaaataaa

SEQ ID NO: 34733 - DNA, 1138 bp, Mus musculus
gacacctgcttacaaaacaaaacaaaactgtagatcccacattctaatagaaaatgataattatgttcttacaatgctggggattgagcctagaggcttgcatatgctaggtaggcacccaccctgtcatgttcccacatatcctagtcctgagaaaataggtatattaaatagctaattcaaaccaagtgttttactcttgtaattccagcatctgacagtaggaggcagaagagtttgagcccagcttggtttcatagtgggatcttgcttcaaaataagtaagaacacttagctcaggacaaaagcacctcagatggatatctctgatagagccttattggcctcagtttgaaaaccatactctgcacttttgcataaggagtggggtgcttggcttttggttttgttgagaaggtttttcatgctttctaaaacttcttttgcacatcgtgcacatccaggtgatgctgcgatttccctgcctgagcagcagagtgctattgtcctgtcagtgcttagctcagagaacccctcctcttaatgcagggtgtgcagtgtccagtcgtgagccaaaacccttcatttcttctcttgctgaaattaggaaacagcacttgggctcactgaggtcagtagtgttgtgcccgtctcattttcccttcatttaagtaatgcatccgtaccactacactcagaaaatagagagcgttttacgttctttactctagcatgaccacacatccccaaaacgtttatatttcaacaagacaagtaaacctgctggtaatttcagtatatttccatgtggcaaaaccaggaaagagatgattttattttatcaaactccaagaaaatatatgggtcattcatgcaccttatttcactattcatgttgagttcccttgcgcttgcttcttgggaatatgttgccagtgagcaaggcttaattctctgggtaggaagtgaggtggcttttcctcctttgtttatatgtcagtatgttaattacatgttacagtcatgctaagcctacaaacagttggaatggattggttggcagagctggatgtttctgaaacttgattctgggtaaaagataataacaacatcacacgccttcatctaggtatgaagt

SEQ ID NO: 34734 - DNA, 1303 bp, Mus musculus
tacttgaagaatttgaccgttaacttctctttctaggaagcgagataccatgcagaatattgtacagattttggagtcggtgcagttgaaatgggaactgtttcagagttggacagacttctcaaggctccatctttccaataaattggccatttttggaattggctataacacccgctggaaagaggatattcgttaccattatgctgagatcagctcacaggtgccccttggcaagcgtcttcgcgagtatttcaactctgagaagcctgagggacggatcattatgacccgggtgcaaaaaatgaactggaaaaatgtttactacaagtttttagagatcaccatcagtgaagcgaggtgcctagagctgcacatggagattgactggatacccattgcccactcgaagccaaccgggggcaatgttgttcagtatttattgccaggaggcattcctaaaagcccaggcctttatgccattggctatgaagaatgtatcgagaggcctctctcaccagatgtggagcgccatgctctggacccagggaaagagggccgagtcgacctggagaccctctcagcacaagcctcattacaggtggaagtggaacccacccggatcatctactgctacctcggtattgctgaggtcaggactctgcagcagtgcttgtttttacatttccaagcaaatgccaaaaccttcagtaaagagtgggttggtattaatgggtttttgtctcagaactgtattgtggatcctggagtttcccccaagtccatctacatcaaatttgtagaagtagagagggattttctttctgccggctcattagttgagtgtctggaaaaagccattggataccccttaaaatttaacaactgagtgtcatccttcataaggatttgggcttgtgcagtcttgtcccttcttcccattacccagactaccccacgtccagatgctgccgtcggactcttcatgggagctttttccacgatgagaccaatacaacctctaagaaatcatagactctgggcaggaaaagcagacctcacctgaaatgctcattttgagcaagcaggtcttgcatggtgggtcagttcttttttacaaaaagaaaacatcgattttaaaactggttttagagccttgatataagcaaatgtaggtacattccatattggacaaaacttatactttgagtttcatatgaaattgaaaattgtatttttttcactgtttcatttttacacatctctataagtattatttacaaccttgaataaataagcaata

SEQ ID NO: 34735 - DNA, 1168 bp, Mus musculus
ttgcagatcattgtccatcattggaggaagtcaggacaggcactgatatggagtccatggagggatgctgcttactgacttcctcagcttttcttatagaagccaggagcaccagcaaaggaaaggcatcagtgactctgaggtgggccctccattggtcactagttgagaaaatgccttacagctggatctcatggaggcatttcttcaactgatgctccttcctctctgatgatgatagcttgtctcaagttgacactcaaaaccagctggtataacagttctcatccttgtctagagagcagtaggctagcccagtcaccttcctctgttgatgctgacagaaatataagacacaagtagaaccagcacaggctaggcacagacatattaagctcagcttccaaaaaggccaaagcaagccccatggttgaacttggaatcagtgggtcgataatagcaaagaactgcagtcacattcgacaggtgtggctataaggagggaagaaatgagtctttttgcgacttgccacatacaaagtggacttttttgcttccctgtagtgcctagccccctgatgcacacccatctatcagttccttattgctttgtaacaaattaccctggatcagtagtttaaaatattatctatttatagtccacggactagctcatctgtgtcctgtgtgttgtaagacttgcttgtgtgaccatagtttttgttttgttctttttgagactgggtttctgtgtatagccttggccatcttagaactcactctgtagaccaagctggcctcattctcagaggtctgactgcctctgcctcctaagacctatgattaaaggcgtgtgccaccattgcctggctgtgtggccataatttaattataggatccagaattaacatgactggccccttagctggtatttctagctgtctccataagctatccaaggtttcctctctttacaatttctccaacagagtagctggacatttttgtcctctcatggccaatacatggtttcaagagcatgaagccacaagcagtggtctctgggaaaagacccagaagctgcataaaaatccggccacattcagttgatcagcaaagcacagggccggcctggactgagtacattgtaaaagaccatgtggttgtt

SEQ ID NO: 34736 - DNA, 1278 bp, Mus musculus
tattatctgtagcttacatgaacatctattattaactttttgctctgcaaacagacacagtctggtacaggttcttattactgtaggaaactggtctttggctcagaatggccttattttctccccttgatagtatatctggaagaggagttcccagttttttggtaccatctaacttgcctggcctttctgtttttctcttattagatctcctgttgtagtgaccgtcattgcaaatggcttccagctcctgttaacactttctccacccagactctgattttggatctcaatgcttgtcttggcacagtggttgctgttcgctatgcctggaccacatggccttgtgaatataagcaatgtgctgtttaccacaccagcagtatgttgccagctcctcccttcattgctcaaatttcacacaggggtatctaaggacatttggagtagtgctcgctcttctatacaagggcaaatcctttagtttgggtatgcaggactttaaaagatgactgctgtttttagggcaatgggataaacccctcattgaatagctcccagctagcatatggcccctccagtattctgacataagcacaggctagcagatacttgaaatgctcatctctgtcctctagttaacctaagcctctgtgctggtctaattctcaactatatcactgggccttactagcattcacttccttggtattagtgggagtaatatgccctattcgtgcccttcttcactactctcggactgtggactctcggaccagcaagggactttaaaggctgtggaggctggtgctttgtgtgttctttacaaccccctgaaaacggctatgcaagtttccatgtgtttccttctgtaaaacaatgctcttgtcaaaccttactaccccatgacaggcctttcaggtcgcctctgacagatcatgtgtttttatcactaggctctccaaagctgttgtcagcctaactcatactctaaagggaatctgtgcatattgccatgtgctaaggagtggccttaaggaagaaagagggcccactgcaggttctcaggcagagggtggggaaatcacaggcacagggacacgcggaagtagatgtgcttggggcaaatagctctttaaatgtaagtcttaggtccctgaggtaaaagttcaactaagcctaagcctaattcccacggaaggaagaagttaggctgaaagttacagaacatgcttatagacctacaggtgattttgtagtttaccatttggttaaaga

SEQ ID NO: 34737 - DNA, 1224 bp, Mus musculus
tttaatccaagcactcgggaggcagaggcaggcagatttctgagtttgaggccagcctggtctacaaagtgagttccagaacagccagggctacacagagaaaccctgtcttgaaaaaccaaaaaagaaaaaaagaaaagcagggtgcattcaataaaaatcggacttttggttttgttcttatcttagaacagtgatacgcagtgtaatatcagtaatattagctaatggtgtgaagccatagctcccacacagacccacatttgtagtgatacttgacactccacagtgtactcagttgcctgatgtttgttaagttaggtatatcacacgcattaacatactgtattttcgacttaccttgggcttatggaataaaatcccatcacaaagagcatccatatcaatcaagattggctttctacctttatcattcatgtgtaaatttccctaccccttggcactggaagagacctaagtgggtgaccccagattttcgtttcagttctgaagaaaacatccaagaaaaagaaaatggagggaggtgctcgaaaactggttcgacccattgccctggatccttcaggacagcctgtgttccccatcggactagggggtctgacagtatacagtctgggggaggtgagtgagaccagcatatggccaggctaatgagaaccatgagagtggggttgagcctttccctgttcccactggcagcacccctttgttgatccatactgaccccagaaaatctctagtcccttccaaaccaggtcagttttctcttctcacagccatcaccttctatgtttgttgtatcactctttgtcagccccaaagttcctctaaaggctaccatagtaaactgggctctaaagccttaagttccagattaaggaatcttttatagatcatcaccaaccgacctggcttccatgatgagaatgccatctatcctgtgggctactgcagtacccgagtgtatgctagcatgaagtgcccagaccagaagtgtctgtatacctgtcagatcaaggacggcggtgtacagcctcaggtactcactgcattatgattcttattttcctttcttggttctgttttttcttgctgtttggagaacctccttgacccctggctttttagctatgtggctaattctgacatactttaagatactctgctcaccatttatacaacacagagatgcaggaaaactgg

SEQ ID NO: 34738 - DNA, 1316 bp, Mus musculus
aagaggctcagtcaattggtttgacactactgaaagaaaaaaacgataggaagtatgtgtacttgaaacgctcctggtttcattttaaaaccactgaaagccgaccttgtgctacttaacattttattaaaacagtttgctaactagataccaagctttggggcaatcaaggtcttgttttactatccccgaagttcacagcctaagaaacacttgtgcgatcagcacatatgggaaactgagttccccgcattagtatttaagtctgctaaaaccccaggaaggcctgctgctcagagcaacctgggaaagcagatgtggacgtgcattccctgagggcacctgcctgagcgtctgcatcaggactttaaactcttccctacttcgctggctatcagccgggtaggaccggttctttccagctccagctccttgcaaccctgagccacacccgtcctcccagcccaccgctaggtccgaaccaccgcaacttccaaacccggaagttacacgtggcggtgcttttgcgcaacttccggcgggtcttccttgggaaatcgactgggaagtgccgaggatcgccatctgtttctgcctgcgctccatcccctccgcgccccggagctccagaacccggtctgatcatgagcgtgttgagcggcctggcctccgagccgcgcaccccgctgtccagcaaggccaggatgaaaaggctcccgaggaagagccagaacgagaagtaccggctgaagtacctgcggctgcgcagagcagctaaggccacggtgtttgtgagtctgggtttgggtggggactgtcttccccacctcaactctctcagagaaagaatatccgtccagtgttagttgcctcgcttgggaatattagttccatatccttgcataagttattcctctagtcctgtcaactcctctataaatgaggactgaagagtgctccgccagcaaactttagtcattaccttcttgctacttttcgtttcgagcctaaggagtgtcttttaaggcgagcacactgaaatgaagcccagagggatgacgtgccctaactccaacttggataccctgattccagtttattatttactctacacagcctgtttcctaagtacacccaaccctaacgccatggctgccgctttcgtaaacaggcacctaaatctttcaaaattgtcctggttgtagctccctttgacgaggcttctaggtgtttctgccttccctccatccgaaactgaaagtggaactcaacatcaggaaacaggctacctcctcctgctgaggtgtatagacact

SEQ ID NO: 34739 - DNA, 2069 bp, Mus musculus
gcctggaagccaaaggcggtctacacagctacaaaatgagatcgacatgggattccctttgactcgccccagttggaactgcaacatggctaaaggtagggagagcttgaaaatctattcccaggctccggtctccaaggtgcttcaaaacgggcccactaatttggctaaggtaagaggtaatgcaggggccaattgaacctccctcagtgttccttgaaaggcttataaaagccttcagacggttcactccctttgctcttacctcggaagcccagaaggcctcagtggccatggcctttcataaggcagtcagctcctgatattagaaagaaacttcagagattagaaggtgtattacaagagggagacagttatgtgatctagtgaaagaggcagagaaagtatgtgtgtgtgagagagagagaggcaggaggcaaaagaaagaaaaaacaggagagatcatagacaagaaagaaatttgccacagtggtaggaaaaaaaaaaaaaaaagacaggatctagacaggaaacctgggcaactgaagaccgagcctcagctaaagaggctcagctgtgtcagactgaagtgacttatttgggatacacccttcgaggtgaaaagcagtggctaaaagaagccagaaaaagactgtaactcagatccccaccccgactacaccaaggcaagtaagagaattcttgggtactgctggtttctacagactctaaatacctgggttggcgaccttagctgcccagttgtaccccctaaccaaggaaggggaggtgtttgtgtggaacccagatcaccagaaagcctttaaagagattaaaagggccctactgatggccagcctatgcctgacctaaccaagcccttcactctttatgtgaaagagagagcaggggtcaccagaggagtccttactcagactttgggactttgaaaaaggccagtgacttacctatccaagaagttacagcctgttgccagcgggtggttttcttgcctgaaagctattgctgccataatctgcctgtcaaggatgctgataagctcactctgggacagcaaataactgtagtggcatcccacactcttgaaagcattaccaatgctcctgtgacacatcagagctttttgttgtctaaatgagtgaccttcgcttcattccacctgctgtcccactgcgtgagactgcacctactcatcactgtgctgacattctggcagaagaaatgatctgaaggatcagatcagccttggcctgagggtacgagctggtacactgatgacagtagcctcgaggttaaaggtaagcagaaggcggggacagcagtatggtggtgaacagaaagcaagtgatctaggccagcaggcttcctgagggacgtcggcccagaaagctgaacttgtgactttaagacaagctctataaatggcaaaataaaagtctacactgacaacaggtatgcttttgccactgtacggggcaatatacaaagagggctgttaacatctgcagaaaaagacctaagatgctgtggctaaagaaaatcagatggcagatctaaccgccaaacaggggctcaaggagcaatgatcctggcagtcaaggagcctaaagattattatgacatcagagagaccagctttagatacacccctgagcactgtcaagttatggacagtatttgacttggcctgggggccaagaaattcaaaggtgtggttaggtcctttgactactatgttacaggactctctgacttggcagaaaaaatagtcaaaagctgcaaggcctgtgctatgatgaggtagaatttctaaaagaaatcttcccaaggtaattgggtccaataacggacctgtttttgttgcccaggtaaatcagggactggccaagatattgaaaaatgattagaagttacattgtgtatgcaggccccaaagctcaagacaggtagagagaatgaatagaaccattaagggacccttaccaaattgacagcggagactggcgctatgattggatagctctcctaccctttatgctcttcaggga

SEQ ID NO: 34740 - DNA, 1180 bp, Mus musculus
gtctttgatttgatgagtcagaagatgcagaatgaactctggatgttcactgactgcagagatgttggcagaggcatcagtagaggcagaagttgaagttagctgaagaacagaaaagataacttcctccctttaccattcttatataaagggcagactgttgtcagagcaacaaactactatggaattctctgtctgttggtttgacccttgaccttggtacctagggcattggaaccactaaggttctttgaaagagctacaatgtgatgaggtctgatttcacactcctccacacacactcataccccttcacacccctccatctcccgagagagaaagagagagagaggggagagagagagagagagagagaaagagagagagagagagagagagagagagagagagagagagagagagagagagagagatttcaaagacttaacgggcttaactgaagaggtcctagtcctgtactgcatcggaatacttgtgtagagggttagtgacacacagtggagattgagaaaaggagaatcctaaggtcgtttggatgagtgctcagttagttggaaccataagaggtaatgccttcacaggaccaaggacctttgggttctttaagaggggaattctgtgtaaatctgcaggaagaccgtttactggaaagtactccagggaaccacctatgttggtgtgtaatgataatgggtcagaacagaaattgctggaaatgtaattgcaataggggaaacttaagactccagaactctgtgaacacagtttagttggccattctagtggaagcctagaagatagtacttctgattatggagaccttgtacaagagatttcaaagagaaacaagatcttttagcaactgggatagaggtaatattttgtcttagaacctagaaactttctgcctgtgtcctgagaatttaccttagtctagatcagaaagaaatgtactaatttctttggtggaggacatgttttataattaattaatttaattaacatcccaaacactgctcctcctccttccagtttccacctcaaagagtccctcctcatgccctccctttcttctctgagagagtgaggatcctctgggtagcttaccactctggcacatcaagtctcagcctgattagacacattcgctcccactgag

SEQ ID NO: 34741 - DNA, 1190 bp, Mus musculus
atcttatatctcgggtatactaagtttctgggctaatatccacttatcagtgagtatatatcatttgagttcttttgtgattgtgttacctcactcaggatgatgccctccaggtccaaccatttgcctaggaatttcataaattcattccttttaatagctgagtagtattccattgtgtaaatgtaccacatttttttgtatccatttctcttttgaggggcatctgggttctttccagcttctggctattataaataaggctgctatgaacatagtggagcatgtgtctttcttactagttggaacatcttctggatatatgcccaggagaggtattgcgggatcctcctgtcgtactatgcccaattttctgaggaaccaccagactgatttccagagtggttgtacaagctttgagttaggatctttttatgttttgtattttctttgattgttgtgccaatgttctccatggaatcttctacacctgatattctctcttccatctcttgtattttgttgctgatgctcgctttgagttaggatctttttgtgttttgtattttctttgattgttgtgccaatgttctccatggaatcttctacacctgatattctctcttccatctcttgtattttgttgctgatgcttgcatctatgtccagatttctttcctagagtttctatctccagggtagcctcactttgggttttctttattgtgtctagttccctttttaggtcttggatggttttattcaattccatcacctgtttggtcatgttttcctgcaattctttaagagatttttgtttttcctctttaaggtcttctacctgtttagctgtgttctcctgtatttctttaagtgagttattaaagttcttcttgatgtcctctaccatcatcatgagatatgtttttaaatccgggtctagctttttgggtgtgttagggtgcccaggactaggtggggtgggagtgctgccttctgataatggtgagtggtcttgatttctgttagtaggattcttacgtttgccttttgccttctggtaatctctggagctagttgttatagttgtctctggttagagcttgttcctcacatgattatgttagcctctatcagcagaccttggagactagatctctccttagttttaggggtcagagtactctctg

SEQ ID NO: 34742 - DNA, 1138 bp, Mus musculus
gtcgagtcaaatgacactgctctaccttctctgagatcaggagatcaatgagttagcgccttattctcccccgcccctgggttgaatctcatattggcctttgaggttgtgtctttaaactttcatcagtgtaaaggtacagcccctaactgagctccctctcctgctcacagctcaaactgtagtaaggtcgatccctcacgtccttcttagcgtaacattcacggccgtcgaggaccttgccttgtccacttttccagccttgccttgttttggcaaacacagttctcttgtggcacagccagcctcacttgctttggttttatctgcctgcttttgtgctaaacggcagacttgagcagttgtactagagatcacacaggcccccagcgcgactaaaacaccctctatgtggtcctttgcagacgggagtttgctcactccgctcttgttctgagagagcaacccttctcttggcttttcagtgatcgcttaatgctcttccccactatcttcattgtagactaagtcctacttgacttcttgatctcagcttaggggtcccctccacagaaagtcttctccaactttctatatttaggccagctaagagaccgtatctatatccttctaacaaggatgtcttgttagacatgtctatatctggccgtgtctatatctgaatacttaaagaaccaaattatcctttttttttttttgctttattcatagatgctaagctgaggatttcaatagtatctgtgggacctacatatagaagaacgtgtgaagtaaacccttgatcagcatttgctaaatgatatataagtgcatagcttgttgacagtatgcccccagttatctataagtttgtgtagactgacgtatgcatgcatttaaatgtgctgtctccttgtattttacatacctggttaagtcataacagaggctatgttctacataatttatctccaagtctgctcttgctcttgcacttggcttctccttattaaggttttgccacatgtaaatctccctgctttatcttttcctaaacaggaaatgctgtttcctttcttgtttctgcttccagcatttccaggttgcctgagtccccaagtctttcttacctcattta

SEQ ID NO: 34743 - DNA, 1299 bp, Mus musculus
ccgagtcgcgcggggcccagcgggtcggaacacgtgggtcctctgcgcccggaaccggaagcgaccactcgccccacctccaaggggtgctggagcctgtctaggctgtaggaggtttggtccactcgttgtgttcctgttggtcgaagcctggggcttctccagtgagacccatgccgggaagcattccctggactgctgccctctatggccagtcccctttgcggcaaacccatcaccttcctaggcgtggtattcattgtccacttcctacagggttttgttttcatctttcatgttggttttggtatctacatctccacaagagaatcccctccttcccacgcagttttcttttccttcaagcatggaagaataaaaaaagaaaggtttagatttgaatgctggctccttcatgcacagctgttgccgggccgccagaacatctgcctgtcaactctgtccgtcttgaaaaaacacaaactgttggtcttagaactaaaaactggaaggtagactgaagctcagtaaggaaatggtggtgttgtctattaacctttgtgtgctattttggtgcctctttgccactgtcttccctgatctaagttgttcatttttgtctttgtccctaacacttctatagtccatcttgccctgaatgtcacatggtgacatgtgcaagtcttctcctttcagccatttcttgaaaaccgtttccgttcatgggacaaactgctcgagactgcttagcatactttgaactggacatgttaattgcttttgctagagaggcagctgtgttctgcagagggtgttacaacacccttgatcaaagctttgttgaagccccaactggaagactgttcttcggtcaaaggagtggatggagtctacctctagcctggctgaagaccgagcaatcgtgagatttaatccagttgtgcccagccaatcacctgaccaccccaccagaatgcaagttcacttaataccgtggtaaaagacatgggagttggtgacggtatccctttaatgagatagataatgtactttttcagaaacctgattctgttcagttcaggcagtcagtgccagaatgggcaggtctgtctgcccttctgagtcctgactaaggtatacttttcccctcctcctcctcttcctcttcctgttcctcttccccctcctcctccccttcgtttttttttttttttttttttttttttttttttttttaaatctttatctgaggacactggacagagccaaagtatgctttttctgttacttggagccttt

SEQ ID NO: 34744 - DNA, 1177 bp, Mus musculus
aaaacaaacaaaaaactaaactaaattcttgactgttgtcttccaatgctgctgtgccacaaaaggatgtaacaatatggccattccactcgccaaattcttgaccttatttcaactgctatgtatacagatgcacaccactgctttccatgtaatggtaacatggctttggaattttgaatatgtatctctactctcataagccacatggcacaatttctctaactctcagccttactcttgaaaggtggttaacatgcctatctcacatgcttattttatggagtaaatgatataatttatataaatctcttggcgtagaagatggcacagggtagatgttcaatatggctcattttctgcttcaagctcctttaagttcttttgagaaatcaagacttagaaaataagcatacagtctattttatttcttcataattacaaatgaaaaatgaggggaaagggttggtctgtttattgtcatatcacaaatgaagtgttaaactcaaaccaaaaagcaaacaggacttgctctggaggcagtataaattgaattaagtaagttgttgaacacagatgggacagaaccttggtgatagagtctttatctgaagatggaatcagtaaggcttctacttacccaaagcaaagacccttccctttctgcagttgtcaggatgcatgtgactcatagccatgaatatgccaagtcttgtgaaagctcaacccggaaggcaaagaaagtgaaagtgacgcatgccctggcttttgtccttctagcatgtcatgatcagtgtgccttaaaccatgctgaaactggtttaattccgaagacctgggatggagtccagaactctgcattttaggcaagtgctctaccactgggctacagccccacctggagaaatgttttgttttgccacttcttctctcataaaagtcatatttgagaagcaagagaatattggctcaaagcttattacaatagcttttaagaaacagaaagaggaatggaaaatgagaagataggaagaagaggagaggtcaaataggcagtggctggtacaagatggtcaggtggtcagaggcttaattatcttctactctgaaatttgactgcctttatagtcaacatcaaggtttaaggtgaataaaaaatgtcattgacaatatggta

SEQ ID NO: 34745 - DNA, 1201 bp, Mus musculus
agtccaacaagcacatttgtagataacattattttttagtgccaaaagtttggacaccccaatttacagtgttctcattgttggctgtcacagtaaatctaaatctggtcatgttcttcccctagtgaagatcattcaatcattcctgcttttctcttaagtaagattctttaagtatatcacacactagctggccttaaggtagttattccctttgcaatcctttatagccatgcgctcctccccccaccccccattcctgaactgggtgcatacaatctttacaagtgtcccatgaactttagctttggaatagcagttgttaaaattccttcccaagggaaaacataaacaatatctatcctttgtctcaagttcctaataaatgaaggcatgattccaccaaatttcactctagggaacaaaagagtttattggacatccttatggagtataggtgaggggttacttacaggatgtggtcactcttcccccaaagttcacacctagaaagctttacccaaaggcttccccacaactgcacagatggaagccctgctctcgtcttctctggtgtgactgtgtgtattctggcccctcctgcagggaatttgctgagttgccagttgtatacttggggttgggaatgaactattaaaaaagcgcagctgggatccttggcaagggggcacagctgaatgctccaagatggaagctggttggcttggagaaaagtcacacatgactcttagtacctgtgacctttagcttggctaaactttatcttttaagacagcttaggttcatgtcttctgaaatttaatttgatcctattctctctacccttacacatggttagaagtcacctaaatgggtcaaaagcaaccttggtccatccattctgttttctgtcttattacatagccactgcttattttccttgagaaacttgatgttagcaactgtgatttttttactctcctattacaaagaacacaataaatgcacttaagccctatgaatctctactctcatactttcttgctatcttagcacccatagccagtcttcccccacctatactcatactttgctgggtcattgagtcttgttaattctgtctaacaaatgtctttcaaatccatcatgtcttcatctgcattaaatgctctagttcagtatctgccacattctgagtgac

SEQ ID NO: 34746 - DNA, 1656 bp, Mus musculus
gggaggaacactcacaaagggaacgagatgaggaggggaaactcaagctgcaaaggcacacgaagaaccagttatctttacaaagacaaggcaggggacaccctaggactcttctaatttcccccttctttcaacctttaatctcatcacctggggccctgaggtttccatctatccttcagggctgcttactgtttgttttctcagattaccatcctaggaaaggggtcttgggattaagggtctaggtgaaactagaggaagtcagaatagttgctttctaaggaccccaaggttcaacatccaaagaaatttaaaacccaatctttaggtggcacaggcaggtgattcaaagcctagaaagtcacactcgcacacatccatcccggccccaccgggctcatggttctagatgaaacccaaaagcagaaccagtaaaatttaaaggataatttatgggaccctcatactctccccagatccagccttgaggaacagtccccctccacatcacacagatcaggactccccctcctcacccaccgccttggtctcctgggttgtttctgcaaaccctccaccagcgtcactgcctcctcgccactctcgggccgctggcctcgcacccagctctgcagttctccaggcaggacagtgaggaactgctccaacacgagcagctcaagaatctgctccttagttctcctctctggcctcagccactgatgacaaagctctcgaagtctgatgagagcttctcgagggcttgatgcttcctggtatcgaaagcgtcggaagttctggtgagaggtctccagtacaggatcatcgccctccaaggcggattctggcccgcacgtgaaatcatcctccagtttcaccatcagaactccttcttcttcccaaagatcttggtcctctggctccaaggctgttgccatttcctggctcttgggtgttatcacaccatttagccctcacactggcgataacgtgttttagaccgggtagctcaaggggttcctcctaagggacctagggtagagtagtaaagatgaaagagaatagaagcctgcagttatgcagagacaacagttctgactttgtgatcctttgtatacttctgaaataattaactccccccttccccagtctccataactgcatgttgcaataaaatcaagttgggataggcctggcaaggtcctcttccctcacttcctagggaaggttcctagcccataaaaaaacagtacaccgctctactcacaatagtgtggctttacctcctaatgcctttcttctacttccttcctgctcagttctttagtttggctccttcaattcctgtctgtactacagccagcacattgtgagttccccacagtccttacatggttgggagaaacgatgctcagaatgcctacaaacaatgccccagtggccatgatttgtttcacaggcgtatagtatttatatcttgagccatcagcagggtggacatatgttacgcaaggctgcacgaaactaatattaaccttggtcaaatggaaactcttggagattttcagcactctagaggaaagacactaacagcaccacccccagagcctgcctttatcttgctaagacatctttaccgggatgactcactga

SEQ ID NO: 34747 - DNA, 1204 bp, Mus musculus
aaaataactcttacttcctttaagttgatttcctcaggcattatgtcatagcaaggaaaagtgaccaatgcaagtagatagaaatactcatttgaaattcaagttgatgcgtgtctctgaaattccagctgcttattgatattatgacatttctgcatgtggatttttactgatgacagagcaaatgcatattcctttggagggtggtgaggtgactaaaatgtaagatgctgtttgagcttggacgccatgcgggctcatggaaggccagcagcctcaggtacctatcaagtgcagcttttccgctaaaaacgtacagagaatcctaatttgacaacactcactttttgttttaatgtctaatatttgcatgacagagtggttccctgcccccagcactcactcactcattggctccgttcttttagccttttctgcttgctggccaccctgcccacatccccagaaggctgatcagaaagctgagatgggggtggctgctgtccctgcctctgcagctctaacattgcgttagagcaggtggagatgttcaagctgagaagaaagtacagctatatttacttgggattgtggttgggagaatggaggaaggtcccctgaaagagctttgctttcaaatccttaccgcccacactctaggatctgtcactcactcactcactcattcatttatccactcaacagtgtttagcatgttcctgctctgtccagtgttgaacagaatgttattggtcctgttctcagaaaatgaatattatagtgtggaaaaagtcatttggacatacaatacacaactcagtgttgggtattaacgtgtggcaagatgacgtttttgtttgtttgtttgttcgtttgtttgtttttgttttgagacagggtttctctgtgtagccctggctatcctggaagttactctgtagaccaggctggcctcgaactcagaaatccgcctccctctgcctcccaagttctgggattaaaggcatgggccatgactgcccggcaagacgttttaaaagcaggtatcagaaagaggtctctttgagtaagtgacagctatacagggactttgagatcaaaggacaacctgaggaaacgtctggggaagtgagtcctggagagagaagagaaggtgccaggttgtgagacaggagcatggaaccgagtgagcagtaggcagcta

SEQ ID NO: 34748 - DNA, 1180 bp, Mus musculus
agggagtggacattaggagtggaaggcaagttgtggcgggagaggcaaagccttaattttatgatttctcaggcttttcaggctttaggatttccatttttaccaatctttgtatatgctttcaaattaagtagtacatataaagattatatgacattttttttgtgctagaaaatgttaaaaaaaaatctgacaatgtaagttgtatacttacaaggtgaaaaattaacatctaggctactatacctgacagttttttcttctttctctctcactttctttctttctttctttctttctttctttctttctttctttctttctttctttctttctttcttcctttccttctttcttccttccttcctttcttccttccttccttccttccttccttctttccttccttccttccttccttccttccttcctttctttctttctttctttctttctttctttctttctttctttctttctttctttccaaaaacagtctaagaaaataagtattaagactcagtttaacactaccctatgactctctgatgggatagccactgtcacgatgacagtggggccaggggcatccttgagtgcagaggaagtctctcctcccaggcttatagaactcaagagctattggttccgggtccctgtctctcagatttgaatagtgaatctcacaggcgtaggaagatctaaatgggatgtttgactgtggagaacaagtttaagaaggactcagatttattagaaggtcagcatccttagggctggggagatggctcagtggttaagagcaccgactgctcttccagaggtcctgagttcaaatccaagcaatcacatggtggctcacaaccatctgtaatggggtctggtgtcctcttctggtgtgtctgaagagaacaatggcagtgtactcatatgcacaaaataaataaataaatctctagaaaggaaaaaagatcagcatccagagctcccatttgatgtgatggaagaaatgggagagagacaggcatcactctgggctccccttttggaagggcctctacgtagtgtggccattgagttgttagcttatggacttttcataggactatggcagaaacagaacaaagatgaactatttttattagtcagctaatttgagggggattgctctgtgcatgat

SEQ ID NO: 34749 - DNA, 2539 bp, Mus musculus
aagcaaaattggaaattctcagatttattacatatgtagttctttactaggtttaattgttaaggtaaccgtgatcttttaaaacaatttcagaagtattcattggggtgggatgggagttgggggacaaaataaagtaacagaagtggccctaaccaccaagaactgctgttcgttgacctgcagtatcatttagaggaggagagcacctaatttgtcagagaaagcctcctgtcatctagtgaacccagatgatatgtgtacatgaagaatagcccccaagaatgatggctttctcgtgagttccttctgtcttagcattagcttgggtttttacacctggaagaaatcaaaatatcagtttattctcagaaaaaaaatctttcttccccttcgtccatactttgtgaaaggattgggaattcaccccctgcagccaaagtaccctggacaatagcctggcaagcagctcattgtccacaggagggcatggaacctagctggcttttggttacttcatccagctggcaagttttgttcacttattgtagatgtaagtatagtttgatcttctgtgaggatttgtgtagcaaggtatttgaatgctttttactggactatgagagatctgggcttgagttcctggccatgttagtgcaaaagtcatgtagctttagataagtccctgacaccaagcttcaggatccaagtgttaacaggaaagagctgaaataaatgacctttaatgtggtatctaggtttgaccttgatttggagggtaggccagagatgagagagatggggagtttccagtcttggaagatgtcctgccagggcagataaactttgttcttggctagaaggtcttggggcttccagtggcagggacagtcttgctcagcatgagcacgagaacacttccttctttcctttggcatagttttacatggaattggtttatgcttagagggtaacagcaagaagagcatccttttggccctagcccatcttccatctccaggcactgtgaatcctttctactatccatactcctcactgatggaggagactatctgaagaagccattcccagttctagaacttctgtttttctcagccaaacccctgtcgcaatttgaataaattatgaaaccgttgctaaaatccttggcttgtgttagggcacgggtatcaggagtgaggagcaccagggacccgcaagaggaatttgccacaagtggattctctacttgtccatagctcctcccctatgctggcactggtttactcttctcatagactgcatctgttaggatgaggtgttggggaaacgactggcaaagggaagactcttttggactatttgtgctcccagaagggtcctttctgtgccataccatcccacttccttagctctgcagggcagccaaagccagccctggtcgttagggccaaggagaaatagcaatcttctctcttcccccaggtggcagggctgtgatggcccttcctacacacctggactctgcctacccactccaggactctctccctccccccaaccccatccccatctctgagctatggggcaatcactcccattttacctttgccatccttgaccttcgttcaccccgctcccacgcccccccccccatcctccagcaggctggccccactcccttccatctccaagtcttcttccagaggatgcatttggatcccagaggagtgttttctggaagacaatctttcaacatccctacattcctgatatgaagcaggaatttgcacatggtgtagagagctccctctcctgcctctctgcccagccttgttacctcactcctgctccagccattgtgatgggctcagccagctccctgttctgatgtgccctgcaacaacagctcaggggtcttgtgacttggagaggtcctcagcaggcctgggagcccggattggagccttggctgccgttgagaagcacttacctgccaagatttgctgatgccagacgatctaccccagcatgtgaatgcataatggacattgccatctctgccctttggtcctccttgcttctctccatacaataagacacctccgaagcaaaatggcggcccttgctccaggcaggacatcagactgtctggggagttggccctgggcttctgtgttgtgtgcagagactgcacagtaaaacagtcacttttgccaacaagaatgtgtggcgccccacatctccctaccttgcactctagggccagaccactctctgtatggaccagaccatcttcccaaacccatggtgctttccccccgaccccactcaacctacattctgaggaggggagggatggatcagaggccatagtggccccctggataatcctgacatggggtagagtcgggtgaggcagagggagcagcacccaacacctgcactgggccacaagcgggaaagaacacgggttggttgcagttgagttgttgtctggccgtctgtatttggatctttaactgtactttgcctggcg

SEQ ID NO: 34750 - DNA, 1099 bp, Mus musculus
gagtgttaccaagctagctatgacttggttgttgtaatcacgaacactcagcagctgtggctacctgcacaagacgtaaatgaagaacaaacaaaaaagcatgaaataagcagagagactatataggaagaagtggatctgggaggggttaagagggaatgatcggagtgcatataccaattcatatgtgtgcgaaattgtcaaaaatttaaaaatgaaaacttataagaagagagtcttctgatattttgtcctaccgcagatgcccagaccctgggactacaaggtaacaaactctgagataagataataatatgcaaaattgtgtctgagatggagcaatggtcaattcatacattagcaggagaaagaaaagcaaggctgcaggctgtgtagcatttggaggatggggaagcagctaagggcttagaaaggcatcccaagtaccaagcgttggctcaattgaaattgtttcctggaaatattaatctagcaattacaggtaggggagtctggaattcagggggacgacaaagtcataatgattccaaagttaataaggagatatttgtgtagggggagggggctggacagatggctcagtggttaagagcactggctgcttttccagaggtcctatctataatgggctctagcgccttcttctgtcatgcaggcatacatgtaaatagagcactcaaataaataaataaataaataaataaataaataaataaataaatcttaaaaaaaaaaaaagaagtgagatctggggagatggcccagtgagcttgccacgcaggtgtgagaaccggaggttgggtcctcagtactccctcagtactcacagaaaagccggacacaatggaatgcatctgggctttcagagcagagaccggcagacccccagaactcagtggccagccagcctagtcaaaatggtgaatggcgaagcaactgaggaagtcattagcctgtggctcccataggtgcccctgcacacacctgtgcacacgctcatataccacatgcacacactccaaactgtaaaaaggaaaagaaagaaggaagaaaaggaggtgatcaggggctggcgaga

SEQ ID NO: 34751 - DNA, 1153 bp, Mus musculus
tagtttctttgtccataccagggtcagcacctgcagtgatattggttggtttaggctgctgcagttaaaagataaacaccaactctggggagggccagcgaggggccccgaggtcatgatgatgttggaaagttttcgttatagagacacaaagaaacctggtagagctgttcggcctggacagaacaaaagagtatctttacccgcttagggtgtgccgctgaagacacacttctatcctcagaagccctaagttcaaatcgtgggtctgccacttaagattcatatactgccttgtgcacataccgtttccccttctgagcctcaatttcctcgcttgtgcagcggggatgatgatagtgagctagaagaatgtgctgagcctctgacataatagtggtctacctgtcgtgacaccaagcaggtaaggagacagaacagtgtgtgacagacacactccatgggaacacacagcctcggctttgaaattaggatgggatgctaattccctgcaaaactgagagcttggagatttgctgcaggctttaagagatgcagtgacagaaggaaaaaaatagagcttcctcacacagtggcttgagacggacagaaacttacctcttccctgttcttggggaaagtggagaacagcctgttacttagcctcctttcttctcaagtgggctaaatcacttgtctgtgtcacttactgtggaccactgatgaacacatctatctcctcctttggtcttctccgaatacttccatttccttcctaaaattgattttgaacccagaacaagaaataataactttttttttgtcagagatcagtcaaaggaccagagagttgtggtcctctgagagtggctctgaattgtgagccagtacctggccctgttgcacacatgtatgctttaagctgattcccctcaagccttttggctctcataacaccacatgttagggagaggggggcggtgtggagtgtaggagagtcctcaacgctggctgtgttaacatggagaacatcttcatggctgatggctgggatgacaaaatgttctcgttgccagagtagcctctacactctctgtgccctagaccacacatggcaggctggttattgccattgtgagaggaagagctgtct

SEQ ID NO: 34752 - DNA, 1109 bp, Mus musculus
atttttaccctcatcttagagaaatacatgtgatttctccaaaacaaagtagaacacacttgggggaaatacccttgtcaaatgcccagaacttgatgttcccttttctgtattcttcatagcttgtaaataaacccatcatggtcatgatggtgatgaatggctttcctttgatgtcggtaagcatccacagttgtctcagcttcccactgagccatgtttctcaatgtcagttcttgagctccatttttttaactaaggaatatgtttttaggacagtggtgctagcaatggtaatgggggtgatttatttcattactatccgctgtgccaatggagcagagaacaaacacggagttactttttttacacagtcgacagtggaaagtctttcaagttagggaatgtagcatttggtattgtgctgtggctagcaatgcccgtacagtttatacatcgactgaatacacttttctagtgtgttattctgcagtctttgaaatgaaggatgtgcatctctatctctaggaatcattcatagccactgggtccagagagttaatgcaaccctagtgagttactcagacaacccccatttgattttataatataaatatcaatttgcttaattattaagtgatgatgattgtgttaataatagatattactagtacacatttagactattctttggtatatatctacaattttaatctgatagtatgattaattaacaatgtattgtaccttggtcattcttctgtttttccatcaattatacgtaaattatactttatatatgtacatattaggtgttagacttgttattatttagttcattaattatcatcctacttagcatttacatgaggtattgtagtgaataagataagagttgatatttccttcccttggagattttcatctaggaatgggaccctgtgaggtttcctctatccaggctggcatgtcacctggtattgtcaccatgcaggtcttgtttaggcatctgcactgctgagattttatgagtgcagcttccctgtcatgtcaggatgacactatttggatgtcaatacaaatatatgggctatgattctgaagagcca

SEQ ID NO: 34753 - DNA, 3940 bp, Mus musculus
tttagaactctaccggaactcaccaaggcctgactgttttatcttcaggagaggacgatgaagatgctcccatgattactggattctcagacgatgtccccatggtgatagcgtgaagagcttttctcattagaaaccaaatggtgtaaatattttatttgataaagatagttgatggtttattttaaaagatgcactttgagttgcaatatgttatttttatatgggccaaaactacaaaaaaaaaaaagaggaaaagaaggaatgaataaactttgtagtatcaactgtgaactgaaaccaggttgattttagtaaccacattctttgatttgacattgatgtcatcttacagggctgcgcttgctgggcatgcttttaagtctgtgagatcattttgcttcattaagttgaccattctttttgtttttctaagacacagaaatgtatttaataaaaccttcaagagagagtaatggacggagtgcattctccttgaaaactgttcagagtttacgtctcgtttgggttcagtttacataagtgtgtgggtgtcttgtgggggaaggttctgtgctcttgtttttgttaatttattggaactctgtataaggccatattttagtggctgtctgaaaccccatgtgtgaagggccccttgcccaacagggttgaggtggggagcaagagcaatctgtttttatttgctcgtatgtcagggacaggtgtttggcagaagagacttctaggttactgctagattccaattcaactgccttgtagcctgggaagcccagcaagtcataacctcctgtcttctaggaacccgtgggcttttactgtgcatgtctctgtacaaagtgtacctctggaagctgccaagtgataacactgctttcttatacactgggatcattgtcacttgaaaaaaaaaacattattgtggttgtgggagaaagctctagatctgtgccataatagatatgcattgcaattgtatgccatgtctccattttaaatttgagtttccctttcgtttttactcaccaccaaagaatctcaaatgtaaaattttatattgggtttgaaccactgacgtgtccattctgatatatgcagtcattttgaatttggtctgtgccttctctggatccctccctagcctgtgccccgagccgtccatagagagtttgtaggtatttccagggatggagaagatctaagcatttgacttccccatcagtacatttgttcatttgctttctctgtgaaacgccatgattgtctaaacaagtctcccctctgccctgatccctttgtaccaagtcaatggccacttgaaagttctgtggactcccttgtggcctcaacccgttcgtccttcagcctgtcatccttcaggcaccgacgcccaacctgccgtgacctgtgctgtatgaacaacctcactgaggatttcctcccggcagaaaagcagcaagctctgcaaatatcccaaagttatgcctctgaacacatgtcttctatatgcaagttttgtgaaacctgcctccttcccgtgcaatgtgtccctcctcacaagtgcttagtttctgttaactagaagtatcattcttgggtggaaataggtctccgtttacctgagctgagggttgtttggaaaataagagccaatttttcttagaatatatatgtatattaaatgagcatttgacctgtagatacatagtgtgccgtttggccagagctcctggtgtcaaatgctgggaacaggagtcttcttacaaattatttttctcctctttcctctcgccctctctttcactattttccccccagactggaatttcctcagctttatcttgtcttgctttgaagttttgctcaatgttcctcccttccgaccacttccacttaaataaagtctttaagtagctgaaggattaacagtctggtgggaggcaagccattgaactgaaccacgaggaaagtatattttcttcttttcttttcctgccaagttttcggtggcatttgtagaagctggtgtgaaaggctaggaggcattgttttctattattcctcggtgaagccttttcccagagcatatgtctccggcaggcagtgtgggttcttgccaagcatcagaaccagtctccagggcctcccgacgccgatccatagtactgtacagacccaccgccacccttctcctcggaagatgcactgtgctgtttgaaaacatgtagccgtttaaggctagagtattttatataaatagaagagcttaggtcctgaagaccaaggcagatagatgcagctatgtgtacattgtatatttttgtgaacttctcaagcacgcactcccgtttccctctgctttgcagaggttttgatgtatccctgccgtctgcaagagtccagaggctggactgacagtaggaagtagaaataagctatgtgtagtcttggaaagttcccacctcacagggaatgaaacctagggaacaccaggtactcggcgccctgtggactgtgtggaaactgatttttcttttttctatactgaataccctttgagatttgtgtgggacatgggtccatgtgggtttagtgacagagaagagttcctccaaggactcttggagaggggccacatctgaggagacaggtgagaagtctccatcactgcttggtgcctggcaagctggagaggtcagcctgctgccaggcaactggctgtctttgggaggggtggctcttaagactctacctctgattgcatcactaggactaactacaagctggctggggatactcccttgtgtgttctgtcctatccagatggcctgctagattgaattatactcaccaacacatagaacaggccctttagaaggcactaggtgtttggaggtgagctaggaagaccagtggtatgttgagccccttacagataagcaccggtgtctctttggtgcaccttgccttcagatgctcctggtggtcagctcaactagcaagaccctagtcccctgttccaaagccatctcatatgttagttctctgtcccatgaagagggccgtggtgagttcccgagaattgtctctctttcagcagagaggtgagggactcagacatatatctaagttgaatagcatccccatcgcagctgtaagaattgagctgcagaaggtaccctctgtcgggattgtatctcgacatccctgtcgcgtttttcttagctggagtgtgtgctgcctttcaggtacaacttttatgtaataaaagccagagcattaagcttacacagactactttctatgcaagacagagatatggactaggttacaggaaacgtgcaccgttggctccacagacaagaagtgcattgccagaagagcatcactgaacggagcggagggaggaccagttgcatgtgtttctgcccactcattttgagcagccatattataaaatggatcatcagagctgagtgacaacacgagagtggtactggtttcatgtgcgaggacttccatggactgaacatggatgccggagcagagcatcaattccttcatagattccaagtcactcctcgatgaagactcttgttgagacttactaaacactttaggcgcagtcgggaggatctgcagcaaaataaaggcctgttctgctcttatttaacatgaagcactgtgtacttgtttcttctctccaaagtaaaattagattatttataacttcgatcgcctcggctaggtttccaagtcactgatttctgctgaagattttactacgttgttgcacaattttaagataatttttttttttggtcttggtgtcaacctttttcactgaataaaaatttaactgggttaaaaaagaaaaacaatgaaaaaaaataaagacaccgccatcacctatttaaat

SEQ ID NO: 34754 - DNA, 1187 bp, Mus musculus
gtgagtacattgtaagtactgtctggacattggtgtgggtgtcagagagcctcaggtcactagggtgtgatttgacgctgtggagaatgaccccatctgccaggttgctgcccatcgttcttgcctccttttcctatcgctgtgatgacatatcctgacaaagcaacttaagtggcaaaggtttactcactgttcaagaatatagtccacagtggcagggagttcagggacctaagagctgaaatagctgggccctctgcatctgtagttgggaagcagcagtgggtgcctgtgctcagttcactttctccatatgtacagtccggcatccagtccaagaaaaggatgcgctagctacaccccacttattctaatcaagataaacacctgcagggatgttcacagtgtcctctcccaggggagtctagatcctctcaagttgccaattaacactagcagcgccctaccttccccttccccgtgtgagcctttacaaggcattagcaggccggatctctgattacctcttccctatgctgatacttctccctgtaggtggaatacagcaggagtgggtccaagatgtgggcctcccagagagctgctagcaactctacagaaataaagaacttactgctcaatgccctctacactgtcagagtgagtgtccacgttccctccagccactggccagtcccaaagcacagggaggtggctccctttgtcaggtctctgcttacggtcaagagatgagtcttggtgttcttcacaatacctagttcgtccagcttccctctgagagaacgaggagcttgtggtaatgtagccctccctgcttctaaccagacactgttgcctctggggtctgtacttttgtatacaccctgtttttccttatcattagctatgggcaatacggtgctgagtggcagttataaaccaattttgtgaggttcctatgacacccagtataagtatatttagcaggaaggagataggttttatgtaaagggtatttactcaagccattaagacaccctccacgccctctcccggagattcctcgtactgagtctctctaggactcctttcatatgggtgtacatatgccttaaagatctcactcacacatgcacatacacacaaacacactcacacatacacacacacacatacagacatacaca

SEQ ID NO: 34755 - DNA, 1179 bp, Mus musculus
tgtatcaatcatgaatccaacaacaacaacaacaacaacaacaacaacaacaacaacaacaacaactggcccacagattttctccaggccagtctgataaaggcagttccttaattgaagtttctccttctgaggtgactctagtttgtgtcattgtcaaaaactaagtagcacatacaatagatagatttcaaactattttggatacaatattctgggggcattgcagtaggtatattctattgtataatactacatatcacttcctctgccaattagcatttagattagcatgcatatatgtggatctctttgtatagtattggaataatgtgattataggcagacttcagtaggtgaatttttgagtcaagttcaactacatttctgaatgaatctcaaatatagatggtagtaataatgagtgactgcatgtcaaatatagacaggcagtagtgataatgatggctttgagaggttacttacctctgagacgtagaatcaaggctggcctgtgtcgttctgatgagattgtgtggtccctgtattgaccagggtgatgttctggactgactggggggacctgaagcctgggatttaccggagctacatggacggctctgctgcctaccgccttgtgtcagaggacgtgaagtggcccaatggcatctctgtggacagccagtggatctactggacggatgcttacctggactgtatcgagcgcatcactttcagtggccagcagcgttcagtcatccttgacagcctcccacacccctatgccatcgctgtctttaaggcgagtcctcacgcgcagtctgccagagacggggaagcacgtggctaggcggagagctgaggcctgttgggctgttgcagttggccagaggccttaaaaacgccgtgccttcaaatctgcacagacttgtttgcatccttcatggagagatgtaggcttctaccactgcttacgtttcaaaaggttggaggttgaggtctcctcctctgagtgaatctctttccttttcagggcctgtggccttgtttcagtttcgcatcttcatcccttgcttctctccctgctgactgatgctgtgtgccatctatataaccttccagtcgttctcaccctagggagcaaatgcatctacctagaatggagaaacatatttcaaa

SEQ ID NO: 34756 - DNA, 1201 bp, Mus musculus
aaatgataaaaagcacacacaccatacatacttcacaacccacacatatacatataataaataagtaaataaatgaataaatttaaaatacacagcctctgaaaccaaacaaattataaaaagcacacacacacacacacacacacacacacacacatgcacacacagtgcacaaatcaaaaataaacagtccccctcccacccccatccccccaaatggctcaaattttatgattcagaagttgatgatgtgaaatgtgactcgcaccttcacagctttcccagaggtgctgtgttacagggctgctgccttcctccttatggctgctgcccaccctcgggttactagagatgggcagttttgagctcttgttcttgctggatggctacagaggcaccggaagtggagggttatgttgaaggtggggagacaggaacccctgccccggcctggatctgatacattgctctgcccttttctgttcacaggggttccttgcacagaaaacgactacaagctgtggtccccatctgatgagcgaggaaatgagtgtttgctaggacacaagacagttttcaaaaggaggacccctcatgccacgtgctttaatggggaagactttgaccggccagtggttgtgtccaactgctcctgcacccgggaggactacgaatggtttgttcttctttcatgcccaggaccttgaactacatcacatctgctctgtagtgtgaggctgaaagatggagaacatgttctctttctccgaggaaggaaataagcattccttgagcatgccacatgatccaggactgcgtgaggcgctctctgctcatgtcatcttctaggtctagccatgaagttcagcagacagagatgcagccggttctataggaacctcctagctcagggtttagttctaggaggacccttaaagggatcacaccgaaagctccatttgggggaacttgttttctatagttgcactctccctttggggagacaggaaaccctgcatgggcctggatctgtgcctctcgttcatgtgagaggacttttaaaaaaaaaaatctgaaatgaggttatgctcatatgtacaatatttgtatcatttattattccatgagaaaactatccaaggtgtgtctgggaattaagtggaagtaacacctgcacagatccccgtgacaggagatgaga

SEQ ID NO: 34757 - DNA, 1048 bp, Mus musculus
ttttaatgaagggaataattgccaagtacttaaatctacctgaggtacacttttaaacctcatcttctatttcttccctctcttctgcaaatgaacaaaacaaaacataaaggtggttgttgtaagctaagtatatttgtggagggagaagatatgtttttataaagttattctaatggctatttgtgcaaaaaaaaaaaacaccaataaaagttgatcataactgctattatccacttaaatgttatagcacaaaacgtcctttgtgcattggggtcactttgaaggcgtagaggtgatgtgggttataaaatctgacagcatcccagatgctcagagtcacactgcactgtgtgcaaacatcactcattgcaaccgtctctttctcatttgttagttgactttaccaagtgctctaaggaagtggaaaccagaaggaacgaagctctgtgttaggatctaggcttcccatttcttgggtacaacccactagaaccctggggtttgaatacatcagcatcactaagacatggactgattaggatgttggatgaatctggcacctagctcttagcagtgtgctgtgcatacaaaaggatccttaagatacactgtttggtactacatcaaggaacggtaaaccccatcccaccaccaccaccaaatgggacatctccatcatccctaacccccgaaggaagaggaggcagagagattgagagcagagaccagggaagatgctgcaagtctctagacatgagggggcctttgtgctcgtaagctcactatagctgtggctgtcgatatatgaaccagccagtcagcattccagagtggttggggtcatggatggggtgtgggggttgagagggtcccacctccagctgggagcttttgacagttgatgattgcttgagaagggagagtccgtttgcagtggtgcaatctctaagttgcttttgcaccactgggttacctcccaggccaaggcctgttctgattggactctggcttataaagtaaaagaagataggaaaattggagaggg

SEQ ID NO: 34758 - DNA, 3266 bp, Mus musculus
tcctagggagggatgggggtcctcctagggagggccttctctggctcttccttccctgcccctcctcctcctcctttccatttgggggtcctgggtctggttttcattctgacttgtacccacttacctggtagttttactctgttcataatttaacttggttttgttgttggtgtgtctgtttttccccctctcgttcccagttttaagtgactttgagtattttaagcatttccagtctgattctgatctcaggaactcggttaggttttagagagaagtaggcggagtgttagccctgggaaactcgctactcccctggaagcctgcgctgggcattctaaccgctccagcacctctgcgccccaggagcccctccagggtagatcagctgtcactcccgtcacctggcactcgtcctgttctaggggttttttcttcatgttcaatgaatgtacttcctgacagctttatcgcataagctattggaaatgaaggaagagttgtagatactcactccttagcagaacatgggctgagaagctggccaggagtgtgaagcaagtggtgggactggggagaaagcttgcaggctttccacctgtgcggcatccttgtgaaggaagcggcgctctcggctctctaacgggagagatttaatcacagggagctgaggcccacctttttcttgggactttgtgatgatgcgtctgaacaactctttttgttttgtattttatgtcccccgtggaatgatttttgcctaatctgtgagtgaactttcagtgtcacccccccaggtgttttttgcaggggtgtgtgtgtataaagcacttgacctttgacacagcccctcacctactctcctattctgaaatctttttctttggccttccattctttgttaatctggatggtttccttgctgtttctatttagttctgttctagttcttgttttgttctggcttttaacatttgatatgtgattccccccctcctccaaacttactgtggagtaaacgctttaggtgacccatgtgacctcttcacggatgggaggtgtagtctttaagttccctcctccgccatgtggcaggtgtttgctctcttgccaccgcacttcaggttcagcatctctaaggctgctgccccgggcctcctgaggcaggcccgaattcactgcagcactaagggtgaaagccaaagggtttagaaagatgaatgaagccgggtctcctgctgcagactttgtctcagaatcctaaaaaaagaaaaagaaaaaagaaaagaaaaatgagcagcggggatcaggccagtatagacgaggacagttattttgcaattgcattttcttgacagagttttggaaatagaaaaaaaaaaagagtatggcagccgtgtcccgaggatgaagattggttgctttgtgtatgtgcgtgcgagtgcggaggaatttgcaagagaaactgtaatggagacgttgctttgtcagcctgggaaacagttgcactcttatttttgaactttggagccactgttgtcccagggcagaaggcagagtgagcgcttacactttggtcacaatgagatattttctatatgacagagttctctgagaggcttttttacgctttgaaactcgtatcttctgttattactcaacagtgtttctctgctgcaggcctaatcctttattacagctgcgtggaaaaggagtctcatccaacccaaccggcgtgggtgtttccagagcattgtcattggcggtttgaataattgccgaatcttttccaattaagaaaatcttaagtacagtccttggccttttagaattaacagcagtaaatgaggaagccgtttgcgcatgcgtctttccagattcacttgggtggctgaggaaagaagctggttttgaaataaaatcggtgctgtgtagacatttataaccaaaattatttttataacagacccagaaggaggagagaaaagaccgtggacctttgagcctgcatgttatccgtcgtgcttgtttgtatgtaacattgatttcatcagattgagtggaagcatatggttggcagttaggaggcgaaaagctgccctcgctggtatacagagcgcgccttgggcacggcagggagaacatgcctttctaaagcagaaagtcttttcggttgtggggaaggaaaggagtaacacgagaaagccaaacctaagcccagggtcctcctgtgggcagagctgctgaagctgtgctccagagggatctcttagtttgggttgttgagataccctggattgttttaaatcgggggagtccacagttgcctgtgtctgcagcccattgccataaatgcacaagacagcagcagagctgaacgccccttgttcttagagaccctctggtgaaaatgaagccacgtagccgagggctgcagtgctaccccgagaaaaagaaggagctgtgtgagggaacgaagagcagatgcagttccaactgggattttcagcaatgtcaccctaccggccctgctgggagcagagaacacttggttgtgcagtattggtcaccacgggagccttgccaccaatagcttttcctaacacatgtgagtgtggctctccctccgcactgtagcttaggccctgggcaagtagggcgtgactccagaatgctctgtagtttgtatgtacgataatttctgtttatgaatttcacttttcctttcatttcatgtaaaactaaaatgcaaacaatctgctttcaagaatgcccagaagctctgtgtccccaactgttgttgtgaactctaccatttctcataggtgcttccttaaaatgtatgtttattctagtgaccgagaggggactggactctcaggccctttacagttgtctcctgcagttaatggaaatataaatatatatatatattttattttagaatataatttaaacatgaaggtctattctttgcactttttattaatatatatagagagagaatctttaaaaaaattaaaaatacaagtccatttactccttgtgttctgagtgtttcttccggagcagcgggtcaaagatatgtggtgggttttatacagctaaagatgaacattgattctgggggtgccttcttggtgagattggcctaagctagtaacagaatggcttgccaaaggtaattggaatttcactgaggttgaaaaatctcaattaaaatttttctttaaaaaaaaagattttatctgttagcaaaagtt

SEQ ID NO: 34759 - DNA, 1185 bp, Mus musculus
gctttcttttcttgaagatgcttttattatgttgataatcacggcattgtcatttagtccataggcttgaatcaaattaggaaaaatttcaatttctactttttgaaaacaagtctaaattatttaatccttattgtagtaactcagtgagattatatctttcatgatcatctttaataatttaaggcctaaattttataaaggcaagtaccctttgtgaaaggatatctttcatttgtttagtaatgtgtgtcctcatgaaacttaataatgattacaagaaataaaaaatggagatttatccttcacagatctaatctcttctaagtgcatttttagactcacctattttatccttcaggggaggtggcagaaggttgtccagctgacaaggaacggcattataaccgtcagacagtttactgtttggtctcactacttggcagcagtcagcatagtcctgggccctaagtagccagatcgaatctactgtgcagtaattttataagtaagccatgcagcccagtacactcacttctgtggtcactcagagttgatggtaggtagtggtcgggtagtagatggactgggcactggcatctcagtgctaactgctccatgcgtcctccagcagttcccggagctctgcagcttgactgcagccacagggatggtagactctcatcatcagctacaagcagcgtagttctggagtcagcacactctgccatcagcagcagtgctgtggcgggggactggaaggagctgctgactgtttccatgtgtaaacttggccatactttgtccgggctgttgtaacacgtggcgacccctggttatcagagtgctttgttatctccggaaggctgctgggtgataggtttagcgtctgttcctaatgagaccgggccttctcatggcagctcagagataataatgagagaggctgtaggcagttgggtaatgaccttaaacttgtgtgcttacagctacaagaaaatgtgtattagcaacctgttcagaggggtgacctctgcattgctgtgggaagacagaggagtgttcctcccttggtgactcaccaggcagggctaccgttttgtgttcaggtttggcgactttgatgtagttacagtaagaattttggctacaatcagttcatacattttagcaaggtctacttct

SEQ ID NO: 34760 - DNA, 1172 bp, Mus musculus
tctggtgctgcttcctgcttggctcttgatggtggcctgtagcccacactccctgaggattggtaagtacgggctggctctggatgatagtctcgtcgctaccctaagtgtacacagaggagatgtctatacttcataggctctgtgggatgcttccctgacctccctgagtatggctgtgacagacatggaggtggtggaggcagaggcagatacagatgtgaatgtggaggtgatgagggggcctgtgctgacagctcccatctgtccttcctgccagactccactagtgtctagaataaaatgatgctcactccccggtaggattcatgacaggttcagtcctgaatgtgaagctgttagtaatggcggaacatgaaaaaggctgtagggattccaaatccaggactggagataagcagttggttacctctttcttctgattagttaaagaagaatctagaacttggtgttaaggttgtatttggcaatttggatgaagtcaggagtctgcttggtgattctagtccagcctgctggcaagggtcttgagttgctatctgctagccatggtgtagctctgaaatggaagacaaggcacctcagcctcttctttgtcctcattgctgagaacaagcagggttaccacctacacccctggcacctctactcctggcagtcaggatggaggcaaaccatgtgcctcctccctgccatgagtaaagctcagaccactggaaaccaagactctagatcttgggacctggtggtagagatgaggacaccatctactctagcacaaggaatccttggagtcaggacaggtgggagggtggtagaggtcagacatatgtagatgtgtatgtgggacatgggttaagtgtggcatcagatatccaaattcttgtgggctgaacagaagtctcctgagaccaggacctccagtgttaggttagatgattgttcttgtgggcggttatatgcagataactgtgagtccttcttccctgactgaaggtgggtggagtagagtcgctgtggtcatgactttttttttttttttcttttgagataaagcttcactgtataaacctgtttggtctggaactcactacgtagactcggctggccttgaagtgatatagatctgcctgattctgcctcctaaatgc

SEQ ID NO: 34761 - DNA, 1214 bp, Mus musculus
tgaagtttctttgctttaaagctacattaaattaaataattgaaggttatcttcccaacatttccattattatttaatagtcatatgcccatatacagcagggaaaatgtaagagggtagaaattgtttacaacccagcacttacactgttgtcaatggtaacagtaaccgacatgtatggagtagtcgccatgcaggatgcatgactcttacgtgctttgaagcactgtggagtgactatgtcttatttatagctttcttttaataaaaaagattttatgttattttacatgtatacgtgtgtcccagagtgtatgcatgcacaccatgtgcatgaaggtgccctcagatgtagaagagggtgttggctccctggccctgaagtcacagacacctgttgtttgctgtcgtgtgggtgctgggagccgaacctgggttttctgcaagagtatcaggggcccttaaccatggaaccacctctcgagccaggatattttgagttgtaagagttcacatattcataatgcataatgtctcatcttggggatcagacctaagcctgagcatgagactcgtgtcagacgtacaacttagaggctgcaaagagcttcgtgccatatgttcttgcctctgtgttctgactgtcacctgccaggtgggacattttgtcactggtggcaccatactgatgctccaaagtttttgactttggagcatttcaggtgtttggattcgagatgctaaacgtaatcacttcttttcatgtgcaagggaaaccgagaagtcacatgaatttctgaagaacaagcaggtaagaagaggacgaggttttactgagcacttgggaggatgttctctgagtctcacctactggggaccctgggaatcttggttgcaattgtgaggtagaactcacagctttcaggaactcctggatcacaactccccccaaaggcctcgaactcaggcattgtgaaggctgagactacttctgagactcaagaagggagtcgaagggcttcctttgtgttactgcaatgctgtgtcaccttgggtatcctcgatgccagtgaccaagatttcttggtctttgtggtttggccttcaggcatggtggccatgcttcctagcagggacagtttggggctgcatcctataggggaccccatgtgtaggggagccaggacccttatcaggtcttgtgatttcgttgg

SEQ ID NO: 34762 - DNA, 1225 bp, Mus musculus
tacagagatatttacatgcttgtgtttactgaatgcttggtcactcaaagtgaccaagatattgattattagtggatgaatggcgtcaaaagaatgccacatatacatgtgatgggataccattcagccgtaacgacaaacatcctgaatatctggtgacatgggtgaatcagagggcactatgctaagtaaaatatgccaagaaaaacaattgctttctggtgtgcagtctgaaatagccagctcccaaggcagagccagagaggagagtggaaggatgggtggtctggatgggggaggaataagggtgttagtctaagagtacaaagtttgagctactcattgttctatcaagctcctatgtttcctggtgcctgtggcttatgctgctggtatcaggcagggttctctagaggaacaaaccccaaagaatgtaatattattagcacattgaagaggcagagagaacagtagttacatagtctacaagctgaatgcttcaggaatctcggacatggagctcacagaagtcacttgctttgagtctaattggaaggatgaagatgctgagcctagatggcagcagaggatgacagcagccgtagtagatgcacttgctccggaaggaggaaaggcaggcaggcaaactgcctttgttcctgagacattttggaaggtactatgcacactgggggcaggtcttccctacttgagttaaacaccttgaaatgccctcgtagatatggccagaggtgtgtctcttagctgattctaaatcccatcggctctatgatcaggaccaacgacccttagaaatgtaaagaaagtagatcttatgttgtgcttttgtcccataaacaatgacgaggggaggcaacagatgtgaccatagacaggtgatggtttaaacaataagtgtgaatcataaaacttaccatttcttcggctgtatgaactaaataaacccatcctttagagacatggtcttatgatgtgtcgcccagaactgtaagtttgcaattctcatatctcagcttttgagttctaggataacaggcagaaaccaaatatgtgcagctttttatatgacaatcaaaccttggtaacatggttagaaatactcattttgaacttgaggattgcagctcagctgtaaatgggggatctatccttccagttcccttcccatttgggaatagttctgtgggcttggagcaggctaagt

SEQ ID NO: 34763 - DNA, 1161 bp, Mus musculus
cccaaacaacttctaatgacctctagaaagaacaagcccttttttagaaagtattttgtttcattgtcttttggggagtgaagaagagaaaagtccttgttgccagaattttagaagctaaaagactttatgctgcctctactgcaggggctcgttttcccgtcgctcctgggcactggcgctggcctgctgcctgcagctggtaccctgcccaagctgtcttctctgcagccgcctgcttgagcttgctctgtgcctgcttccctccacgctccgaaaaccatgatctacaaaaacagacttctgcaaggtctcgctcgcctgcccacccgccccctaacgttgtgttggttttggtttttgtttttgtttttgacagttcacccccatttagtgtgagctgtaaaactgtactttatttaaaggcgtgctcttgttcccgtctggctgccttccccatgggtgctgagggtttgggtaatacactgatcaggaaaaggtggtcttctcagaaaccagtccctccctcccagccattgccaggtgccacccgctaagcagacatactacagcaggggaccgtagcgtgcacactgttggtggtttttaatgagcctctctttccccactaggctgtctcactttacttgttcaccatacaatcatttactctttaacaaaaattgcttttaagagaaatctggaactatctttaaaaaaaaaaccttattaataatcatgtatttttactgatcacattttgaaatgcctaaaagacttttattgctctaattatccagatgcacctttgtaaaaagctcttttatgaattagctgataaggctgtatgtttctggaacaaaatattgggtcatctaaaactttctgttttctggggtctgggaaaatagaaaataagaattcaaatattaaataagcttaaaagaactgagtatgtgactttttctttgtatgtattcctgtttgtcttctgtaagttgtgttttgacatggggttctcaccttaggctggccttgtgctcctccgtgagtgctgaggtcttaggtgaccccaccacagccggccaccaagttcttaagtggacaaggagtcagtagcctccctagcagtgactctcctggccttcctgctgcttccgg

SEQ ID NO: 34764 - DNA, 1424 bp, Mus musculus
gaagaccagagagcagcaatgcaccatactcttgatttcatggggagaaagggggatggacccccaggccaggaggtgtaactcctagctgcacctgtttccatatgaccaagagtaatcatccgggaatgagagagtctataaagaacactcattgctgctgcaggtgagccagacatggccaggtgacaccagccatgtctctgatttcagtcaactcttttcatttgtttcctgaatagcaaacacttccttgaaactcttctcaaacttggactccagtctaagtcccatttcgccaaacttagggtccttgaacgtgattttgtgattccggaagatgagcctcatgtcttgcacaaagtcttctacttggcagtaagcctggtcactcagctttttcttgattatgttcaaccacataggctcttgcacacccacagtcatctctctaaaataataataatatggcatcttggaaaaaaaggagctctcagaacagcaatagactctcaagagaacatactcgcacttcaactgttcctggggagccatctccctctgcagtatctcagattctggaagactcggttgacttcctaaggactgcatcctacagaagatgcaactccatggtgttatctcagcttccactgttgggatatgacagtcctcatggaaggctctggaacaagtatcacagcagaagagtattcctccatcccggcacacctcacattcatctgagttctgaatactagggtcagctggggaacgatgcaagttctgtgttctctgctcttttcttttgcgatgtatccgtggaggattgggtagaaattttctctggatcaggagtttgaggggccaattatggcagcgcaggctcagtttccagttctttgactttccatagcctcccatcatttcaaattccgagggtgtgaaccagtttccattctgacactgtatggacttcacagatatcccttgtttgaatttatccttgtgtaacactcccttcaagttaccacacgtcacgggaagcaactcagcactaaaatcggcattttcttttctgcgtcttcttagacccctgatcttagcagtgcgtcctgggttctttttcattttctttctcttgaaagctgcctggacaacagctattctgccacgttttctctgtacactcattggctttctccattttggttttgaccagttgtggcctttcttttttcttctctgcttcttgggttttcttgcaggaatgttcctcctggtgcccacacattctccttggctgcttcccatccttgcttccaggtcttctggcacatatgttggggaacacatgacacaggaacacttcttttcacgtgtgggttgctgtgctcctgggccaaaattgtgggtgtacatag

SEQ ID NO: 34765 - DNA, 1205 bp, Mus musculus
cttgcgagtgagtgtcgtgttcttgtcgggaagatatgagcagttcttcacttgaatgccgtgaagtttgggcatcttctggagctcaaggattgtttcttttctttttccttttttcatagaggagacaatgatgaagaagaaccagccaagttaaaagtggagcaccatgatctttcagtcgctggtctgcaaagtccaggtaagccgcatagacaagtgtgtcggatgtaagatgttacctattacaacgaaccatgcgtgtcagcagatgctacctctgagccttccgtgtgccagcgcagcactgctctgtgctgtgttttccccagtgcatgatctctgtagcttatgtgacttatctctgcccccaacataagtgttctatgttgaaaaggaaacgtctgtttaggtgtaacctaccttttctgctccactgaacagacagagttttgggattagaatctcccttaatttcgtcaaagcctcagtctcattcactgaatacccctggcaaatcagcggcagaacatctctttgtgaccgcaacacagtttgcaaaggaacagcatgcaaatggggcactcaaggaaggtgatggcgggtatccagtcacaatcccaggtccacacttgcctgtgtcagaggagcggtgggcattggacgcactgagaaattgtaagtttttttcataacttgtggagatactaagtcccagagtcgtatgatgtgttggaaagcctttaagggaaaaagcaatgccttgtggaaaatacacaaaagtctaaccaatgattttttttccaagaaatttatggtctagttgggaagataataggaccccactgccacttttaaaagcaaacattctaggaataataaggctctgtgtgtgtgtgtgtgtgtgtgtgtgtgtgagagagagagagagagagagagagagagagagagagagagacagacagacagacagacagacagacagagacagacagacagacagagacagacagatccgagttggcgtggttagagaaaagaagcagcagatagaaggaaaagaagatttgcttgttatttgagaatttattaagatcaaaataaatgtgtagaatagaaccattcagacaaaaatatcagtaggagcaggagagcatgcaggagccacagcatctccaggaacagtgagcagagcaggggcctgt

SEQ ID NO: 34766 - DNA, 1173 bp, Mus musculus
ccatgtagcctttgtttttaagaaagtatctcatgttgtgcatctggccttcaacttggtagttctttttttccttaacatcctaaatgctgggattgtaggattctgtcattgcacctggctttatgggtaaacatttagttttatttttagagtttaaaagctttgttgaagtataattaatgtgtaataagcttgaaatgtttgtgtgtaggggtgtgtgtgaacatgtttgcatgtgtatacatatggctctgaatgcagagaccaacttttgtgtgcctttccttggaagcattccaccttgtgttttaagatagggcctcttagtaggcagacccagggcttgtcaatcaggccaggctggctggctatcaagccctacagatctacctttctttttcttcccagtactgggggcgttccacgcacagtctgccatgcctagctttttatatggatttggggaccaaacttaggtacacatttttctcttttcttttctttcctttccttttcttttcttttctttcttaagatttatttattattatatgtaagtacactgtagctgtcttagacacaccagaatagggcgtcagatctcattttgggtggttgctgggatttgaactcaggacctctggaagagcaatcagtgctcttacctgctaagccatctctccagcccaggtccaaattttcatgtggcaagcacttacctgtctgtgctctctccagccctaagctgtatatattaagttgtacaccttggtagactttgacacctgcatgtgcctggaaaactatcattgcagtcaagaaaataaatacagctgataggttagctctggctgataatcctagcactcaggaggctgaggaaggaagaccatgagttagaggccagcctagggtatgcaatgaaaccctgtctctacctgaatataaacagtcattttcttgtgcttttcttgccatccttccctccatgcccctcacctgtttcatgccacagtgggttactttgtgtgtgtttcattgaaatggtctcaaacagtttgtgatgtcttgtttggcgattttattctctatgtaattcttctgggttttgtctgtgttgtgcctcaatggttcatttctttttcttgctgagcaatatatggatatata

SEQ ID NO: 34767 - DNA, 1134 bp, Mus musculus
ggactaaaggtgtgcgccactgcccagcagagccatgtggtttgctttcaagctggaacaagacagctaagctagaagaagcagacatggcactggggcccctagctgaaagactgggaccacagagagttgtcagttagaaagatttcctttgctgataggaaggaaaataagaccaggcatcaggagacacaggctgtggttccccaccccccaacccccgccccatggcctttctgtgtagctctggctctcctggaactcactttatagacccttggcttcgaactcagagatcttcctgcctctgcctcaaagggctttggatgcccttgtactaacagatccaggaatgaacactcagcaagtgtggagaaggtaagagaccacagcactgacagaacttggtgtgtctggagttagtgcacaagtgttcagctcctatgacgtgttagccacaagcaaaaaacaaattccttttggcttgggcaagtttaaaagcacttgcaagccagatgggagattcctggctgccagcctggccaccaacctgcttaatttgacagggcatcctctggattaagaccctcccgtggctacctggcatgagtctgatttcaggcttgaccttaccgcaagctcaggcagggttagaaccaattatttattaggccgtttcctaatacccagctgttgctctctttcacagttttccctgtgctgacctctactttaaatccagtatcttgaaggatggtctgtgcctgacagacacctccagtcagcccctgttgcgccccttaccacagaagcctttcaggtccctcccagcccaggctaacgtagatgtcctgaatctgaaaacccccacaatgccgtgctgcggtgagtgattctatagaacttctgtttctgtgtctcccccccccccccatccccactagaccccgctcctgtggggcaaggaccaactatgagaccacacaatgcattcccaagtcaggcggtagtgtggtagacagtttgtcctgagttacacgggtgaagcataaaaggatacagagagcattccttttgagtggagtgacttctttagcaggctgagcccgtgggcccaagagtgggaaactgtcc

SEQ ID NO: 34768 - DNA, 3335 bp, Mus musculus
cttgtgtggggaataatggagctgagggttctgctggggtcctgggcagtgtgttttcctggtgagggtggttttatgttttctttttttttttctttctggccccccaaatggagttggcgtagctctcatatacccctctctgttaacgcccagtccgttctgtacacagtgggtgaccccaggtggattctacccacagttcctatatgcctctgccaacatatgcacacatatccatgcacacatccctgggcctatgccaacctctcacgccctgcccaggctgaacactgcccgaggcccaaccctctgctccacctcttacccgttcccagctcaggaagggatcagcccacagaagcattcagagtcagctaggatgaacctcccgcacccacccacccacccccaaagccactctacaatttcagtgtagctccaacctttcctgacaatgtacatgtttctcggatttctccttatctgtcaagtgctagcaacacttgactcttctggaaagtcagggctgggatcccaggaaggaatgcgaggcacagaattattgagacggagaaggctgctttgtggaaactgcaaacacaattgaagggggactgctagcgtctcatatgggaaggctggcctagatgtgtctcgggtctcaaagaaagtgcaggggcaccggggacctgctgcgtatccacagactgacccctgctcactctctcctggtgccagactggcaagatggccgtgtagaagggcctttgcatgcagtctccctctttgaatgggattctggctttgtcagccgttcggggctgggccttcccttgagtgcatggaaaaaggtctccccaccccacctcaccccagccctctgtccccaagctcaaagtgcctcggtttctccatctgtgcccccagattaccctcattctaaatgggcattcccagggcctgcctgtcaggatctcagccaactcagccctaagtgacactcgctgagggatcacaaacattggggagagggaggcagaccattctgtgccctacgggcactgacccaccctgccataggcttcctaagggagccccagcccacaccccactcctccctggtgctgctattgagttcccagtccaagcgccatctctggcaccccttactcagcccaccagctggggctcttctgccaggccctcactgccctagtcccagcccaggccgcccagtagccacgtagcagaagtctgaagccatgccagccctggggcggctctccgtcttggcattggggacactggatggggtgaagtttggggaagaaaattctggggcctttctagccacagggagaaggaagatggaggagctgggctgcttctcccagaagtattagtgtcctttccatgtcacagctcatcctgttcctcataccactctgcccctctccttggtccccctcccccacccccaaggcaggaggcagaaccctgactgccccagagtggtatttctgtccctatggggccataagactgaaagactcaccctcccgagtctctcgcacctttcacggtcatcccctatcccctgtcttgtgatggatcgaggaggccctgggcctggacaaagcacctaagctccctgtacaaacctgcacgcctttccccgaagcaaagcacaatttatagggtccatgcagcaggatctaggatccccagccgtggcactgagcgcttccaggcggccgccacctgggctaagaaaggacaggagtcaggggtcggtagctggacccaaggagaaggggcttttcttgccctgtgtttgcgggacagtggacacagccagctgacagtgtgacagagcggagggcattttgcttcaccttcatgccccccccccccagcacagctgagcttctgccagactgcggagagtaaacttggtgtgttacctgcccagacccctccggatgtcgtccctagctgccctccccctcctgtccctcccctgcccctggacccctgtttccctacagattttggtattgttctggtgtgcaacaaccctctgagtctcttttaccagaaggacctgaaatacagcaacacacaattagtgaacacacgcccagcacaccaacacacgccttccacagaccaagcacaggtgtgtgtgtgtgtgtgtgcacaagtacacacataaacgagaaacctgtattaattaatgctcgggccccaagccctgggaaggcgcaccctctgccagccaccccagcgtgccccagtcactggtgcaataaccttcctgccatcgtccaggtgggagaatcaggactcacgtcaggtgggtgaggccacccctctgagcccagcagacactgcatcctttcctgggaggaggggggtgctcccaggcctctggaggagtccaggtagagacttccccaagcctaactgccaactgaaaccctctcctggtgagggcaggtggctccagctgacctgggccggagacaccgagaggtgaggaaccagcctcgctgatgctgctttctgaccccagctgtgaagagtgggctggggggaagagggtgactttttttttttttaacaaatggaaacaaaatccaggagaagctgccaccctcgcctgagtgtgactaagcttcctttgcttcagtttctatgtcactgttttcctctttggtcctggggacagcccagcagattcccctggtcctgacctggagggggggagtggttgccccgcccccttttacttgtattaaaaaaaaaagatgggttgaaaatgtactgagaaaaaaaatgtacttttttataaataaagtgtttaaaacaagcccaagtgcctcttgtcactgcagtggggtgtgagcaagagaaggagacagacaaccggacagcagggacgacaaaggccagagtatctgattctatgatagggactcattgaggggccacatggccaccttgcgggcttcaatggagctatcccaggagacatgagctgcgcagggcacagggggatggatggctggcatctgctggccagggccaaggcatgggggtgtggggcaagaactggatgacaaaactgcacagctgaggaaggaagggctgctccggctagagtcacaggcagcccctgctccagagctcttatgtcagtcaccacccctccctaggtcgctctcctctcgctcacttccttagaattctgttcctccctgccaggtcccctgtggctctgaggagccccgcagtggagcacctgctgtgttccatccctggagacagaa

SEQ ID NO: 34769 - DNA, 1055 bp, Mus musculus
ccaccactcaggaaatggtggcagcttcgtgagtttgaggccaacccaagaaacatagtgaaaccctgtcagtaaataagtaagcaagtatttgagtatctactatatgctagggctgacctggacattaggggtcatcttctgaacaaactagtgcttgagggaggtatttggggtttttgtttgtttaatggatctgaatgagttccagagactggctacacagcgatatgactgagcttaacacccctaaagcatacagtcagaccaattagacaataaaaggtatgtatagcttaccaaataaaaaaattgtattttcaagagagtgtctgtctgtgtagccctggctgttcttgaactcactctgtagaccaggctggcctggaaatccatctgcctgcctctgcctctctgcctctctgcctctctgcctctctctctgcctctctctgcctctctctgcccctctctgcccctctctgcccctctctgcccctctctgccgccctctgccttctgccctctgccctctggcctctggcctctgccctctgccctctggcctctggcctctgcctctgcctcttgagtgctggaatcaaaggtgtgagctctgtaggtcttaagttccagaagaaagtaatgaagtcacccagcagggaggtgctcagggacagcacagacacacacccaggacataggctcccacttccttggctttctctgagtggcaaaggaccttaggcagtgtcactccctaagagaaggggataaagagaggggctgaggtattcatcatgtgctccgtggatctcaagccctcaaggtaaatggggacccacctgtcctaccagctggctgacctgtagctttccccaccacagaatccaagtcggaactcttggcaccatgaacccagccatcagcgtcgctctcctgctctcaggtactgggcaagggtcagggctggcattctaaggaatctggcttcctcccatcccgggaagtagcctctttgccatagtctcaggggcacaggtggttgggaggtg

SEQ ID NO: 34770 - DNA, 1944 bp, Mus musculus
tgtccaggttagccaggctggggtagccaataaaaaaaaaaaaaaaaaaaaaaaaaaaaacaggcacctccattacccttcccctaactgctggtctcctgggaaactgctgctgtctatgtgagtggggcaagattaggggccagaaagggggagcttgtagtaaaagcacagttgaggaaactaaatgggaaaggcagtacagtggtgattcttgtggtgtggaggttctgttacagcatccggtggagccgctaagatgagaaagcgccagctagctgccttgaacagctgacacctgtctttgcccgcctgagtcctgatctcccctcctcccggcaccccttctctatccacagacaagctggtcaagtgtggcggcataagcctgctggttcagaacacatcctggatgctgctgctgctgctttccctctccctcctccaagccctggacttcatttctctgtgactggttgggcccaaggagaaacaggagccctcgaggtccttcctctgcagaggtcttgcttctcccggtcagctgactccctccccaagtccttcaaatatctcagaacatggggagaaacggggaccttgtccctcctaaggaaccccagtgctgcatgccatcatcccccccaccctcgcccccacccccgccacttctccctccatgcataccactagctgtcattttgtactctgtatttattccagggctgcttctgattatttagtttgttctttccctggagacctgttagaacataagggcgtatggtgggtaggggaggcaggatatcagtccctggggcgagttcctccctgccaaccaagccagatgcctgaaagagatatggatgagggaagttggactgtgcctgtacctggtacagtcatactctgttgaaagaatcatcggggaggggggggggggctcaagatgggagagctctgctgagcctttgtggaccatccaatgaggatgagggcttagattctaccaggtcattctcagccaccacacacaagcgctctgccatcactgaagaagccccctagggctcttgggccagggcacactcagtaaagatgcaggttcagtcagggaatgatggggaaaggggtaggaggtgggggagggatcaccccctcctctaaaacacgagcctgctgtctccaaaggcctctgcctgtagtgagggtggcagaagaagacaaggagccagaactctgactccaggatctaagtccgtgcaggaaggggatcctagaaccatccggttggacccagcttaccaagggagagcctttattcttctttcccttgcccctctgtgccagcccctcttgctgtccctgatcccccagacagcgagagtcttgcaacctgcctcttccaagacctcctaatctcaggggcaggcggtggagtgagatccggcgtgcacactttttggaagatagctttcccaaggatcctctcccccactggcagctctgcctgtcccatcaccatgtataataccaccactgctacagcatctcaccgaggaaagaaaactgcacaataaaaccaagcctctggagtgtgtcctggtgtctgtctcttctgtgtcctggcgtctgtctcttctgtgttcttccaaggtcagaaacaaaaaccacacacttcaacctggatggctcggctgagcacttctgtgtgcagaaggtccaaccagactctggggtaccccggccctccctattcccttgcctcctgtctcccgctttttatagctccctatgctgggcttctctggagagtgaaatctttgcccaaatcaatgcgcattctctctgctgagtcatctggcgacagcagttgagttcacccgccaacacatgggcccagctatgtagccgaaccctggctctggaagtgccagggacttt

SEQ ID NO: 34771 - DNA, 1147 bp, Mus musculus
tctttcagcccatgaggctcccagtacccactgagtaccaccctgaaggatgtcccagctctcctccaccctgaagcgctatacagaatcgtcccgctacacagatgccccctatgccaaaccgggctatggcacctacaccccttcttcctatggggccaacctggccgcctccttcctggagaaggaaaaacttggtttcaagccggtctcccccaccagcttcctcccacggccccgcacctacggcccctcctccattctggactgtgacaggggccgccccctgctgagatctgacatcattgggagtagtaagcggtcagagagccagacccgtggcaatgaaaggccctcgggcagtggactcaacggaggcagtggattttcttatggagtttccagcaactccctcagctacctgcccatgaatgccagagaccagggggtgaccctgagccagaagaaatcgaacagccaatcagacctggcccgggatttctccagcctccggacttcagatggctaccggacttcagatggctaccggacctcagagggctttaggatagaccctggaaacctgggtcgcagccccatgctggcccgcacgcgtaaggagctctgtgccctgcagggcctctaccaagcagccagccgttctgagtacctaacagactatctggagaactatggtcgaaagggcagtgcaccacaggtgctcacgcaagcccctcctccctcccgagtccctgaagtcctcagtcccacctaccgaccaagtggccgttacacactgtgggagaagagcaagggccaggcctctgggcccagccgctccagttctccagggcgagacaccatggtgagtttactcttggggatccagtgagggactggggagacagccccgtgttacaaagagccaggctaggaacagaactcccaacctgactgacgattggtggcggacaagcagcagagatcatcttccacgatgatcaaagcatgacttggtggctccatggctcagagccatggggaaggggctggcccgtgcttcagagacctacacacgtgggaatgatccaaaggtgctctaggaggttcagccccccctgtctgctgttcttctcattctctgatc

SEQ ID NO: 34772 - DNA, 1227 bp, Mus musculus
tgcaatacactccagactcccagcagctgctgttatctgtcatcttcctcacagccagctacttactgctcttcctgaagtctgctgtcccctttcccttcatttctcctggggacacctggccctaccccagcccagggccggagagagttgttttcagaaaggatctcaacgaggtagcaaataccctgagcaaactcagtcgccagaacctgcatccctctggcctagaagcaaggcacagaactgttaggtggtcaggagtgccctaaagccaagctagcatttcatcctgagctctgctcagtacagtaccaccaaccaggagagacctctacggtctcactgccccgagaccatcacttcaccttggccctcttatgctcgcttccaggggttgattgtatcctaaggaagtgagagcaactttttgggtgccttgaaatctgccccatcacaagcttctccataagttctgttctcccaggatggcttctttaaaaaaaaaagtgtggcttcttctcacagtgctgttttctagctctgaactctgtaccatgcacacctctggggaactgagaactctgtgccattcacctggctttctcgggcagtttccttaactcctaagtctgtttgctcttctgtaaaatgaaagcactcatagtttctacttcataaattactgtgaaagagcctgacacatagtagggactcagtaaaggtcggtcatctttgctcctggctttaggagacgagagaggtgcaggccagcctctgccttgagttcacttcaggaaatccatgcctacttggttacaccaggaggcaggcctgggtgtgtgtgtcttccgaggtagggaagggagaggtcacctgaggccgagacagactgcccgtgacctctgagaggcacagtcttaccttttaaccttggatacctatcagctcggacggatttcctcctctataaagtgaacgatggcacctgccctgccctcctcacaggactgccacaaggctcaaaccaagtaatgaaggtggaggcatctccagccaataagacagtaacggccaacctgagcttggagcttcacaggctccattgagcatgtgtaatggaggcaccaccggcatgaagtcggtgaaggtgcaactcggccctggggctctgagggtcaaccccctgaggccccactttccctgaaaatgcagggcgatgagcca

SEQ ID NO: 34773 - DNA, 1099 bp, Mus musculus
atctaaagttactctgctttgaagttgctttttcttttcccctttaatattttgaatggaatctagttgcctccaagaattgtgccttatagcatttggggaccaggggataacttccccttcctgagatatctccctcagctgcttccctttatccccgtgccatgttgaaagccacttggggttgcggggtcctgccctgaacccctggcttgttgtgcacagcagtaaaagagggaagtgggtaaatggtgattcttaagatagtgtatcaagctcttcctaccaccctctcacccaccccggtctccccagctgtttgaaggacagcacaggctccttgcccctcaactcccccctccctttaatttattctctttttgatgcccttatcccccaagcttcctgccacctgtccctttcccagagtctcttagacaaaggccctctggactgagcttctcagggacacccacaccaccccttaccccatcttggcatcagtctttggtcctgtcctgggagtgtgagcctggatggctggggttagcttgtatgattctttgccctgacgttagacaaaaaaaaaaaaaaaaatactccatgctgtcccaagagccaagctattcagcactaaggcatttcgcacagtgcattttgcaccccccacaggtgggcctggcttatgccctcagaacctcgagtgcttgagtgtcccaggacagggcacccaagaaaagacaccctgagtttacctggcctgatacccttctctagggaagacctgtgaacatgagcccaagggctggtgtacacttgtttactatgtaagcaagagtagaatgtctagtgtacagtggagccttgtacagaataaatagtagctttgagaaggaagctggtgtgacggtcttgatttgggaggggcttgtatccgggatgctcccagcaaagtgaggaccacacagttcactgcttttgccataagtgctgcatcctagcttacccacttgttaaacttctcaattattttttgttccttaaatagtacatatttcagatgccatatgccacatctggattcgcaggttgcgtttgt

SEQ ID NO: 34774 - DNA, 1320 bp, Mus musculus
tgccgccgcagcatcctgcaaaccctcaatgtctacctctgaggactccctccctgcctgctcatcctctgcgctccacacaccgggacagcatcaacactttgcctctgggttctggcctgagtcttctttgcccccgaaggcggcgactctgccaagcctcaagccatatatccaggacgtgtagcttggaatactctggaagactccagtctgggtgggacagagtaacactttctctaaatcctgtgtggggccctgagatgctgagggtggtgagtatgtcactatgcaagggccctgagactctgtggtgggctcttgtgctgcgcctgccagggcccacccagatgcctgcctctagggctgtccttctctgcttctggctcttttgttggagtttttggtcctttcccccaggccacgccacgccacgccacatcagtgttgtttgaggattttggaaactcatgggccttagagtgatcttgattctttttctcttttttgttttttcttggtttggatcttgaacctttatgttcagccagagcctctgccctggtaggtctgggagtagaaacttgcagatgcccttctgcctgtcactgtcttttaaagactcccaacttgaccaggacctggagtcaggagtttatccctgagtacaggggtgcagctacacctggctttgggaccattcaccttcaggcaccccagctccatggggagcctcggaaggaacaaccagatgtctactcattccctacatggcatagaacatagcattcctcctgggctctctccggcagtggagagggcatcccgcacttttcacttgggtccaaacgaggggctgggcctcaggggtcatagctccatttagtcggtcggactgcccagtttctatgaataaagttctcttgacagctctaagtgtggtccttgggagtggtcctccagcagccggtcagctggtgttgtctccaggtcttttgagagtagttagaataagaagcgagcaactggatggcgagcttcaggggtggggatgaggcgattgtgcgactggcggtgccaagaggaaagcccacagcaagcatggctgcttagtgcctgcccttctgacctgccttgcagtcagtggttctgagtcgccttctctgtactgcgttataaactcttatgagcagaatgtgaacttgtccctgttcttcctgtgttcctactgtgctaacctttccccgtggacagagcagaatctgctgcctggaggccagtcggccctcccattcctggaggggctggtacttgtctgtg

SEQ ID NO: 34775 - DNA, 1255 bp, Mus musculus
ttcctgctgcttgctttaaggatgttgcagcccatcagcttttgcttcggccttttctgtctggtggtcacgctgtaaaccttgctggctctccatgttctggtgacttctctgtatccattttcagggagagaaatacatcgatctgaggcattagatggctcccattgcactgctcgcagctccctgctcagacttcaccccaagctgaagcctccagagggacagcagggacgagccacactcaaccccccccctgcacatcaggtctgagagctaggagctgggacaggagtcgtctgcaggagctcagttggctacagaggcctggttttagagaccaagccctcctctgtgtccagtaaataatgcttatcccaaggggcccgtctcccagggcatttccccctcccgtgcacagccattggtggcaaatccttctgccatcagctgtgtgggcttgcctctttgagctcatctcccctcacaggctgtcttcatgatgcaggacctgggcacatggtcacattattccgttcacattggtccttgtgagaacctcacagtctggaggcggctgcttttgtaccttcctgcctgctactaattcagggtctcatttggaacatttttcctttgggtagtggtcaggaactggtgtaagtcctccagacacatccctgtgtaaggaagccaggcactgtttctctgagttttgttgttttgttttctttgaaggctactgagcccaagcttcccgcattcccttagtaacaagagacaggacagagagaaggtctactgttcatggggattaggcttataggaatgttagtaccaaatttctacatgtgagctttgggggccaggtcctagagagcccaagtgggagaatggtatttaggagatgaaaaacctggcctagcaagagcttttgaggtgtgtgtgtgtgtgtgtgtatacatatatgtgtgtatatatatatatatatatatggttttgtctgtaaatttgcaaatttttccttttatatgtgtgttagaaaaataaagtgttattgttccaaaagcatgatgctgtgttccattcattatgaagggacagacctggggcttccaaaactataggtgttttcagagagggacaggctcccagaagtctgcccttacctctagagtatccatagctggcagcatgctactaaatgctagctagcgtctctgccccctcctgtgtgccctattcacctgcatca

SEQ ID NO: 34776 - DNA, 9761 bp, Mus musculus
tctagtatccagggctgttcttatacctatgactgcctggtagggcagcagccagaatagctgtcactttggaaattgaagacaactttcaaaacagctgagggaaaagatctaccatcttgttgcccctctaggtagcatctccacccagtccagcttcctgcttcctctttacagtttaagctgttgtcttgttatttgtagaagtagtgagtgtttgaacctattgctaagtataacacccagtgtaggtgttatatgcttttcacagtcacagttgttgttaacagcatgggtgcatggcatatttagaaggtcctttactctgtaataggagtctaaatctaaaacccagaggccaacagcagaatacttaacctatcatgtgtatagccctgggtttagttctagcacctcaggttgataaaacccagacttatgccaggcatggtgtttcatagttgtaatctctgcacttgggagaatgaagcaggagctcagctgtgagtttgagttccatctgggttttagagtgaacccttgtttcaaaatgaacaaaaaacagagccccagtcttgagacagaaaagcacactattagcactattagtaactactgttactgctgttaaatgtgagcttcccaagatttgcacatgttttctttcctttctcttttagacttcaatgagggttcccaagttcctgagcggccccccaaaccattccctcggagaatcaactcagaacgaaaagccagtagctatcaacaaggcggaggtgccactgctaaccctgtggccacagcaccctcaccgcagctctcaagtgagattgaacgcctcatgagtcagggctattcctaccaggacattcagaaagctttggtcattgcccacaacaacattgagatggctaaaaacatcctccgggaatttgtttctatttcttctcctgctcacgtagccacctagcacatctctccctgccacggcttcagaggacccatgagccaggctcttactcaaggaccacctaggaaagcagtggcttcttttgggacgtcacagtaaggtcctgcctttcctgtggggatcgacacatatggttccaagatttcaaagcagtggaatgaaaatggagcagctgatgtgtttcattgttgtattggtcttaagagtgtttttgtagtcctgcagtctccagtaggagagagtgggtttttattaaatggtaacctaccccagaaacagcacaggaagcagtagcagtgctgtgctgtggccctaattaaggacttaaggctttcctgttaagggtgtgtgtctctgttgtctgtgtgtcctgtcattataagattatcctgctgtgtgtgaatccaggcagggagttagcacaagagcttcaggaaggaatctctgaagactcccatctactgtggaattgcacctagccctgctggatactgtaacctcaatcctcccctttggcttagattatcatgtacttagctatgttttatattgttagaacaaccaatgtcctttcccttggaaactccttacttcacctcctcctcattggtgttctgtaggcttgccgtgaccagtcttactgaaaccaagcagcttataggatggtctttctaatgcgtgatggtgttggtttgtttggtagactaagtgggaaggaaagtactgttctgtggctaattgatgctagcacctaacactggtcactccaaagtgctgtttctataggaatgttgaatttgtttttgtttttgttttttaaagaagttttaattctcctagttacctaatgaccgatttgagatagaggccttcatatacattccgtgtcctccccaggacatagcctgtgggagtcggttgccttgatgccaggtgtatgtttctgatgtaggtcatgagtgtttctgcctaacaggaacagaacatttgtttccagggtggctttccaacccaaaaccatagagcttttaggaagcgtcagtcatatatagatttacaaaataaacagctaggacttatctgtttagtctttcttgccagtggctaacttcagcttaggaatttctcccttgaatgggagccaggtaagcctttcagaaatgatttcttcttttgccctgtgaggaacggagctaacaccagtgaggacagcatttgctgatggcttctctagattggtgcacccagtgacttggttgtccatgtgcctagcttgtgctttggaatggtttctctttccttttccttgccttttttattgggtcctagatgtaaccgctgtgtcatccatctacagtatttagttatcattcattggaattctttagctagacggtttggaacagtgtaatagtttgtgtatttacaggttcatcaaggagatgtaatttgttttggagagtccgtttctacgtcatcgtagtgacctcttgggttcagtttgttctctgactggagtcttgctggcttctctgacagcgttgccctttctcctgttgagtacgagctggcttttacatgaatcctctctgttctttaggtccaggcagaaatgacccaccaagaatctgctttctttccagtcttttgcaacaaaaatcttttgaactcttcttttagtttcttgatgcttcaaggtctggattttatcctcttaccttaaggctattcgaaaggcagatacggtatctatggctacccagtgtcttctctacatagcaatgagtagaaaacaatagcttgtcatccacaaaaagtttgtgatatccaattttgtgttcatttgaatactgaaagcctaagccaggcttggtggcatctcagcacctgagagatggtggcaagatgatcaggagttcagcaccagctcaaagctcctgaaaccctgtctcaaaaataacaggggttaaagagatgacttcagttcagagcagctcttcttgcagaggacctaggtttggttcctagcacccacatgaaaggtttctcagatgtataagcaactcacaaccatctataacttcagttcagagcaatctgatgccctcttctggcttctgtgggcaccaggcacacatacgatgtacatatatacaggcaggtagagcattaaataaatacatatgaaaaaattaaaaaatgaaaattaaaggccttaaaagaaaagtagggaaaagctgcaggctctagtctgtttatattggagtgtctttttcccttttagctattgcccagaatctgaagatgtatcaaggaaacagcactggctgcaggccttttgccttctttgtgcatctgtcttgtgtggaggctaaggagatagctcaattggttgagtgtttgtctggcattcacagagccatggttcagcccccactctgcacagaagagtgtgctaaggcacacctctgatccttagcactcgagaggtagagactgcattagaaggtcaaggcactcctggtttaaaactagcccgggctacatgaaaccctgcctccaaaagaaaacaaaaaccaaatctgtggggattactgcccataatacttagggaaatgacagttttgtcctgctgtctgctgaggtgtgagctctggaatgggcgtggatagggtaggtgggtattgagtccctaagctgattgacttgggtgttagtttatcagatgtatacctgcaggtgttaaggttcaaggccattgtgtgtaggcctttcctttgctccaggacacactgaggccgtgcctggtattattagatgtccttaggaaggcttcatgccactcattttggatagtctccaaattttgaatttctttttcctgtgagggcaaatttcctatttttcatcttccatctgtatggcaagtcttaactctttggctcgtcctctgagtttacctaaacctgccttttcgtaaacaagctttattttgagtctcactatttttggcaagctcaccccctttctctgttctgtgttacaattaggaaaacctctttaacgtttctccttttctcatcttcactaacctatttttattcaacacaggcccttgctccctctgtgtccttgtggattgctttacacgccaccttattgatgggtcatcttgccaggactccgggcaaggcttttctagtccagtcccagaactggatgttatagctgtccctcccactgtccttctaaagtgaaaagtttggcttttggattttttttaattggatattttctttatttacatttcagtgaaaagtttttaaaatggttttaaaaacttgtgggttctgaaatatacctctttctaatttacaaactagacagcttttgcgaattgaccctggccggccattcttcatattcttcttactcctcccagccccaccctgcatactctgccattttgtctttctctttctattctcagacatgcctatcactgaactacaatgtatgatagttgtgctggcatggggcagctgagatggatggaaggcactattcttcatagttaaaatatttatttcctctgtaggaaagtaagacatgttttatggtccaagtattcaacttacaagttaatttttgcaacacaccttgcttgcagaccaaaccagggaccagcagtgtattccttttatggaaccattaacaagatctagtctttctgtgttagccatgatgctaatactgaatgttttcctacctcacatcatgagaatcagaaggctactggccttctcagaccttccttctttctgttggcctttctgagtctggaatgatcactccattgaatagagtattccagccagtgtcctggctacagatgtttgagtgattactgtgtgtcagaaatgtcagctatgtgctctttcctgccacctcctggtggttttctgttattgggaagttaagcgtgggctgcccttggctcttttttgcatttgactgtgcacgtgtgcattcagggctctcttatgtagacttatcttcccttacagagctggtccacttaaaactggcccgagactttcccattaaccccatttgtcttcctgtggctttgataatatttgggagattctgttgtgtatacctcatagattatccatgtttgctacaaagtttagtgccatttcttgagtggatgcagagtccactgacttgagttgcacactagagcactaaatgtttaagctgagcttgctgcggtctcctttccagtccagtgccttttctatctttttactgagctgcttctgtccccagtcctccttgctgaaaagattttgttttgcctttctaggactgtcaccatctcccatacagtttagagggtttttttccctgctattcaacaatctaagtaattctgtcttagaaggggtgaaagggttggaaagagcgaagacctcattctcaggctgctcttgtagaagccagtcaggaactgagcctggatcctgtccacataagcctgcccagagcagcactagagggaccagagcttcactgtcaatgttctcctctgacacttgaagtgtcaacatgtagcggaagtactctagcactacacagagcgtcttgatgcaactttgatttcagtccacagacacagtcaatcctataggaatgcatggaagacttggttcttgtatgttagtgggctggacaactttagactttgtccctcctcctacttgacagagtatttatatacatgacaaaatatgttccctagtccttgagttcatgtgatcttatgatgaatgcagttctttagaaaaactcaagaattcctggaaaaaaaataggaaaaaagttaaccctgtatattaattccatgggccagcctggacatcctgaggacaactgtgctgggcctgtgtctcctgaagctatctgcaccaacctagaaatcatggaacaagcctgtcttaacggctctgtagaagtagaaataggagaattatgaattttaggccagcactggatctattacaagctgaagaccagactggactctgtgagcatcttgcctgttcgtgggaatattttctcctcttgtttccagcagcagagaaagcagcggcaccacctggtgaatgcgtggaggtgctctcttcaagtgcacatcactgatggactattcgaatggaggtgctctcttcaagtgcacatcactgatggagtggtttcattacctcttccactgtggtttcctttaagtctgatagtttgaaggtgcagtcttttacggcggagcagtcgtgaggcaggaccatgaggtaactactggccacactgtgcctgcagtcaaggaacagtagtgcctgggtgtattcttaagaaagaaaacactcagcaagaatagcgatttgagggtccatcccccactgaacctatagggagaacagagaaattatggtgaactgggaacttagaagagatatgcaaaggaacttccacaatggaagtacagttgctgttctactcttcgcccctatttttaacttagtcagagtcactgtcacctttgctgctaattacttttcttctccctaggagtcttggcacccaagattgctttcctcactcttgaggccactcttctgtccttgggtggcatttcttagcctccattcaacctcgggtctctttgatgttactcagagtgcagaccatggcttccactgtagctagtaccctttggcttggctctcttctggttttagtgctgaatacctgttcattctgtgggctcttgacctgtcttctgcatccccatcctctttgtcttcctgtaaggggagcctacagtgatatccttagctttactttcctaggtacactgggacatttgctagaatagggatattttcagtgtcgaaaatagcttgttcttgtgtgcttcttataaacaggctacctgtatcttctctggttgctttttctctagtcctgtaataagtgtggtggttttggttttttggtttggttggtttggttttctttcattctttctttttttttaaggtgttggggaagtaaaactgcttctgcttgcctggatcattggaatcccatcctagagcctggcccgagttttaaggcgtatcaaacatactaccctgcttttaacttctaaagagtcaagtcatttggtatatacagaagtaacctactaacccaaagatacacattgaggcacataggaagaagggcaagagcaggtcatcaggttttcaattgatgtctcagctcctgagtgaagcagcagagggatagtagtgccatgtgccttcacagtgccccaggaaatctggcttggctgcaagagaaaggaccagtatttcttggttccagtaagtagcacaagagttgagatggagaactaaggacagggagagccctgcacattgttttgtgcctgctgaagagcactatggggaggggccaggggctgaccaacacctgcttgcagatcttgcagcctcttccctgcttgagaaaaatgtggctgaccactcctgtgttgtccagaacccaggctaagtgccagcctcagatctcccactgatctggctgctgaacaagtcagcaagagttctgctcacctggccctgcattcctgattcagtgctacaaccaaatgtgagaggcaaacctattcctgattcagtgctacaaccaaatgtgagaggcaaaccttcacattgccttgagtttcctttcctctgacccagaatggaggccagtgaagaagattgctcagtgcatgctgtgcacagctcatcagactcacactgcctcaccacatacgccctccagtgggggttgtggagcctgtgttgctcttcccgctacctcttacccagtagtggagagggtggccatgttttggatgtatttaagtggcaagtgaattcgggggcccttctctctctctctctctctctctcgggggcccttctctctctctctctctctctctctctctctctctctctctctctctctctctctctccctccctccctccctccctccctccctccctccctccctccctccctccctccggctttctgggctagtgagcctgccttgcagtgcatgagaggagccgcctcctgacctcctcctcctcggcacccttaagtgggaagtctgacctctgctgagacatgctgggcatggcagctgtgaggtacctcccacatctgctttctggctgtgctgacttgggatttttaaccttatatatctttttcctttattcaaaacaaaacaatttttagcacactgaaaaaaaaaaaagccaaatgttttgtgcctttctaaggcagcgctgtaccccaggctgcatcttaggacttaatatggaaataccagagtctgagctcttctgccttgaatatctttagccctggagttttggggacaaggatgtctggctagagaggtggcacattaggtgcctatagtctcctttctctgccatgaggtttccctggaaaagagcattgttttattctggcagcacgtggttggttccaggcagcagttagtgttcagataactgctctgggtgcccactcacccacctccgagagcagtgccctgcggagcagagttgcggagtgaatgctcctgggaagaggagatgcttcatttgttgtctttttgttttgctggaccttgagccagcttcaacctcctgcctctcctcagacttggctgtcctttcatttgaaggcttcaaccataaagcatgaagtggctggtgcccatcacagggtctgcttgaatccagggaggagccgtggaaccctgaggcctgccggtcatactgtcataggtttcaaccacaagcttttgtaccccctcccccttctctctggttctcccctgcctgtggctaacaaagggggagggaggtggaaacagttctttttaagatctgcctcattcaagatttttaaattcttgatttgggtgggacaagagagaacttggtattttccccagaatagagtcccaatttgtatatcagtgttaaaaaaacaaaacacaaacttaggtgagattctcatggactatttttaaaatgtcattaatataaaagatttctattagtagtatttaacctctgtcctgtagagtagacagaggtaaatactcctgcagagcagcggagctttaagactcgttctctccgacccgtgttgtcttgccagtgtactgatatgtagaggtctgttatactaattagaggtctgttatactaatgttatttattaatttttttcatttccatacagttaactaaagagctttttcaagcacccgtgtctgtaaaaaaaaagtatttttaaataaaatttcttttgttgtagcacacttgagttctggttcacttggggttagggggaattacacagggtagctttgggaccgatcgcagtgatgcaggtgaatagggcacacaggagggggcagagacgctagctagcatttagtagcatgctgccagctatggatactctagaggtaagggcagacttctgggagcctgtccctctctgaaaacacctatagttttggaagccccaggtctgtcccttcataatgaatggaacacagcatcatgcttttggaacaataacactttatttttctaacacacatataaaaggaaaaatttgcaaatttacagaca

SEQ ID NO: 34777 - DNA, 1080 bp, Mus musculus
gggtgggacatggtacctgactttcctccttttctagattttttttaacgatttatttatttaatttatattagtactctatataagagtcttaagaagtcatcacatctcactatagatggttgtgagctaccctgtggttgctgggaattgaacttatgagctctaagagccatctcttcagcccccttttctagctctttttctggattccaaggcatgctgagtacacacattacctctgagctatatcctcatcaactgtactttaacctctggaaactgtatcttctagtaggtaagtatgttaagcactttcagaagtatctgtcactgtcatctgcttcttctgcaggaatcagaaggtcagggctgtcctttttgccgatgtgaaatcaaaggtactgagcccatcgtggtggatccgtttgaccccagaggcagtggcagcctattaaggcaaggagcagaaggtgctccttccccaaattacgacgatgatgatgatgaacgagctgatgattctctcttcatgatgaaggagttggcaggtgccaaggtaagggggcactggagatacagcttggtattagagtgatgtcttgttcagcatttctattactgtgataaaacattgacggaaagcacggtgaggagaaaagggtttttatagcttgtagttcatcatctaggggagtcagggcaggaactcaaggcagtacctggaggtaggaacagatgcacaggtcatagaagagtgctgcatacttcttagcctgtgagagagagagagagagagagagagagagagagagagagagagagagagaggagagagagagaggagagagagagaaaagagggagaggagagggagaagagaagaggttatacggacaaggctggcatgtttttattctcctgaatgctaagatgaaagatgtgtcccaccatacatacctggcctcagcctgcttttgtataggtccacctgcctgaggatcacactcacccacccacaaggggctaggaacttccaaatcaaccaaccaacccaccaggtcatccagccaactagta

SEQ ID NO: 34778 - DNA, 1760 bp, Mus musculus
gctaaaaagaaaacgaaaaggagctagatggtggtggtgcacccttttaatcccagcacttaaaagacatccatgtagatctctatgagttcaaggatagcctggtctattgagagagttccaggatagccagggctacacagaaatcctgtcttggggtgagagtaggggatgatgaggactgtttttttttcttttaaattttgctttgagaggcaggcttcagatcttttggttctcttctctaacccgcttcctggctgctgggattacaagtatgtaccaccatactcagctcctgatttcttactgcaaaaactgcctattacagaagtgtagtggtacacacctaataccagcattcaggagagtccagcagatcccttgaattggaggcaagtctggtctatgttccaggacattcagggctatgcagagagagcctgtctcagaaatagatggcctttgtaaagaaaaaacaaaaggctatatcaatttctattgagtctttgctatagcttaggcagattacgtgtagaagttcgggaagactgcaggaagaggcttcctcctaagcagtaacacaaagaaggcagccctagaaggattgcagtgtttgaagggtttggtgcgatggggataccagggaacccaggagttgggaactagtgtggctgcttctcagaagagcactcaaatatgaaatgaatgaataaactgctcaggactggaataaatgaagagcatggtcctttcatgtagtgtagcaggaaggggtaaagaaatcgtttctagaccatgctgggaattgaactcaggtcctctggaggcaaaacggatgagccaaagggtgttacaagacttcaagttctactgagggaaggtagataaagaaagagactttggttaagaccagccctatagtatttacctaacaaaggcataagttcagtttccagttgtgacagttaatttgccaacttgacgtaatctagagtcacctgcaaagagagtctcattgagggactgtctagatctcgctgacccattgtgagcatgtctgtgtgggattatcttgattgtgttgaggtaagaagatccacccactgtgggtggcactattttctgggcaggcagatccttagtgtagagacagctgaacactggcaggcatgtgtgtatttgttctctgctcttgactgtgatatgtgtcaagttcctgacaccttgactccccagtagtctgtaactttggaattacgagcataataaccctttgtcccttaaagtgcttttagcaggatatttgtcacagcaacagaaaatgaaactaatacacagtaacatgtgtggactggagaggtgacacagtggttaagagcacttgctgttcttccagaggattcaggttcaggtatgagtacccacaggtagctcaaggccatctataactcccagttccaggagatctgatgccctctgctggcctctgtgagcatgaaacgtgcatgtggtacacagacatacatgcaggcaaaacactcatccacataagtaatcctaaaagacaaaaaggctttggtagagaacttggcattcacttcctatcaaaggaactatcatgtaacaggagagaaagacgcggctctaggggccatgaatgtagctcaatggtagaacacttgtttaaatgcttgattaaattattttatgtcagacttgagtgtggtggtgcctttaatcccagtagagctctgact

SEQ ID NO: 34779 - DNA, 1710 bp, Mus musculus
ccactacgccgagcgcgtgggcgcaggcgcgccggtgtacctggcagcggtgctcgagtacctcactgccgagatcctggagctggcgggcaacgcggcccgcgacaacaagaagacgcgcatcatcccgcgccacctgcagctggccatccgcaacgacgaggagctcaacaagctgctgggcggcgtgaccatcgcgcagggcggcgtcctgcccaacatccaggccgtgctgctgcccaagaagagcagcgccaccgtggggcccaaggcgccggcggtcggcaagaaggcctcgcaggcctctcaggagtactgagggggcccgcgccgaggccgcccagccctccccacacctccacaaaggcccttttaagggccaccacctccctcacagaaagagctgagccacttcgggctgcggcggcttgccgcgtccccatcctttctctttccctcctctcccctccccgccctcgcgccactcttccccttaccccgcacggcctccggttctgccacggaggacgcgggcgccgcggcacctgcccatcccggagctcgtgacatcgcttcgccgttctcggttgtggacgacggctccgtgcggagaggctgcggcgccttcccggagtctcggcccctcgctcagacgtccggccgcggtgggcttgaaggttagtccctccgcagctacagccccggcgtctttgcttcagcttggtgcttagccctcgcctggacctttgaaaagtgacttgattgccgggcttagaggaggagaaatggatcacattgtttccttcggtgtcaccgttgctggcctcataccagttgaccctgtcgccattcgtaggccagtgtggtgtggcggggccaaaaatggttgtaatgtgaacccagtttctctaggaatacctcccggcaagggtcagagagacgcttaccggcctgtggacaagagttctatacctgccgcaggcgactggcagccgggcctagccatccatcccctcttccccagcgactcaactacaacccaaacacctagataccagcacaagccggtgaatccctgtctggactgagcctctggcttctgaactggaacttttgcagctattacaagtttagaaccttaagtggggagatttaatgggctaattttattaaaggatcgtttggttttgtttttttaaaaaagtggtttaatgttgaatgctgtagtcccagggctggacatatagctccgtggtagagccatgtgcctggcacatcttgggagagaatgggacttccctttctgcaggccgtgggagtgggaaaggctatgtaatccacgaagatcccgttgactgaagacaggctgtaggaattgaaggctgatttttttttttttttttttttttttttttttttgagaacatgaggcaaatcacagcgtgttttacaacagaaaggtctcagactcaattcaagtttaaaagggctttgggtttattcatatcttccccaactctatcagaagaaccacattctaaactggtttattagtggtattggttacattcaaagattggcatggactttctctaaagagatgaagcccccaactactgagggaaaggcagatatggaggccccaaggtgaggcatatcttccaaagtggaagtctcaacaaccccgtggttcaatttcctgggataatc

SEQ ID NO: 34780 - DNA, 1226 bp, Mus musculus
cgagacagggtttctctgtatagccctggctgtcctggaactcactttgtagaccaggctggccttgaactcagaaatctatctgcctctgcctcccgagtgctgggattaaaggcgtgctctaaccacgcccgactccaaagaagtctttttattttattatttatttatttagttagttagtttttcgagacagggtttctctgtatatccctggctgtcctggaactcactttatagaccagcctagcctccaactcagaaatccggctacctctgcctcccaaattgtgggcttaagggcatgtgtcaccactgcccagcttttttttttttttttttttcatttctaccatttttctagacaggctttttctgtatagcccagcctgtcctggaactctctctgtagaccagatttagccttgaattcatggagatctgtatctgcctccagtgctgggatttaaaggtgtatacaccaccactcaacaaaaacaaaagttttttaaaagttagctagaggggggaaaagagactgtggggcagagggtgcactgggtaggtcttgacttctccttagcaacgctccacagcggggaaacctcaacacccgcctccggaagctggatgagctgcaggaattcagtgccatcgtcctggctgtggctggcctacagcgcatgggctggcagaaccgggtgggccaggtaggagctgccctgttctgcttcccattgaatctgcctctctcctgccttgatttcttcctgaccattctgccaacaacactacaaccagaagcccaggctagggatattgggactcattgctggacttcctacctgtgccttccccaggcttcctagattggcaaaccctagctcactgcctttgaacatcccctatcccaccatcttgtctctctccacagattttgcacccagaagaatgcatgtatgctgtgggtcaggtaggtttgcctggagagaacctggttcataacctttggcacctgctatccatcaaataagatgtttagagagggacaggtttggttgttatgcataagacccagggaagcaggtagaggtgtgtttctcatgcttagctctattactagagaagatcaggcctgttgttctttagggagccctagccgtggaagtccgagccaaggaccaggatatcttggacctagtgagtgtgttgcacgatcctgaaac

SEQ ID NO: 34781 - DNA, 1211 bp, Mus musculus
cattgatttgccttaggaaggcaggagggtgtgggaagcagagaactgacagagaaacctacattctgtcttcccttcagacacattggctgtgatgtctgtagacctgggcagtgaatccatgaaggtggccattgtcaagcctggagtgcccatggagattgtattgaacaagtaagagtagatctgggtcaggggtgtgtttataatttatagtgcccacttcagactgtgatggctgagcccccgtatgagatctggtggcgtctggcttcatagtctgctgcaggcagctgggctaatgctgctttttcttagggaatctcggaggaaaactccagtgactgtgaccttgaaagaaaatgaaaggtttttaggtgatagtgcagccggcatggtgagtaacagccctagccagattcgttccctcagaggctagccttttatctagctggatgaagtagaggcaaggtaaggtaggtttgggcctaagaattggctgggtctcctcctttcaggccatcaagaacccaaaggctacgctccgttatttccagcacctccttggaaaacaggcggataaccctcatgtggccctttaccggtcccgtttcccagaacatgagctaattgttgacccacagaggcagactgtgcgcttccagatcagtccgtgagtgtccagagtgggaaggaagccccttgttggcgcatgtgtccgtggttattgggcttggtgtttgccttcctggacctcacctcctcctcctcccctcaggcagctgcagttctctcccgaggaggtactgggcatggttctgaactactcccgttccttggctgaagattttgctggtgagcatcaaggtggtgctggtggcagtgggacttcccaaatgtacagtgaatagcaagcagagcctctttgatttcttattgaaaattggaccataccggaagacatgtttggttgtcacaagctcgggacgggctcctggcatctagtatgtagaggatagggaggcccggtaagagtcagtggtactgtgttggacatcctggtctgatgtttggggttgctgagatcctgctctttgtccttgtagaacaacccattaaggatgcagtgatcaccgtgccagcctttttcaaccaggctgagcgccgagctgtgctgcaggctgctcggatggctggcctcaaggtgctgc

SEQ ID NO: 34782 - DNA, 2128 bp, Mus musculus
accccagatgtggctcacacatcttctatgtgtaccactggatttgtaggtctcacttgtttagtgactggccttttccttctaaaatgcaggtacggaaccagcagactcggagcctctggaattaggaggtcctggagctggtaagagaggagcctggggcattggcagcttgttagggttggagggaaagaagaggctgttgagccttacactgctattctcctcccctccccctccaacaggacctgaacaggaagagcagtcagcaggacagaagcggccttcaaagaacgatgaactataaccccagctcctgccttccgacttggctccagccccttctcctaccacctctatttattatacatcagggttggagtgggggttggtccctcaggggctcaagttccttctctcagctgggacaggaggtggctgctcagtcctagagtagctctatgggtgaaaccggctctagttctgtccccagccccaccctctggtctcctactctctggccctgtgtttgggaaaaatcactattatgtcttaattctttgcctgtgggtaagtgagagaatggctgccagtagttgttggagacctggtagtgggaaggatgttatgggtcactggaaagtggccagtcttcacagcatcctttcatcttttcctcttccacaaaatcagtgtcctgtttgggccagtgtctacagagcctcagtcccacttggtttctgagtgcctcttttctcttctgtgtcttctcttcccttgtccttcctccttggctcttctgtcctttccttccctgtgcagacaggactatggtcttcttgcccaaagactttcatctggactgtctatagagtaaatatgctctcatggttcatgcgacccctggtggctggagtaagcggggagcaggcaagaagggaaagccctgtagccctgaatgggttgttggacccaggacagtacaggtccggagagtggctggcaaggatgcaagtatactgcaggcactcgacatccttgtcagccccagttcctgtgacacctaccccttcatgctctttcctccttccccctgggctgaccaaaaatgtgctatctactgtgagcccctttcccaagaccctgggggacggagagaccatggagtgaatgtaaaaatgccacctcactctcaggcaagctttgtgggtaaagacgaggggtcagggttcaacttgacagtgtacttcgctaggaaggagaggcccttgcctgctataaccatgcctagagtgcctgtcctccagtattgcacctgtagccggagctagggccaccccagtgcaggggcaaagcaaacctgatgtcagtcgttttgtcttttctaccccaacctcaccctctcaccctactttccaccccccaccccgccttttttttttttttttttttttttttgtgccacattggcagaggggcctataggtccttcactgttccctcctgtgtgttggagttctttagttagcagttcaggctggttggacaggtttgaatcaaattgtactttgttccattgttaattgagaaactgtttcaataaaatattcttttctataggttgtatgtgtttgcttcttccctcccttgtttgtctgtttgttgtgtgttttcacacaggtagtgtatgagtcaggtttcctgaggttggccttggtttcctgaccctcctgcctccacctgtccaatgctgaaattgagataccacatacaggttatttttagagattcattttatttgatttatatgagtacactgtagctgtcttcagacactagaagagggcatcagattccattacaaatggttgtaagccatcactccagtccccaatgcagtttttagatttggaatttggttacattgaaaaaaagtaattgtttgctgtaacaatcatatttaatgtgataagatagaaagttcgaaatccataccagaaaatggcttttcaatgaatctgagaagcccactgccagacttgggtgcacagttcttgtgatccatgtgtgtctcttactgccttatctcgaatctgtactgaaacattaccaggcctttgacccagca

SEQ ID NO: 34783 - DNA, 1189 bp, Mus musculus
caagtttgtggtcctggcagaccctaggcaagctggaatagattctcttctccgaaaaatttatgaaatttactcagactttgccctcaagaatccattctactccttggaaatgcctatcaggtaggtagccccattcaccagattctgccaaagctttgtgctagctcccaagtcatttaaagtgtgaccaagcactgcttttagggaaagacagcagtgaccagctctgtttgtcttgaggacacagggtttccgtaggcttcacgttcttcaagtcattcctaccgattctgcctctacccttgtggtggaagtctcatccctcacagtttcttgtcttctgggtctgacctagatgcgagctgtttgatcaaaacctgaagctagctctagaggtggcagagaaggctggcacttttggacctgggtcataggatgaacctggaatggacgccctaaattctgagacgtgctccagagggctttgctgtgtctactcggtgagggtcctgttgtagcagccttgctaatatacttgaaaatggtagaccactgagcctggtgatggtgacagatcctgggctcgaatgctgtgttctctgcccctctgtatatattacagtcctactctgtatagatttatttatggaggaaactggcttagcaatgctgaaataaacattcctttgttttagtgttttctctcctaactgatcatttgggagaagggcaggggaggggaaggcagaattgctaagggcattcagtgaatataaagtactatcttctagaaaacaagacaaacgatgttcattagacaaactagcaggatagcgactcttgagccttagaggcggcccggccccagagctgctggttctctggggcctgaggtggccgtggtggatgatgggacacttacttacttgcacttgaaatcaagctaaattttatctcagtatgatctctgaccctgcggtgtatgttctgttctaatctcttacagaatttagcacattataaaatacctgtgtttcagagctctcaagccagttacaaatggcctaagtgtggacccatgctttcagagcccccttccttaaacctatttaacctacctgcaacctagtgtaagtgtacagcattagctgcatgccgagcttgtacttaaaagggtccatctgct

SEQ ID NO: 34784 - DNA, 2190 bp, Mus musculus
tattaaaccttattaatgttacgacccttttaagatggttccccttttgaccaccagctgtgaaattactatttgttttttcaagatgggtttctctgaatagccctgactgtcctgaactcactctgtagaccaggctggcctcgaacttagaaatctgcctgcctcggcctcccgagtgctgggattaaaggcatgtgccaccactgcccagctcatgaaattatttttttttttatgaaattatttttgttgttgctacttaatagttttgctactgctatgaactgtaaggcatatgtctggtcttcagggtatctgatagcgactccaaagttgccaatgcaataagccaagaagtctctaatttccctgagatgatcgtgacagagctttctcagatgcttgatgttagggagcaaagggatggttctgactggttctcatttgttttgatgagcagaagtggtccaaaggcaaagttcgggacaagttgaacaatcttgtcctgttcgacaaagcgacatacgacaagctctgtaaggaggttccgaactataagcttattactccagccgtggtctctgagagactgaagattcgcggttccttggccagggcagcccttcaggagctccttagtaaaggtaggtgatgtgcccttgttcttaccagtgcattgtcttgttgggagcagtatgactggaaagacttatgaaggatagactgacttccagagtcttaagttttagtaacttcagtgtcctgcattcctttgcagtccttgaattcctggccctttttatttatttatttattgcttctccgttaattgggattaaagtccagagtaccaccttgccttgttattttggaatgccatctcactttgttgtccgggcaaattattctcctgcctctggtgggattttttttgtttgtttgtttttttgtttttcgagacagggtttcctctgtgtagccctggctgtcctggaactcactctgtagaccaggctggccttgaattaagaaatctgcccgcctctgcctcccgagtgctgggattaaaggcgtgcgccaccacgcccggcttggctatagttttaagtacataaacttagcagataggatctaggtgttgttacaagtataaactatggtccttaacatagaggtggtggccccttaagtctgtgccaaggatgtggaagagtttgtgtagttactcctgtaaccacaacacttccatggcaaaatggacttacccaggagctcaggccaactctgcacggcacccgctgtacagcagcgtgagacatactgcctcaacaggatggaagaaaagactgacttcagatagggtgattctctctacgtgcaaatacactaaattattagtaaatcctaaaaacagctacattgatggctggcttgttggtcttcctgtcctagacagagttgggattaagggtacacgcttgtgagcccagcacactgaaggctaaaagggtcagcaccaaatcccaggccggcttggaagttagagtatgacctggcaccctaagaattaaggagttctgtctggaaaagaaataggaaatgtacacttggtatctgctatatgaggaactctggcatccttggagctggagagatgatttccttctcagataccaaatgcacgtgtgtaaggcaagaaccttcaaacactttgaattttctccttaggacttatcaagctggtttcaaagcacagagcccaagtaatttacaccagaaacacaaagggtggggacgctccagctgctggcgaagatgcatgaacaggtgggaagaaaagtttcttggtgtagaagtatcactcgtgccctttatgagatgttgcggttatgactttgtttttttttgtttgttttacaggttcaatcagctgtacatttggaaaaataaaactttattgaatcaaatgaatgggtgcatctgtttcctaaggcagccggggaggatttggtcttaggaataatagctggaattggtttgttggccatgaagtcagatgcaattgcgcctgggaaccttcagcttttccctttacgtggttgcttgcttcttgttgcagcttcggttttgaattgatgcctgaaagaaaataaaaacttagcaagactaatggtaaatctacaggga

SEQ ID NO: 34785 - DNA, 1224 bp, Mus musculus
agtcacacacaagaaaaaaaaaagattgagaaaaaaaaaaaaaccttcccccctctttcaaatgatcacacccttcattcctctggacccagagacatacagtcctatgcaccctccataagccccacctataaaatgagatcagaccatctaggcttccatttggtgagcccctgaggactgagaatctacccccgtccctctacgacggccgcctgtctgctgctgagtgatttccagagagcaggtgcgcacatgtacatgtgtttacccacaccagtgacatagggcccccagcctgggtgcctctgctgctacatcttagccagaacttgaagccctttatccccattctaggataaaaggcgagaaggaaggggcagcgtgtggccccatagaatggagctatggaggggttaggatgctgggaccctggctgcagtagccgtgggccaggtaacccttcagggcatggactcttctagaaaccaccacttgcttctcaccaaagaaggaaggtacagagttggccctccacctctagtgcagagcgagggaaggcagtgtgagcgagaacatcctgttgcctcctctgcctgcctactctctgcaaggtccttctgtccagggctcagggccatgcaccagatctgtctatgcccaccagacacagccactgcctctcctctgacttcccaggagagcccctcacccgcccctggtcagactcaagccatacaggaatgggtgttttgtcccctttggccccaggagtaaactacttctgtttttctcacgtcctttcctgccttgtaaggtggcgggcagctccctggctaaggcctttcctgtcctgcctccagggccaagggccattctagacagggtgtcttttaccagggccctgtccccagcctttctgacctgcagggcctggttttgccttggcagctgtaatacaaagggaatttgtgcccacttctcccagtctggtgctgtccaccatcagccaggccaggcaccaagccccctccagagctggctgcaggcccctggcttcccctgctcctcccagggaccatagccaaggtctcttgtgttgagaggtgggtggaaacctgtccttcctgccagacactgccctccctgcttccatctgggccttgtgcccccacccacatccctaccctgcccagactgtctagcctgccctgctccaaggag

SEQ ID NO: 34786 - DNA, 1067 bp, Mus musculus
aggctgcctgcagtcagaacttggaacgtctcattctgtccttgggtatgtgggaaacttgtagtttagttgatttttctcagccagcctttagccctagctcaactgaaacagactggacttgcctgcacgagctgcaacagccaagtgaaatcttccatgtaactagtagatcaccttaggagaagagagagtttactgtaaggcttgtgaaaacatgtctccttttttatattgctttcatggatactaattttaaatttctaaacttttcccataggctttgacaaactacagaaggctctttggatctgtgacacatcattttgggggggtgctcttctctttgtgggttttttcatctttattttggaactatgaagagttatataagagctcagacatttttcttttttttaaactggtgaagaaaaactgaaaagaagacatagaccttttttgttccacttgtttgcactgtgtgctgactgaacattcgttgcactaactgctggtctttaaagatgttttctggggaaaggggacaaggaaggaggaaaagaaaagaaggggagaaaccctaaaaaagagaagaatttgggtgaacacatgcacctgtctaaagttctccactagctgactctactgcatttcaacttctccctgattattcatccgtttttaagcctgaagagcttattacttatttgtgcgaagtgccttatgctacaagaccattaagaatatcatctttacacacagcccaaggaatcaacagagtcatgttctattttcttttttatttctttgcctcttcattttggtttcacgttgaagtctcacctcctgttctaccagtactcagcccagggccggaaggtggactagtgatggcagcgccattttccttttctttatatggaggagttgattcacaactgcagtccatccacactgtacatacatgtatttaaaaaaaaaaacaataccaagtaaaattttcttccgggctgagtagacgtaccatcgtcgctcccaaaggaaagagcagcctctcactgcaggag

SEQ ID NO: 34787 - DNA, 1425 bp, Mus musculus
tgacaagcctctgtgctctacagcagaacactacgctggctcacacgcgtccatgagcaggaaggcactcgctgtaaagacttgtcggagggagccttgaccttctttcctctgtggcaaagcgtgacccgtagaaaattggatgtgtatacttgtataaactttgtaaataagttttttttctgggttcatatatatatatatatatataaatatatatatatacatacatatatatatattattttttttggatgaaggttgctgggattaagggattagagtgattatgggagcagctaaagatgagaggggctcagttttctgcaacactaaattctaaaaagtgctttggcctctaactgtaggaagcagacctctgcaggctctgtgttggaaaggggccagaagcccggccacactgctcttgtaatgaatgcacaggcagcggtcttagcagacagcaaaggagctttgcaaggctgtggtccctgggggctttgagaagctctgtggtttggctctcctgtcctaaacgtttgaggaacttcccaagttctgcaaaggggaacaaagataaatcttccttggagtgtgagaagtgtacagagtgcagtcttagaggagagtgtgtggagcatggatttttatgtcaccggaccagccagtgcagcctcggcgggcttggcagttgtggagcctagttatccgcggcccctcctgttgtgtgtgagcagcgccctctgcctatcttgataaatacatttttgcaggaaggggcagcccgttagagctgttaacgtccatgtccatgctgcagaaagctgcttgctgcccgttctctgtgccgcactaagagttgctgtctgtcgttttgcattgtaaatcgctggcagatgccttaggtggtagtgttgctttaaactgtgcccctcccaacacgcttgatgtttggcctgatctccaggcaaaaggagggagatgaatcaaccagtgaactttttttttaaaaatgtttttaattcccttttaacccagtatactaggtcaggaggcatctagggaacaaaaaaagcaaaaaacaaaatttaaaaaaaaattgattttcatattccatcactttgaagaccttaaaactatgacaaggtatgttgagtctgcttccatgcttaactcgtctgaagagaggagtcagttattcaaagttgctttgactttgcctagttctaaagcaaaactatttgtgacttatcccaaattctttggggatcaaaatcctacagatgcctccttatcagagataaccctgactctgtaacaactgtagcaggagctgcacggtacaaatccccaaaggcaagtccagtcaagtgttggctacaaaacaaaccaaattaataaggaagtcacttttttagggagggt

SEQ ID NO: 34788 - DNA, 1268 bp, Mus musculus
gcctctggtcatgtagttgtgtgataagtaacagactgttacacacttgctgctcagggcctgtttttttctctcccttagtgttctgaacatgaaagaaactttcttaggaatggaatacatttaccataaaatgtttttcctggaaaggaaaacctaagtagctctaaattatttccaggtgggcaccagcatcataacaattggttggcccggtggggtggggtggggtgggctgggtgggtggttgtcatactcgttttcagaatgagatgagggcatctttccttggccacctgctttgtgctggacaccatcgtgctcggtgagaacagagcacagcacagagtttggagtgacatgttggaaacaaaacatctcattctgatcatttggtttatttttttttaataggggtgggaggggagggtactgtgtcccaaaagggagggtgtctgcactaaggatttagaaacactttggaagctcataacctcatgggaaactgcctttagccacacacactcctgacctttagatgagtaacaaaaagatgaaataagtttgtgggaattaagccatgttattttaattggatacttttttttttcaactctctgtgtatctttaaaattgttactgtggaatgattttcttgccaaataactttgtcaggcaaaattattggcctcatgggaggtgaagtaagccagattttgggtaaatttatgtggactttggtgagtttgtaattctactttatattcataaagatagttttttaaaactcccaaagcaaatctattttcttctctaatgtaaaaactcatctttggaataaagagttaagtgtccgagggttgtaacagatatgaggtcagagggagctagcctggcctggactctgcccctccacagctgacagactccaacagaagtgtatttaaatctccagtagacagagctgggcagggcaagggaggggtgggcctgggttagtaagctgcaggctgctgtattttaaccagtggttcttggggaggggtgctggagaatacaaagtcacttcccttttttgaaacaaaacaaattagaaaaaaaccaatttttttgtttagtaaaaataagaaaattctaatgtccctagtcacaagggaccagttccactttgagcagtaggaacttaaaaatttgaaaacatttggggaaagggaaaattggctttctgtttaattggcaaatgttccagtggggagggtctgtttttg

SEQ ID NO: 34789 - DNA, 2522 bp, Mus musculus
tttagagaatgtgatatattctgtgatgaaaatgtagttaacatttcagagactcaccattgttttttttcctatccccttcccctctctctgttgccctaggttaccaaagtgacccaggtggatggaaacagccccgtcaggttttccacggagaccactttcttagtggacaaatacgaaatcctgtaataccaagaagggaaagctgaaaaggaaggatttcagattaataaagaagaagccaaaagtggctgaagagttttccaaatttacaagccattggaggtcccccaacccccttttctgatacagtgcacgttctctgcgcgcaaggaccctcaactcacacccagtgttgcggtgtcacagagacatttttgacaaatgacactgacataaagggaaaggctgctgatttctttggccagcaggaagccagctctccagggaatggaatgccccagtaaatagctcttctgccttcacctaagtcttcctttattttaagccctaaatataggtatatttcatactttgttttaaaaagttttctctatggatttgagtctttcacacccctttgctttctgttttctttcagtacacttagtcacacactggggtcatctgtctgttgtactgtgttcagcactctgagaacaaggttatctaacccattcttgacattagacagtaccagtgaactgcttaagggatgtagagtctagaagttgaaatacaaggttgtcttgttttctctcctgtatccatccattgctccatctctttatgaagtcgtccttgtgagccctgcccttccagttgcaggcagtgttgtgaatcccatttgtgtcaatattaaaggtagccagctgggaagcagcttttatgtgtacacaccttttcaagatgccgaataagatggctacatccatttccacaggaaatcatgtctgctgctaatgctaccccaacttacagttccctacttgacttatggttccctacgtaacttacagttctctccgtgctgtggggcgattgagttgaagcacgtagtccactcagattccgcgtgtccacctcctcccttcccagatgcttttcccttcatcagtcttctttccagcagaaatgagtctagtgagtctgtgccatttctcattagccctaaatcactggagagatccatctttaccatttcagtggtagcattttgagaggtgtatagtgaggggttactcaaatataccccatctaacctgacatttaccacctccctctctgtccttgtttctgaaaacctttttttctcctcctcaggctttttggtgtcatcatgtaataattgtaggagttctcagctcattttgatctattaccttttcaatagaggctgaatcagccaatcccacccgccaagcactgaactgggcgggatggacgatcagttgctgaaggctgcaagcagtagcaatgggaaacagtagatgacctccattctctcaggtggctgcagagcagagcagagcagagatctccctctgaacacctgccttccctggcaagagtatactatccatgaagcagggcagtcccacagaagactgtggctgggatggcttgccaaagaaatttctagcctttccctttcccctaaactgcatcagggaagaatccttatctctagcttcgttttcacatgaggttttctgaggaaggggactgggataggaagtctgtcatgtagtaaagtagacgagaaatcttattaatccagttgtatttcagagtttgtccctatgatttttaaagtcaagtttaatttcacaagactttttttctgaaattacttttggggtaatatttaaaatgagagacattttgtaaccctgtaaaatacatagggaatataacattccaatgtacacaacgaaggcaaattcttaatcaaataaaagagtattataaaatgagatgtttactggactctaactttgaagtctgctggtgattcatgatactgtaataggatctaaaattaaagattaatgatatgttttttttttaaagaaaataatctatccaagtgtattcattgccttgtctctgattcccaggtattgtgcctctgttgtgtgtttgagtacacacactcaatcccgaaagcagaggtttttggtagaattaggcttcttggagcttttgccaggtctggagtattccaatttttagcagtttagagtcagtcaaatgaagcatttttttaaaggatatcattctgcagtatcctgaagcctgccctttgtcagacagtgatgagtaaatgaatagggatgggggatgctttagaaatgtgcttatcgggctggtgagatggctcagtgggtcttccgaaggtccgaagttcaaatcccagcaaccacatggtggctcacaaccatccgtaatgagatctgactccctcttctggagggtctgaagacagctacagtgtacttacatgtaataaataaata

SEQ ID NO: 34790 - DNA, 1167 bp, Mus musculus
gatttaaaaaaagaagaaaagaagaaaaaaaaaaaacttaaaataaaataaaataaaaaaatacaacacacatacacaaaaaaatcttttaatgaatgtatctttctaaaggactgacgctcaatcaaatacctgaaaatactagaggtcacagcctcatctgatgttaacttttattggatttgggattctttttcatagaaaccaagttgttttttgttgttattgttgttgttgttgttgttgttttttaaggaaaagcgggtcattgcaaagggctgggtgtaattttacgtttcctttccttcattttaaagcaatacaaagttattgaacagatagttttgtgccgaatcatgaataccagtcaagtctcacactctgaaaacttgcaacctttttgtttgtttgttttggttttcaaataaatataaatatatatatatataggaactaatataggaatgcaccattgtaacaaagcctagttcagtccatggcttttacttctcttaacactatagataaggattgtgctacagttgctagtggggcagggaaatgtcaggctcccagtgacagtgacggtggtgctgactccacatacggatgacagacgcccgcctgtcccgagaggagcgtgcagagcagatctgctctcacctggcttcttcctgcctgtggacgttgccagtcggtacctgtactcctcgtctacttccggttatgaatgttggggtcaccacctgcatctaggggaaaattgtgttctgtgctttctggtatcttgttctggggtacactagttctgtctttcaaccaagaaaaaaaaatagatttgtggtgtttcttttcttgaactttaacagtctccttagcaaatacaggtagttgaataattgtttcatgagctgaacagtggcaagcttcatttctagaataagacatttctctacagctgtgtcatgtacaatggatcttttgggggttttttgtttgttttgtttgcttccctttttttccttgtgttcttccaagcttctggttagagacaaagtggggggggggaaggaaaacgtgtctgaagcccatcagtgttaactccctgagacagggatgaaggaaaatactttaatattcaaaaaataataatgctgaaagctctct

SEQ ID NO: 34791 - DNA, 1913 bp, Mus musculus
ggctgtcttggggttgtgccaattaattaccaaacattgagcctgtggctgtaagtgggagtgttaccctgtgagccttaccgtagccagtgacctttcttgacgataggagcggctccctctccatcccttctctttactccctcctcccctcctccatccttcatctgctgctttcccattctttctgggtagcgggagcttgcctccctgctcaagggcactccctacttggtataggaagtgcctacagaaagtcccccaagccagtaagcactccaggtggggaattggacagaagccgttggccgtaaccagacggaatttggagatctcataaagctccattgagagttttaaagagatgtatgtagcgaggtttttttaaacaagagactaaagattatttaaataggatttgagtcatgcagcagcctgagtccatagccaggatatgcccatccccttcccaggacgtgcttactctctttcccctttctgaagacataggaagatgagtttctaaaaggtcagggtccagctgaaagaacactaatcagatttcaaggccccaaacttgggggactagaccacatgtgctaagggacctctgccacccgtgtgcagcctgtggctgagcaagttcaatgacactactgccctggttactccttagggtgtggacagccagcagcaaatgtttctttcttcccccaagacagagtcttgaacctgttagattaagtcattggattttcctctgttctgtttacagtttactatttaaggttttataatgtaaatatattttgtatatttttctatttgaagcacttcatagggagaagcacttatgacgaggctatttttaaaccgcggtattatcctaatttaaaagaagatcggtttttaatgattttttattttcataggatgaagtgagagaaaatattcagctgtccacacaaagtctggtttccctgcccagcttccccctggaaagtgtactttttgttgttccatgtgtagctcgtttgtgcccattgacataaatgttccttgggtctgctctttatagtaactgaaaaagaaggtcacccactccattaggccactgccctccagggccaaggactgagggtacagaaccttagcacaccagtgtctcctcctctttgctgtattgccccctccctctggatcagccccagagtgggaagcagcaggctccgtttcgctcccctttctctttctgagttagcaaccaagaagctgcaacttgacattcgccatcacatctgcctcatccatcacctcctttccttctctgcccaccaagtccttgtacccgcagagaacccactgaccgcctcctgccctctcggggcagattgttgaacctgaagcacagtatgaccactcacgatcaagcagatctctgcgcctgccacaaggtttcagggtagcgtagtccgagtggagggcagggcaccctttctcttatggaagtcagcaaagcaatatgatgcagcccagaactctctgccaggactcgtggctctgctgtgccttccatcctgggctcctttccttctgtgaccttaagaactttgtctggtggctttgctggaacattgtcactgtttccactgtgggaagcccagcactgtggccaggatggcagagatttccttgtcatcatggagaagtgccagcaggggactggggaaaagcactctacccagacctcacctcctaccctcctttgcccatgaacaagacgcagtggcccaaggggtttcactagtgtctggtttccttcttattgcactgtgtgaggtttttttgtaaatccttgtattcctaatttttttttatgaaaaaatgtaagctgcatttgttactgaaagatt

SEQ ID NO: 34792 - DNA, 1642 bp, Mus musculus
agatggatctgcacatagcacagcttaccctggaatccctaaactgacaccacaggttcataacgcaactcctggagaactaaacattagcaaaattggcagttttgctgaaccctctacagtgcccttttcttctaaggatacagtgtcctacccacagctccacttgaggggccaaagaagtgacagagaccagcacatggatccttcccagtcagtaaagccctctccaaatgaagatggtgaaatcaaaaccttgaagctccctggtatgggccacaggccatccattctacatgaacacatagggtctagttctagagacaggagacagaaagggaaaaagtcttctaaagagacttgcaaagaaaagcattccagtaaatcctacttggaacctggccaggtgacaaccggtgaggaaggaaacctaaagccagagtttgctgatgaggtgttgactcctgggtttcttgggcaacgaccatgtaataatgtttcatctgagaagattggagataaagtccttcctctttcaggagtccctaaaggtcaatccacacaagtggaaggatcttccaaggagttacaggcaccccggaagtgctcggtcaaagtgacacctctgaagatggaaggtgagaatcaatccaaaaacacccagaaagagagtggccctggctcccccgcacacatagagtcagtgtgcccagcagagccagtctcagcctccagaagcccaggagctggcccaggagttcagccgagccccaacaataccttatcccaagatcctcaaagtaacaactaccagaatcttccagaacaggacagaaacctgatgattccagatggccccaagcctcaggaggatggctcttttaaaaggcggtacccccggcgcagtgcccgcgcacggtctaacatgttctttgggctcaccccactgtatggagtcaggtcttacggtgaagaagacattccgttctacagcaattccactgggaaaaagcgaggaaagagatcagcagaaggccaggtagatggggccgacgacctgagcacttccgacgaagatgacttatactattacaacttcacgcggactgtgatttcctcgggtggagaggagcggctggcctcccataatttatttcgggaggaagaacaatgtgatcttccaaaaatttcacagctggatggtgtggatgatgggacagagagtgacaccagtgtcactgccacaagcaggaaaagcagccagattccaaagagaaatggcaaagaaaatggaacagaaaacttaaagattgatcgacctgaagatgctggcgagaaagagcatgtcattaagagtgctgttggccacaaaaacgagccaaagctggataactgccactctgtaagcagagtgaaagcacagggccaggattccttggaagctcagctcagctccctggaatcgagccgcagagtccacacaagcaccccctcagacaaaaacttactggatacttacaacgctgagctgctgaagtcagactctgacaataacaacagtgatgactgtgggaacatcctgccttcagatatcatggactttgtactaaagaatactccatctatgcaggccctgggtgag

SEQ ID NO: 34793 - DNA, 2223 bp, Mus musculus
tcaatgacagtaataacatccaaaaatcctactgtcctgtgtatttactagcccataaggtctggacttaagcatctggccttaatatagctctgtaatattacagagtaactttccagataaatgcaaataccttagtgtgtgtatagatttttttggctggtggagatgagggaatcttatacaacttttgtattatcttgtcacttaaagatacgatcacaacaaacactcctatgaggatctcaccaccaaaaacatagctgcacaatctttcagtgagtgacagtaatgtgtggaacttgcagtaaaaggataaatgagaagctattgggcccctttctcttttgtgctccaaggtctaggcctaggtaaaataggcaataaatattctatctacatgaaaatgtcattttaggacacttaaaacagtatatctcagtgtatatgtgttaaacacagatactgtgtcctttttttattagtctcacttgagtgccacgttatatcgtgtcttcccaggtaagatttatgtagttggtggcagtgttttctcacttgttctagtcaggtaaaaccctaagactacaatgtacatagctagtgtttgggctgtgacctggcttctaagagctgcttcttatctagccttagtttatcaattaacaaagtagacattaaagcaagccattttaaataaatacttctctctgggtagttactaagtgattctgcccacttctcccaactgtttgctctaagaggcccagtcctctgcgggatgttttcatatcagtgtcagcccagaggtgtaaaggacaagaaaatgtggctgtggcttcttttacagaacattactgttacaaaagagtatacatatgcaaaagcgctgtttcagtattccaacacaagctgctataggcagtcctttgtgtgttttttcttgttggtgtcaactggaaaacttgtgattagagagcatctcactctggctattgaagaatgtacctgttgtgaacagggaagcctcgggcatatctataaatgccggaaggttaaggcagactcagtgtgcccctgggcatttagctagatgttgacaggatttctttcctttaaatgaacttcatttcctgtatgcagcattctcctctccctctctgggaatggactgcatatgaaataagcttctacctgctgctcttacttttccagagtgaatgcgggaggatgcttttacgctcttatttgaaaaagagggaagacccaagtttcacaagtgaaaaatggaggaagatgggtacaaacccttgagaagacagctgttgccagcagctttctagtgaatgggctccgtgctgcctccagtgtctgtattctgcttctgaactgaaccgtcagattgtaagcctgttttggcaagcttgtgttttgttttgtttttaaactcttctgatactttcctatgaatggccgtgacgccacccaagctgctgaactcctttaatcacaaaagcacgtgtgtagcttaaggccactgtggtgaggaaaccaagtgtcctctgtgccttctttctttctgtgaactaatttaaaggcatccagaaaaagaaactctaaagacttccatcctggtacaataagaggcatatgtgcattgcaaaggtcaaagggtgtcttgtctggaactctgcagcggctgtaaatctgttaagacttctgactaccgagttttacatgacggctttgctggagtactaaaggaaagtgaagacttcagtcggctcacacctcaccaagaggctaatactaaacttggaaaattgtttagagttcaggcagttgtttgtttgtttgtttaatatagctttccgtgggtgtgtgaaaattgagggacacttgagaagtagcataacgaacggtgcaggtgaaagtgccagttgctgctcagtaccacactctaaacgcttcattactttatttggttctggttgctaagcagccattgggcaaagccaaagcctactgggtactgtgacaagccagactgatgctagagacagaaaatgaagaacaaaacagcaaaaaaggttaaactgaaatcaaactcaatagacaactgtatttgagacattccaggaaagttactttttgtcagacttgcctgtgtgtgggggtgggtgggggagggtgctcaaaacttgtatttaataaataagcacc

SEQ ID NO: 34794 - DNA, 2174 bp, Mus musculus
acagcacacaggtgtgctcaggggtctgaagagatagctcatctatcctcttgcagaagatcccagttcagttcccagcatccatttggtggctcacaaccatcagtacccagttttaggggaggtgacactctcttctggtgtctgcaggcactgaatgcatgtgatacatgcaggcagataccccccccccaagataaaaataaattaagtcataaaaagatgagctaaccattccagccacttttgattaataccaaaatccaaagtcacacaggaagtctgattttcatggctatctttaaatggaaacatcttgttttactgattttttttcagtatcctaggtttattgttttgtcaattattccaaggtttatagatgacagcgcaaatctaagcacaataatgacaaaaggtcacaagaacaccaggacaccagcaagtgctaccaggatgaatctctcagcatcacttttgtatttatttatttatttttagtcaggttctcactatgtagtgctggctgctctagagctgactatgcagtgttggcctgaaacctagagacaccccctgcctcagctctcaagtgcttcactcaagggtgtacccccacatctagcccgactgtaggtttgtaatgagcacagacagcgtgcttgctgtgtgctcccttttacccccagctcaacattctcttcatttgcagactggagcccttaagcaatttattagaagacttcgtgatacacgataactttaaaagaaaatagacttgtgaagaaggccaactcaaagcaaatgaccattttttttttcagtcttatgtgtgagaactggaagagattatttaaaatacttttggttttaattcaccttactttaaggagaatttgccatgggccaaagactacctaaatggaaataaccaattttatttttccctttatttgagtataaagcaaacttttcaagtggcctatggaaagaagagggatggctttcttctttgtgtctggttacatggtctgtgcacactagcattgtttggagaacagagaccatctaaaagttcaggtccagggtgaatctttgcgatgtgatggtttagtcttcactgactgggccacacagactatttctttttaacaaactggaatttccaaaagattctatttctacatattggatcttgtaattttacccagtctttacaaacaaattggcataatttaaatataaattttggtcttgaaattcattctatacatcttgttccactttttaaaatgcctaaaaaaggttttgtttttatttctctccctcccccccccttaaaaattaagacagggtctcactactatatagttctgtctatcctagaacttgctctgtagaccaggctgtccttgaactcagagatcctactgcctctgcctccctagtgctaggaataagggcatgttccaccataccctggtctaaaattttgatacctagttttgaagctacaagttagagctatattttctcttgtgaatataacaactggatatttctttaaacagatggcctgtgtatatttcatatttgtaatgaagtagttaaaaactcacagagaatgtctccagggaacttgcagcttgtgtcttgtttgaatactcatgggatatcaggttcttgttcagtgtctccttcctaagagtacttttgtactgtaacttattttttattatgcatgaatcactgtgtaaataaacccttagtaataaagaactatgatttttattatttgcttacaaacaaatctgcaaaattcacaacagcagttaatggaaaacaagggaagatgtttaactttgctcaagttttcttggtagatagtagagttagacacgcagagcaatcattaattgatgaaattaatttctagtagttttatatttctataggcttcacatattgctttggaggactgggaaatgggcaaaatgatagcacacatttggaagactcatttcttggacctaaccctaatctgagtcttacgactgaagtccaggttgtccttagttcttctgccccagtcttgcagatcttggatttacaggcttttgccatcctacctgacttagtttgggaactttagaaacaaggatatttgtttttct

SEQ ID NO: 34795 - DNA, 2009 bp, Mus musculus
ttgcagtgcctacatctccacacgacagctccgggcagcagagcagggctcacggtgtccatctttgggatggatatcttcaagacaagtgacctgttatgcaggggtctgtcaataactccagtcttagttacacacacacacacacacacacacacacacacactcctccgtctgcctcttagcattgtctgctcttcactggccctgggggtttcaagggcatgccatcggtgggatttataggcaaagggattatgctgaagatggggagaggatgaggtatgggtgccagaaaggatctgggattgacatgtgagttgtgtctccacagcctccagaagccaaggccagctacctgacgcttcagagactgatgtcgaggcttgagaaaaccggctacttcataccagacctttccctaggagaagccaagaatgcgtgttccctgtgcctctccctgccccccactaaccccagtcctatattaatgatgcaacacttctcactgcagccgggctctggaccctgtctgtgccgtgtctgtgccgtgtctgtgccgtgtctgtgtgtgtctgctgactgtggtcgaccgtggatttcattgtttctgtgaactgtgtgcttcctctcccacgctaccatcggcgccttgtgtcctcctgtgacctccatctcctcttgctctctggagtctgctctgttcctgaggagccctagtcccatctctggattgagagagagttagttgtccccagggcaggagtccccagcggacccagggctgagaaagtttgttgctattctttgtggactctcagaagaaacttgctctggattccaccagttcagaaggtctgtttgcagctggagagtcattgctgcaggatctgccttccagggctccttttccttttagggtgtccactgcagagtccccatctgccccaccctttagggaacacccaggaaatcttgcctctggggaacgagctcctctcttatcttccgagcaataacctggtaggctctggagtccccctgccttcatccacctttcctgcttctaagacttccatctctggcccgatttatctgagcagaggactcctttcttctccgaagctggtctctagcaggagatagtcaaggggacaggcagtggaaagggtggggacggttctgtctctctgcctggtggtgtggatatggcagactttgcagtttcttgtccctgcctgtcaggggtcagagtggagagggatggaagggttcaggggcagcggggctgagggtcagagagcaacagggtatgagcagcctggatgcaaaggccagaagtcaaaagtcatcagagtggaaactcacaccggagcctgcccaacctgcctaatgtgttcccttggaaactaaccaagccacactgtgtactgggactgctgatctctgtcttgtgatctatatcctctgacaacagaaaaataaataaatacagcattgtttcctagtgactctgagtggcttttcttctgagaatctgagggtttgtagggcccagggaacttaaaggacaagagagcctgctccccagtcagagggagaaagtcaagactagaggatgccagaggtgccaggcactttaggcctcttttgctaggggcttccagagtccagctttggacctcctctgcccctccccctttgttctccttttacaggtccctggtcagtcaggctcttctcacctgtcaggacaagttggagcagaaaagagccacaggaggttagggatggtgacagtaatagagacattcccatggaggttggtttgttcttaagtactgttggccaaataaacacagctgctggcaggttcctttggagggtcgcagcccactcctgtgcacagccctatagccagccccctgtgtgtcttgggtgagtcactgctcctagagagtgaggaataagccttattctaacccaagagtgcctagcgtatcttaggg

SEQ ID NO: 34796 - DNA, 1099 bp, Mus musculus
gccttttatctgtcttgcctcattctctctctgacatccaaggtcagtgctctcaagcttgcatgtacattagaaaaaaaagatgcaaggtttgttaaaatatagactgctggactccaggctcaaggtttctgacccactgggtctgagaggagacccaagaatttgcatttccagcaacatctcagaggatgctcttggccccagagcacctttgagaacctctgccctggaggggttcttataaatcacctatgaaatggagtccagagaccaggctggggccccatctcagcttcttgctagaaatactaccaagaagctaatctatttagaaatggcatctcatcctgagactgtgttttctttcttcattgactgggaataaaaacacctagttttagcaccctgagacatcataggagagtcacactggaggattgtgtctaagtgctcctaatgtttgctagctgtctggtgttatctactgggtacaatcacctctggcccgttagtgtttctctccgtcccctcagctgttctacctctaggatgtgactttactcctctggttcttttgtcattagaagtatcaggatgtagggactgttgctgagagacataggatatgtgtaacaacagctcatcaaagcccacgctccccaaaaaggtgtggtcacactatagccaacctgctttgtgacttcagcccctacaagtgtggagttgctagcatgtcatgagaatggttcagaagaggcctgaacaatatgagaatcctttcagagcaagagaaaaaggcccaggtagggtgacccaagtttatctggagacctgatgaagtgagtaggaggctgttttggtttggtgtgtgtgtgtatgtatgtgtgtgtgtttgagtttgtatgtatgtatgaatgtatgtgtgtgtttgtttgtatgtgtgtgtgtttaagtttgtatgtatttatatgtatataagtgtatgtatgtgtgtgcatgtgtgtttgtttgtatgtgtgtgtgcttgtatgtgtatgtgtgtttgcatatatgtaattgtatgtatatgcatgtgggtgttatatatgtgttcaag

SEQ ID NO: 34797 - DNA, 1428 bp, Mus musculus
aacagactgaatgtgtttcattactgaaccccgtgtggggcggggcagggcggcctcctcctctattacaagtgcctgaggagccgccaacattttatttctctcatcaagcatgtcctccgttgtgaaccccaccgaggacttagaggaaccaccgggttagataggtggagagtacggctgtagacggccacgcacgcttcaaccatggactgtcctgagcagaaacatgtggacatatgcgagcttctgcaccaaagtggcactgagatgtgggctgctgaagacttcaggggtgtggacaccttagttaaagcgactgctatgggaggcttagggatcctccttggaggttggccccctgctgaggatgtggtcctttattcacatggcctcctagcatggcatgccctggcactttggctgtgctgggtctgtgcccctttcggatacctcagccccgacaggatcatacccgtccctctctttttgcctttttttttctttgtaaatgtcttctgactgtcacaagtttgggctcagctgcctgagcccggctggatgttgctagaggggccccgagggatgttctgtctccttcccctcggctggcaccgtgatttcctcacgattctcaggagcagccctctccccccttagggtgctctgtggagctcttccttgccctcaggtttcaagcacctatctttccaggaagccaaaaaagccatagggaaagaggggaatgccttctgccccatcttgatatttctcttctttaactcgagtgtgtctatgagccctatttccatctgtccttctatctgggccgcccctagcccagtccaactagcaactctgtccagagctcagtggatggaactgattccagcctggcaccagcagggaccatcttgggtcaggtgcttctggctagtgcttctggctcaagcctcctcggcccaacttcccctcagcgggctctgcaggagctgcaggtgatgctctcagcatctgtctccttgtttaaacaaaatgccctcatttttcttgtcttgagaagctgcgggctgcctctacccccgcagcccacagggtctcaccgatttattgttcgtttctttgctgtggaataaacctcgagcagccagttggctttttaccctttagatattttttagtcatcggctgaccacacacagataaagtccgttttgttacttcttccactctgtgtgccttgagaaccgctcatgtggtacaaccaattctggtgacaatcctgtgatttttttttttttttgcacctattaaatctctgtaagtcaattttctatgaggcagtcctgtgagtgtgctggtctctttggaagccttgtgttcttcttcccgagggacaggaaggtgggggtcaatgggtcttcaggg

SEQ ID NO: 34798 - DNA, 4569 bp, Mus musculus
tgtttaatactagccaatgcgtggtgtttccttagccagataaatagaggggccattggagagggcaagagaggaatgaacccactcagtattccataaagagcttatcgttttgtaccactgggcaaaaagaaagaaaataaaaacaaaatccaggcagaggcaaatgcatcagccctaaccctgctggatgaatcttgagggctctgcctttgtggatcagagaggaggactctcctgtctgttccttttagcaccttggttggagtgaacctatgctgggaagaccatccctagccctacaatattctaactgttgtcccatagggcacctaagaccttggggttgggtcattttggtgccacttagcatgttgaagaagcagagagagacagaattaacaagataggaattcatctgtccagtgggacttttctcatgagcactgttcctctaagagtgttaaaaagagctctttggctaataagccctttttcccccatttcatttcagttcagactacaaccacaggcacattggggaatgatacctcttagtccagatgggcttctgtcttggagatgagtctaaacttggaactagaaagtgatcagagttctgcctttcccagttttgctaccatctccttcctgtctctatcctatcctgtctcctcatcttgactgcccccaggagtataaacattcgcatcgcataggttcttgtttatctcaagacgcagtctttgtaccagtgtaggcttgagtctgcagtccctatcactaaagcaactggcaaacttcactttcttctgctgactttggccagcagggaatgagattggccctttctctgccagggtaccacagggacacatgccgggtagcctgagtatgacgccagtacttctggaaggacataaagaatactttaggttggagactctaaaggatgctgggcagagggtcagggctgaagcttcaagcagcaaaatttccaactcaagtttgtggtgtctaaggatattcctgccaccagaacgctgcttccttccctctcctgtgtcctacaggtgcaagccctgtaatccagcttgcctgatttctctgttctgtcacgccagaagcattggcaggttggtgagggtcctgaggtgctctggccacaggtaccatccatagctccaactcatgtgaccaaagggaaccacccagatgtggtccaggggcgtctccatcatctgcccacgggcctccttacttgagcagggagatgtcatcagcaaagtcatcgtgctggtggcgcaggcaacgcaggcagcgccactgacataccatgaggcagagtggcaacatgaagagggcgcagatggccgccatgacataggctatggtcataagtgttgactcatctgtctggggaatgttgtagccacagtcttccatgtctgccgtaacaaacggaccttccactgccgccgtcctgaactcatcgtgcactggagagagggtggagatgaaccggtagctcttactgtcatagagtagcttaggttatacaattaaaagagcttcctgacaggggccccttgggatccacccaagtgagactgcagagcccaacttggacagagcgagcagtaggcagggaagctagtactgagggaggctgtttctccttccagggcctcgggaactggactgcaagcctctcccattctcacatccagtagaggtgatatcaaagtcaacagttccaagttgaccaaaatctagctccttccacacatagcagacttacctgtcttcatgaaaatgcaaccacaaagccctggcccttttctgcagtagtactcagctttactgtgggcgggcagccacccttgcagctagtatttccaagtgcctgggaagctcgagctgctatcagtttccaatagtgctttccccaccaggcgtgttcaccagagcaagccttagccctagctctcacacatggttgattagccagaggcagctactactacctcccaaacaaagagatctgggtattagcagctgacagcaagaacatgagctgactgaccccacaccctcctcaccatggcaagcgctgacagcaaagccaattcgctttcgggctcgatcgaagacgacatagaaaccttccatgatgacggctcccataacagtgcccgtggatgactgtgagacagcgaacttgtaacagtcgtcttgggacgtggccacgtcctccaccggccgtaggtattgctaggggtaaacagtcacagggtgagagcatgtctgattcttcctgccttcctctgccttttagtctcctacactcttcctcaagccccaagatgtggattcttctgagacccctttaccaccacacattcgtttcatctttcaagttgtagcaagctatgtctctttacatactttgtctgctgcttggcaccccactgtctcagcttggggacatacctgaggaaggatggtgatgcggaaggactgattggtgacttcacccatgaggtaaagtgaaatgactgggaaaatgttccaaggggtcgtgcctgcttgccagcacaccagctgctcccctagccaaaagccatccgggaacttctccgtctgttgacaagagaggaatgtgaagcctcggcctatcccaccatgtcttctctgtgttcagaaccacagtgacagtaccactgtgtgcttttccagggaattttccaaagtagcaaaggtaaactgaagtctacggatcaggaggagaaagtgagatactggcctcataaagctgtgagtgggcatggtggctcacactgcctgtggtcccagaacttagaaggctaaggcatgaagttgtcaagttcaatgctaacctgggctacgttcatgaccccatctcaaaaaaaaaaaaaaaaaaaaaaaaggcatctcaatgccaagtcaacagagcagtggtttgtaagcgcctgatgggaaggatctacgtatctttagggcttgctgaggagtgtgactgtcactgaccgaggaggctgccttgatggacttgacggcagcttcaaatactttcttgggcaagcgaaggttggtggtcccactgtccacaatgctcttgtcgtagttgtactgaggagagagggggggagaggtgggaggggtgaatctgacagctaagcatcctactggggttggcatcttagctttcccattttgtatatgtgcgtccttgggcacgttgcttaacctctgtgtacctgttctcttgttctaaattgaagataataacagtgcctacctcaaaggttaccataaggattacataggtcaaaaggctgaaagcactaagtaggtcctggcagatcccaggcacttggtaagtactaacttcgtcaccttgtgcgggtaggtgttctctaaatctaaagcagaaatgccttgtgtggtatttgtaacttctagtacttttatgtagttattctcattcaccatacattataatggagagaagggtggctcagcacgcacaaagccatgagcttgagctctgatgctgcatggtggtatatgcctgtagagagacacttgagagtcagagaaaggaggaccaggagttcaaggtcatctttagctacctagcaagtctgaggtcagcgtgggctacataagatcctcaaaaaagccaaaaaagggggctgttgagataggtaagggcacctgctaccaagtctgatgacctgagttcaaccccagagagacctactagttactgaaaattgtcctctaacctccatacacaagctgtggcacatgccccatcctcatcccaataaatgtaaaacaaaatctagggaaagagaccctaagtgttggcatttgggtatgccaagcataacgactaacacttcatacattggctttgacctttacagtctgtgagaacgcttgtgtatttctacctctgccttgtagatgaggagtctggcactgtagtgaggagcctgagggcacttagtaacagcaggactctagtcaggtccaacctctgcctcacaaaagccttgcccaaggctgaagaggcagtgactagagtccagaaaggaactctttcatgttttcattactatacttaagtcatgtggtccaggctctgtgactgctctgccaggccccgcccttcaccttagggattgcctcgtgatcctgtgcttccaccctcatggctctcacacactgtgagactccccttatgctcacgagaatcccctccatcccattacctccttgcagtccatcttgagatcttgaccattgatttccacacgtacaatgatcacttcataataccactcccgccggatgggtgtgtaccagagactgcccgtgtatagcgagtggtcgataccaccaatgatctaaaagaaaaagagacagacacctatgtcctagcacagaaggagagcaagttacccaagactaaataataagatcagccatttcttggggtgccaagattctctctaatctcccatcatgccccatgca

SEQ ID NO: 34799 - DNA, 1291 bp, Mus musculus
ttatgtcagtaaaatccacagtccaagaacaacaaaatcaggttccatttctcccaccatcttctgtctactctgctttctagatagaaaagcacaattcacagatttttcccctgggccaagccaccatcccttgttgctactggtttagcctccactaagcactgaccagccaggcttgcaaagtgctcacccttccattcctctggtttcctaatctagctatcccctccccccaaaggttaaggcaattggttcaccaccaagtgatttggtgaccttaggtgagctccagacaggcactggggtgagatgtctgtgcaaaattacttgcagaataatcgtgggatgttggacttcatttatcaatcaagaacgctatgaaggatacattccctgtctagaatacagtggagacagtgagatgaaggaaggtggtacagttgtaagctatgctttgtggattcccatctggaggaagataggtttgccaccgccacttactgagttcttctggtttttatgtctgagacagctgtggctctgagaaccttgagtctttcccaatctttatctttactcctacaggaaatggttttaattaccttcttttttcagaattaaacaagtgttaattgagaaaaaatgcatctgggggaagggtaacatgctactgacaattgatgttttcccatcctgggactgggggtgcttattgagtctagcagtttctgttaggatagcaaagactttgtcctttctgagctaactaaattctcttgtttttctctgccttgcctatgagctcatggatgaattcttttctcttgccttattgtccaggttgattgataagcatgattaggggtggacttcccagggttaccttaaaatctttaagggggaatggcctgagtcttcctttttagaggtcaggtgacctcctttctttggttaatgaagtacttctgtcttcttgtctccagtttggtactacttgaacagaaaaaggtggcaaaatggaagtctacttcctttgtttatttcatgtggcagattcattcattcattttctgtcttaagattgctctctcccttcaactgtgcagcatccagcactagctatgtagtacctcactgtcacctgaaaactgtacattgaaagtgagcataaagaatgttgtgtttagttaaacatagtggcacaagcctgtaatcatggcatatgggaggtggacacacaggagggtcaggagttcaaggctagcctgagctacatgagaccatatct

SEQ ID NO: 34800 - DNA, 1166 bp, Mus musculus
agaaggccgaggacaaagcttagcaatgcatacttccctttctatgtgaagccctgggctccaccagtactgcagaaagaagcaagcaatgagggacaggaggttggctctaggccaggggttgtcaaaatagtccacaggccaaaggcagcctgatgtctgtttttataaacaaaattttattggcacacattggttatgtatcagctaggctattttcatacaatagaggccatatggtctgtaaagtctaaaatatttactctgctgttttacataaaaagttgacagactcttgctctagactgacaaatatctaagaccttgttttctgaggttcaagttcagaggggtctctgcagcaagtgggtaaagctggtctaggtcatgctatgatgtctagggtccctcagagtggaaggcctgcttagcacaaatgaagtaaagtaacttgctggctctttgttcttttctccacactctatactttagctctgcctcaacatggccaacaagggtccatcctacggcatgagccgagaagtgcagtccaaaattgagaagaagtatgacgaggagctggaggagcgactagtggagtggattgtagtgcagtgtggccctgatgtaggccgcccagatcgtgggcgcctgggcttccaggtgtggctgaagaatggtgtggtgagtaacccttgcgaagggaatctagggatgtgtatgccaccctacaaactgtgagacagactccctgagctgagtgttcagttgtgttctgtacctggcagattctgagcaaattggtgaacagcctgtatcctgagggatcgaagccagtgaaggtgcctgagaacccaccctccatggtctttaagcagatggaacaggtggctcaattcttgaaggcagctgaagattatggagtcatcaagactgacatgttccagactgttgacctctatgaaggtataaggaaaaaagggctggagccagtgggcgagtggagagcaagattatcagtcaaggagaaggaatatcaaaagccacaaccagctctgttgatgtgttcatagcaggaatgggatatgccaagagaacacatagcaaggggaccagcttggtggtacagcatttcccttctgggtacaagggcctgttttggatcc

SEQ ID NO: 34801 - DNA, 1595 bp, Mus musculus
ctccacccacccttaggttttgctgacgttggatgacgacttggacacagtacagcgggacaagatctatgtcttctagcagcatctgtggtccaggcttcacctcacaggcctagcgcctgcctctgcatcacctgccagttgccacaagaacaccacgggtatgagtcccagctctgctgcccagcattggatgtcgtggcaagacagcgagattccagcccaggcctgactcaggatagttcctggtggcactgagccttggagttgcctctgcggaggaggaggcctgctccgcattccccagacactggccaaattgctgctttcttctcagtgttgggtcctccccaggaccctagtctgtccatctgtcttgtttatccactggctctccatttgtccctttggagaggaaggtgggaaggcaatgtcctgtcccatttcatgccttgcattctgcccatcccttccctcctctcagcttaggacacacagccctttcttcttcccatgctctgtccaggaccacagtctggtgcctgattctttgtccatcaccaggacctaagctctccctgggtctgtagctggctgctatcactgcccactctgacctgccaggacagatgcaggtaggagactttgggggctggccagctggtgccaggctttcggtgctaaggcctgcaaggggcctaggtacgaccctcctccctgacctgtgcttggagctggctcttcagcagtgagggccagcccaagttgagtcttctgatcggggactgaattcagaggccacctcatcccaccagccactagaatgatgccagcactagggttggtgggaagtggcaactcactgtccccttccacaccctcagtcctgccaagccccagatgggggcctctcagtgccattgacactgcccaagaatgtctagaggccacggaacggtgccaagcacacagtcccttttgcctctttcacgggagcaggagtcccagtgcctgtcgtggaaagggaggaacatgccaggtccctgtgtgtccttggccctgtctcaccaaaggactcagggctggtttctgagtttccgtccagtatttagccaagttctgtgttagtcacgtaggcctaagagccttggcgtttacagagtcacccagctctggcccctggccattctggtccttggcgtttacagagtcacccagctccaggcccctggccactttggtacttggttgcccttcactccaccaggtccattccagatgccaagagtgggccccaggaatgtgtttccttctctccaccatgtttttatagctcttgggctgggagaagaggcgggtctgggtctttgtttctgagctttgttctatgttcctccatgctacggttgcaattgttttctatgaacgagtacattcaataaagacaaccagacctgggatttggggtcttactgatgtgttgggaggtgcaggagcctccgtgtcccatttattttggccttcccgtctcgtttctgtgcgtggctacattgggaatgaccttccttgatcccaccaagccacccattgattct

SEQ ID NO: 34802 - DNA, 3397 bp, Mus musculus
cagaccaccattgcttgactggcccatcagtgttacagcatcccgcttcctcagatcagttagaccactggcactacagaatcctttcttaaggcactttgcattgtacaatgttcctggatgcttgtatgtttgaaggggaggagggatttaaattggtcctgtatataaaggttttgtttgagaggagaaaaattagccaaggaagattcatttgaaaccagaaggggactttttagttgtttatgacacatttgtagaattatcacttttccctaggacaacatcaagcaagagtacaatatgaagattcttttcttggcccttttttctatggattatgtcatgtgtgataattatcacatctacttggctttaaacttatttttggtccagttttaaggttcataagttagtatgttgtgttgttttgtttgattcatgtatcctcagtatttttattaacacatagcatcagattaaacatgcttgtcactccaatatgggagatgctatagttacaagtgagtttgttcctctcaatcttaagcagtgaaaacaaggtctagggactgtgggatattgtttttattgctgctgattatcatgtctgtaatagacccgtgcatgcagccttccctctgcctccccctcatctcctcacaggtgggttatttacattacaaacttttaactcatttttgatctaggacatgcactgccgtcaggacggtcttactgatggataactcattctgtgtggtgttctgtgatgtagggtctgtgtaatgttcatcatccagagttctgcttgtcatcccctccccccccaacctgttgtttttctttgttttgggtgtaggggtggtcagaattgtttcccattccataatgcctgatgttattttcaagttttatattatcttaaggtgtatatgtttgttttcgttttatatatattatatataaatagatctattttacagtactggaatcaaacccaggacctagcacatactaagcaagtactctgccactgtttgcttgcttgcttgttttttttaattcttaaattctgtcagcaaaaaaaaagttttttttccatgggaaacagggaagctgctctcacaatagatgtactatccttatcattttttttccttttttgtttttgtttttcaagacagggtttctctgtatagtcctgactggcctgaagctctgtaaatcaggctggccttcaatttagagatcacttgtctctgcctcccaagcgctggaattaaaggcgtgcgccaccacacctgctttagctttgctatctttattctaccattttaataaaggtaaactaagttcctgttttggtctttgagacagggtctcatagtgtagctctgcctagcctggaatttacattgtaggccaggctagtgttgaactcacagagatctgcctgcctctggactcctgaagactgacagtaaaggcatgcatgtattaccatggaggtagctcattgatcttttaaggttcctcatataatttaatgtctttatcaagattttaagagagctctttacattcctactggtttgcttgagctatacaaactgccacttgagagaacaatagattattggtcatccaatatgcctatggacccgtataaactggatctacaaacattttaactggaccaggttggggattgaagtaattcattaaatgtgctctgcaaagattttgcttaatggttacattcggtagctatgatctaggtttttatgttctgccttcagagcagccatcagggctggtagaggagctattgttggtttgtgctgagacctgcacctgactgagaaagatagaagttgaggtggttttttcctggtgagcatctgtgtaggaatttaaggcatagtgttatgaatgtatcatgtcttcattagcaacaggaaaatatacacggtgtttactaaaattgtttactacagtaaaattcccttttatttttttagtagtccaagttcttgagtttttcaagacagattgttttctgaaccgagctatcattttaggaaggagagttaattaagccagaattttgtgtgtaaaaagagcattttttacccaggtgtttgtgtgttcctcggagagtgggagtatggtccaagtgaatccattcggtcactcccgtagcatgcccttgtagtttctcttgaccaaggatgaactagtcctgtgagctggccgtcagctcctgcatatgtgtataaacctcagatgttactacgttttatacctaccagagctcttcaagcaatagtatttgaaccactagccttttaaataaaactctgtcctattgctaacatgcagatatggagtccactgtcatttcttgccaggtttatttgtgctggtttaggggtaaaattgttaaaattgttggtcagtttttctttggttgacatcccagattgcttcagtgacaaactggttagtctttgtgtgtttttaaagacgtgaacagaactactttgccattggctaagggcctggcagccagcagagacactgctttgttttggttttttggtaggtggggtggtgatgttcttaggcagagtctacagtaccctggctgtccttgaactttggtgatcctcctgtctctgtctctccagtactggaattacaggcctatttcaccatgcttgacttattctgttcctttcccaacatttttcttctcttgagacagggtctcagtgtagtacagtctgtcttaccatgagctgtggatgcccttgaactcggtccttctgcgccatgtctctactgtagcaggttggagatgccctggcattgtagattaccattggcagtgctctggccaccatgtcaggtctgctaggattgttgaggacttctatccaatcctgatacttctgtcaaaaacctcacccagcaaaataagtcttgactagctagctcatggccagttctttaaagaattataattcattgttttaaaaagtcccaatttctgtttgcattttcaatttaatcacttaacagttgtatgctgtgtctgaaacctgtctgtgctaaggtgtgtgaatattgccagttttctatttattacagtgatgaagaaactagaaacttaggaaaggggagcacagccagctcctgactctgagcagcttgtgtgggaacaatgagtgggggcttgccagtgagcttcctctccgggaccactgcagcaggctgactgaacctccccaagggagcttgtgactatgctttggcaaaggcttcctgactagaatccattctgtccagtgctcatttaatataaaagtcaacatttcactgcaaacttact

SEQ ID NO: 34803 - DNA, 1186 bp, Mus musculus
gagatggctcagccattaagaacatttgctacttaattatgagaagcagagttcagatctagcacacagttgggtggttcacaaaacacctgaatctccagcttcagggctaggatgccctcttgtggctcccttattcactcttatgaactcgcaagcacatgccaacctaaagtaaaatgagagagagagagagagagagagagagagaaattaatttagcacatacctgtcttcccagcacacttggaagttagagacagaagtatgctgaaattcaaggctagcctggggtattcaaaatagtttttttaaatagatagatagagatagctgggtgtagtggcacatacgtttactacaatacttgtgtagaggcatgtggatggatctcttgagtttgaaaccctcttgttctatatcttgagttctaggccagtcaggaccaggtagtgagacctgtctcaaaaacaacagcaaaaacttgagtagtgtaacaaatacatagctgtacaaagaaaaatgaatctagaaaatgtcataatagaagtttgcatctgtgtgtctgtggacaacttataagagttggttctctccttctaccatttgagttctaggattcaaacttaagttaggctgtaaggcctttgcctaatactaggtcatctcgatggccccataaatgctttgttttttcttttctttttttcctaattatttgaggaaaagatagaatgcttgtggttgctgctgttgttgttttaataatatgaaacattgtgatattctggatttgttagaattgtgactatcttgaaccttaacctaatagaatgatcagtatgatataggtagaaattaatttgcagtcagctccagaaaaaagaataagctttaggtaaactaaaaaggatggatggtttggttacagtattggggatggatctctgggccttgctcataaagaatgttttatagtacctggtcagacagctggtttttttaggccaacaaattgtgaaaggaaagaaatactaatttcttgtttttcttttttctttaaaccagcataataggtttgttctggactgtaaagacaaagaaccagatgtgctgtttgtgggggactccatggtacagctaatgcagcagtacgaggtaaagcagagggtatccttgactccta

SEQ ID NO: 34804 - DNA, 1114 bp, Mus musculus
acatttctttttaaaaattatgtcaagccagcctgacacccagagtctgattcctggaacccacatgatggaaggagaggaccaatatgtcttccgacctccatactttctctgtggcacaagcttacacacacacacacacacacacacacacacacacacagtaaatagacaagtgtttttgagattcattgtgtctatggaagcatttctaatatcaagggaaaggggtgccaagcaaaactgtgctcatttctggaaggccccaccataggctccttcagtaaattccccagctggtggggtatttgggaaaggtggttagaccaggagtgcctttggagagtgaggtccctgggcctcttctgttcacaatgagatgaagagcctcctctgtctgccctgtgctacccaaacaccatgtcaagcagctggaagcttcttcccttatagcatcctctcagtcattttcgtcacagccagacagaaataataatccagtccctattggacttcttgtctccttccgcatcactcttgtctcggctcctatcctagcctgagatggccatttctgctacctaatgcataacctttacatttttattgttacttagcattagacatatatgtctgttatttgtatattgttgacaattgaaagagggtctagctttgttacccagaatggcctcagactcataatcctcctgccttggtcccttgagtgctagcattatagatgtgtaacaggaagcctagcctttcctcatttttataatgttccctccttccccgacttttgaaagtttctggctattctgagtattttctttttaaaattaccatcgccatattaccatctaaatgaatggttgagtgttgagatcttcctgatgttttgtgtgaggtggatctcatggtttcctctgagctgggtttggcgtgtgcctttgctgctctcatctcgtggtttatatcatccttcaagcaatggtgcctgcattgagaaagttatttccaagaaactttctggtttgaatatttcctggctctgtgttgagttaatatttttaatgcattctctaggtttagtgagaattgtcccccctaa

SEQ ID NO: 34805 - DNA, 1198 bp, Mus musculus
tagtagactgccaaacggccttccctagagctgggctgtgttgttgtaaataagagttcttactgctgcccgacttgcggcttttgcctgattagcctgtggggcgtggtcccctttcacatgtgtgtggtgttcctttcatgtgtagttctgaagtctgtgatcctgaacatccttgtataggtgtctcatcaggtcttcattttttattcctctccaacaaaatctcatagtgtttttccaagctgcctttgaactcctgggcttacacagtcctgcctcagtctcctgaggatctggaattgctcgtttatttattagggtttttcactgtcttctaaaccccattgtttcttactgcttctgagatccattccttctgtcccctaagtatactcttagtcatctctgccagatttttcgttctctcttaagccttacatctcctcttacccaaatgagctgtctgagccatctcgtttactgccatggcttcaccgatcccttttggggactgctcccaattaactgtctccaaattctctcctgaggtctagggccacaaatatccatccatttgctatttagcatctttaaaaaaattattttccttgttttgtagtactgagactcgaacccagaaccttgagtatgttaggtgggcaccctgcccctgaactacaacctgttactcagtgtcttcctttaacatcttgaaatcacattcactgaagcattttccaaaatgaactttattccctatccacagttttgctctatttggtgtccctggtgtccccgtctgaggcttggcagaaacaagtcttgattgtttcttctcttatcaccaccagagccaactggttagtaaaggctgtgcagtcagtctgctattccagtaaccatgctgtcatcttctcttgcctaagttagactttgtcaaatctgtggatgctgagttccatccttgtcttctccatgtttctgcgtgaccttggcagacacgaataataaaaactacacctcacatgcaaacctcacaggtacacgcatacaaacgcacaaatctgatgatatcattttatagtttaaaaatgtttcagcagtttaacattgccctaaagtttactgctaatgtgtctaaagcactgaaattcaagaatttttactacagccatgataaaaaaacatactttat

SEQ ID NO: 34806 - DNA, 1335 bp, Mus musculus
tcagtcgtgcacttacgattgtctgctcgtttttctctaaacaaaggcaaagaccacagctatgaatgcgcagctggtcctaaaggaggcctcgagtattagatgaacaagcacatgcctgtgaacaagggaagaaatccagatatagcacctgagcccgatggagctggaaagcaagatggaagaaagtcctctctagccaccgttctagggaagcctttgaaataagaacattaacaagacccttggcctcagtccagttaccagagttgagggcatcacagaataagctgtcaccctgagcctttccttcctgtctctctgcaggcagtgccagcagttacccctgtggatgaggagagctcggatggggagccagatcaggaagctgtgcagaggtaatgtggcacctggcagtgcttgcagaacgtccttgggcaggctcccctgcaaccagcgaaaggtcacctctgcccagggaggtggtgcagtgcagcttcaacacttgtgtggtctctttgctcaagccagatggcatgttcctccccacacggaagtaacagaagactgcccagaaaatttcatttctataagcgccattggaagccccttaagtgacagcaatacccttaagaacgctttctctcctccctccctcttccttgtccccgcgttcatattgcaactttggtagtgttcaggcctaacgcctgctcctccctgccacgaactgtttactgaaaaggagttggagattggagatgacagtgatcctagctagtctggccatggacctctggcatggactcatccgtcccaggagaatgaatgaatgaatatctcctgcactgtttgctgtgtgtttcctccactcccttgtaccaacactgagatattgggaagaaaaaacaaacatgggggttggggggaggggcagggacagttgtaaatatccattgtttgcagaaccttgttgagagatgcctgattcacagagcgacagtgaccatcaggtgtgctgtgcagtccgatggcctcagttccagtagccatggtctgcagctccatgcatgcccccttgtggagttgtctttcttattttctgtgaaggggttttcaccagaatccagcatgtattttcccagaaatacaggtgttcttcaagattatatgttttcccttgagggaagttgaaataaaatggttttcatgggctctcggggaaactgtgggtgtttttatcaatggacattaaccacagatggcttctttaagcaagtttgcatactacaaattacagtctgatgacagcttttaactgacgtaggcaatgta

SEQ ID NO: 34807 - DNA, 2034 bp, Mus musculus
cctgctggcctctactagaatcctatctggcccagcagaattccatcagatcccagcacaggccggatggcctggtgctgaaggtttgccatccagaatagctcagtgtaggcccctctggtgtgtggtccagttcccctccagtcaccaactggttccccctcatgagtgaacacccaggagtggtgcactgtgctgtttgtgtgatctccattcttattctctactgcgttgtaaaaagggccgttggtccatttgtgtgcacacgtatgagtgtgtacatgcccttccctgcggcctctttgtcacagacaagaattggaggctgtactgggtctcttaaccttctcctctccccagcatcctcggcccctatattttaattcttgatcatgtaggaattgtttttgataaatgttgatattattgttattattgttattattaataaagacaaaaaggattttgtttatttgtttaaaagagaaatgtttaaccagattctgtgctgttgaactgtggcttgcaacttctgtttgaagtgttttccttggctttggcatcgtgagccactctcctgtgccagcagcggatgcagtggcctcccttccccagccgaagcagcacataggcagtggctactgtccttgtcacttcctttctctctgcagtcagaaaccaaagtctggggccaaacgaggccggcccggcttctcttctggtcttcaaaaccagagagggatggtccctgctctgactcccagccctcatttctgagagccaggggccaccaacctctgagtatgcacagaagaaagccgctgcctgccatggcatctggacattaccagcagggtccctagccattttatccttccgcaccaaccctgaaagcttgcctctttgaacaaatccattgtctcttgaatggatttgttttcaatgtgagagcttggctggggacctgtttcgtggtcccatgtcctccaatttcccctccacttcaggtgtcactaattactagccagaagatgtctgactcccaagaaagcttgacaagccattgtcagcttccaagctcagtccagctctgatactccagccccgccctgctgctccccacgctcagcctgacctgtttacgtggtactggattgatggaagagcaggcaccaccctccagagccacccagacgaaagccagtgagcctattaaccgtgccatcttgcgaactattttcaagatcaccattgctttatattgtagtaaccaatatgcgcagtatatgttgaatgtatatgaatctactttgctatttctgttctttgaaaatgtaagaagtatttttcctttctcatttctgttgatctaaaaatgataataataataataatctccagattcaagttgctaagagcttttgtccttgtttgtgtgggacatctacaacttagtgacttggttggactgtaggaggttgtggaaataaaaacctgattatgtactaacgctgatatgttgtttgccttacggttcagagtctaattgagagaatcacatggggtaggggcagaggtgacccaggtgtctggagaagtccccagacttagggtggggcttggagcagcacattctcaccttgccttttggcctctgaacctggcaaatcagactcacactgtgtccaggcatccgtgtggactctaacccctcagaagggacacatttgtgtttgcagagttgggtgggaaaaggattccttggggtcctcagaaggagagccttgcattgaccctggctggaacctttatgaggtggcctccctcagctgtaggacagaagggcttttggtactgtttcccaatgtctgttcctggattccaggtggagggcagaatttccaacagggccccaggctctgctgaaagagctgaagtcacacgagaaaaaagatcaatgatctggggaatacggagatttgtagaaagagtgacagaggctggaaggatggctcagtggttaagagcaccaac

SEQ ID NO: 34808 - DNA, 1099 bp, Mus musculus
gttggagggttggggtgtggggtgtactgccaagtctgcagttttcatcctgttcctgacaggcagtggaaggtgccatcgcagagagaattgatgagttcattggcaaactgaaggacctaaagcaaatggcttcccctttcacactggtaagtactgggctactgcagccactttcagtgtaaggaggaggcgagcatcccttggcactgactgatgctggtaaccatggagcttggcaagtggaagaggtaagaagatcaagagtttggactcatccttgacttcatagcacggtataggccaggctaggctatgctgaagcccaacctaaagataaaaaagtggagcaggatttttctagtgtgttctggcgctggatggaagttatatatggtttatcttactctctcctctcttatttgtcaggtcattgatgatccctcgggaaacagctttgtagaaaacccacatgctccccagaaagataatgccttggtgatcacatactatgaccgaaccccacagcaagctgagatgctggggctccaagtaagtggactgattaagtcagagggatgctctggggctgccctgtgttctgggtcctgaagtcactgaagtcactttgctattgctgccaccatcatccaatgcatcctgtctcggccttttatcacgctcacaaagcaggtgtcagtcacaggaacccagccttgagccccgtctttctcttgtctggggatttgctttggcttctctatccatctgtcctttgaggtgtcctttggtaccttacagggaacaaaggcattctctccctctttaagtagggcagggctctactgtaggctgaggtctatctgccaacttgtggtttgggcctctgttctttcaggcagaagcaccagaggagaaggcggaagaggaagaccttagaaacgaagtgagtggtgctggctccctttgaagaccatagtggagttgtgggtagagactgacgaatgtccagtgtgtcaccatcacagctcacatgggtgaccacctgcgggatgtcttcagctcgaaggggtggggatgctcagtctgtgcccctata

SEQ ID NO: 34809 - DNA, 1292 bp, Mus musculus
gcaatcaccaactttggctacattttttataggaaggcccatatataaaagtacttagaactgggggttaaacacttgtatgcatgtacaggggcttgggtttgatactagcatacacacacacacacacacacacacacacacacttttgcagaatgtagccgtgggctctagagaccctgcaaatcctgtgcatttcttcggaggttgagagtcagccgtgggaggggatggcgggctgcacaggcgctgaccgtcgtctgtctgctcttggccctgcagaatgtgtatgcacctgaagacgatccagagatgaaggtcgagcggtacaaacgcacctttgaccaaaatgaggagctcgggctcaatgacatgaagacagagggctatgaggcgggcctggccccacagcggtagcagtggccagctcactggccagctacagtgccactcacactgcagggttatctgttactgtggggaactgacgaggagtgctcaagccctcgtccatggtgaagaggttaccacttgagttagaaatgtaagcacccaagattagcagctgacggacgaggcagctgcagccctactgtgctccttgaccttcttttggaggttttaaagtcggcgtgagaagaatcccagaaacaccaggcggtctgccatcaccgtttgcctgtcagctctctgacctccagtgctggacctttgaagtctggggaagtgaaatacaagtttctgctggctctgggcatgtgaagtactgactcagcagggaaggatgtcggaggggccgagcaggcacaggtgaagacgccacattaaagtgatggcctttaaacgacacccgcctctgcgttcatgtccttactgattaccatgtgctagactaagctgggtcacactgagtcacactcagctccgaggagactgaggacagcttgggccatgcagtgagagtccgtcttcatgaaaagaaatgaggaaggaaaaaccagtttagtttcctaagcaaatctttcttgaggtggctgctgtagaggcagcatttgattcactccaataggccatcctgtctgctctgagccaggtacacctgtgtggagtctagctgttctcatgcagcttaaagcagtctggaaaagcagggtggcacacacctttaatcccagcagaggcaggtggttctatgagtttgaagccgatttggtctacagaggaagttccaggacagcctgggctacacagaaaaaccctgattcaagacaaaacgaattcaaactggataa

SEQ ID NO: 34810 - DNA, 1106 bp, Mus musculus
ggcattaaaccttctttttcttaccataattcttcaaagacatatccttatcaatatgacctactgtcaagttaataacgatttgatggcaatatccaagagaaatgacacctttgtaatacaaatttggccagtgtattaatgcatggtatatggctggtattatccaagaagaaaagccgagttcatcagtttgagtttctcctggaattaggtggtgaatgcttcaagtatcctattttaaaacaattgcatctagattctgcctgcaggattgcttatttcattattctggtcatttgcatgaaaacaagttgatgattccttaaataacctgtcggttcggttttcttttcacccaggattgttattcctcaagtgccctcatccagtcatgcaggagcaggaactcaatcaaaaaactttgaaatttagagtaaggtagtaacagactttttcttcatttattttttggccaaaaaatgatctcccattttcatattaatttacctatgatttacacctctgtcctcccttcagcagctgggagcatacagagatatattttaatagaacatttcccaaagttttaggcatctaaaaaatgaggtcatcatcttcaagattttggcctgaacatctcatgaaggaagggagcgtgaaaggagacgtaggaaggggtcctagtatgtaatatcctcataatggaataacgatcaaagcgaaattcctttttcaacatttgtctggagcaaagtaatttgatttccgaaggagaagccctctgtttctgtatgtgtcaggtacttcctggagaaagtgtgctttgctttttacttgtttgtcttgttttattttagtttaaagtttcttaccagtggcttaaacaaaaggatgcttttacattcaaaacagcaggccagagagcggagctgtgtgctggcaatcatgctgtctaggctgtcccctataggtagtgatgaggagtgtgtgtctgtctggcattttctttcttcctatttgctttgggctcccacgagatgttgctgtggctgcagcagagagctggaggagttgagcttttccttcacttggcatatgggact

SEQ ID NO: 34811 - DNA, 1197 bp, Mus musculus
gcagcgcctgcactacactgagtactctgtaagcactagctgtcactgtcgtgggggagtggatgaagtgcctcctataaaatgttagtgattgtacttagacgtaattataattacagaagtgcaaaccagagtgtctagaagagttcactctgacacagctgtttacttcttaggcggggctctaatgctacggtaaagtgtctatgtctttcttagtttgagtgtccgcattgtcttagggacatgtgaggactctactttaaatgaaaaaaaaaaaaaaagacccaaaacaaacaaacaaaccccctgcagcctgggtatgatttctatttctaaaaactcaaaaccaacatcaggactacagcagcgttccatgtgccagaaagattcatccacacagaggcaggcattctggtggggtcaaaggtacagtagccattaggagaagggagttttgttaatttccttctttagaaattatagttttcctgataggattttcacgagtgagacaaacgttctgttggtgaagttcagtggttttcttgtgggtttggcaaatcacctgtaccaggaaccctttcctgattgcatggagatgagactctggttggcttcaagccttttccttgccaacagtcctgcctcatctcacacaatggagaactgagaacacaagattgaccctgtgctgtttatagtctttatttataattttctctgcagcttgatttttttttcagtgagaaaagcattttttttaaatgtggaaaacctactaaaatgttggtaaatactagaaatgggattaaattttccagcattttgaattaacattaagatatggatgtggctcttcgatagataccatgtatagaatgttcttgtagtccttggggctctacctcacaaaatatggggttgcattatgaaatttgcatagcatcccatgttttctttgctcatgtttcccccaggcatttttctctctgtcctctgattctctttcctcctttgcatttttttccttcgatttcaagtgtgttacaggcaggaggaaaaagtccctttctctattaaagccacaggctgtgtatgacactgtaatgaaattagatactcagaggaatctattcacttttaatttctgatggctataatcaacatgaaaagcttttcttaataattaatgtt

SEQ ID NO: 34812 - DNA, 1174 bp, Mus musculus
ttaacagcgtggtcagaaccgcagaggcctcaccagctgacatgccaacatgggctgagaaaaatttcataaggtcccacctgtaggtgaagttatgaacactctttgtggttgctgaagtgggagagaaccagtttggttatttgtttgtttgcttggttggttttgttttaggaaagcaccccagtcctaagtggttagcgccaaacacatgcaaaacatgagaatgctagttggactctgaaggtgtgagtgtctgtgtgtgtgtgtctgtgtgtgtgtgtgtgtgtgtgttggaggacatgagaggtgttggagcagcgagagaaagggtcaatgtaaatgcagtgtattttctggaaacccttcagcaactcagaacataaaggacaaaagtgaggaggaagcctatgaaggtggagtctgcatcttgaatgaccgtgacgtcaggttcctagtgtgacctctctagctgccttgtttcctgtggactgcagtagctcagagcagacagctggccagccacagtgcagctgtttattgagcaaagaggattgtcttcctatttactttgactcgctatttttggaaggaagttgatgttttttaaaaattgtaacattatatggttagaatagagaaagaaggggaaagtgctcacaaactatgtcctgagggggctgtccattcttttcatttactaagttgtgtttctaagtgtgatcggattctgtaaacatatctaaacactgcttgttgttttgttgaatctacacagtacaatcaagttaatgggtcagtcagtttaaaacaagagtactttcagacgtgttgtgctcatcaacagcactgtgtcagacatcgttgggtctcttttctgtatacacctgtgggatggtcacaggaacaaggttgagattagcaatgcagtggatggtattccaaagtctctagaccacatgggaggggagcttaagcacaaaaacaaaacttgtgtttgaagcagccgcttttgacctaggggaacttgtagcagtagggagagcccctgaaccatataagaataagttgcactcctcaagcccctttgcctacaaatacttcaaagtgtatttccaaagagcgccatttcctcctctatagtaccgttattagctttgggcactttaacata

SEQ ID NO: 34813 - DNA, 1128 bp, Mus musculus
aggaatttgtaactatcgcatgatagatactccctaagtatttatgaatgttattacaattccccggcctctaacttaatatcatggatcttttggggctctttcccagttacctcccataaggttaatgattataattttcataacattttttgttcaaagtccattcatttctaatgtgaacattaaacattatgaaatgttaaagactcctgtcttgatgaataaattctcatctttgcattgccaagttgtagttgagatttctgcatacccagggagggctttgattgaagcataacactagaaagcatgtgatatataaacacacacctcactaagaaaaacgtcacaaggtaaacacacaagtgaccattattcaaatcaagaagtagaactttaccagcaccccagaattctccctcatggcttcttaaaattactgcttttcttctctttccaaagataacccagacttgaactttaatgctacagttgtgtgtttttgtttttgacattttaaatttccttattgtggaaaatgtcaaacatacaaaaacagaaggacttgtatattgagccctcatgttcccttcagtcaacgtcaacaattattaacttgtgcccagtgttatttcatctataatatcacctgttcacccaccacaggtcactttacaaaactctagaccttataacatctcatctataagtatttcagtatatacctctgaaagggaggctctgtatagaaggtgaccatagttctatattcatacgtaaatagacataatctctgttcatgccaacaacatttagccaacatctaaaatttttatagttatatcataattattgatctgaaaacatattttcgtttggttgaaccaaaagccaaaaaaagtccataatttaactactgttaagtatgtcaagtgtcttttaacttatagtttctaactccaccttccttttcctgtattatgtatttgtttaggaaactggacctgtcctgcagtgttgcatgcagtctgattgtgtcctcctgaagctgttctgcatatttctttgttttgatttcctgcaagtcagatgtctattaaattcagatttaattttcactttagt

SEQ ID NO: 34814 - DNA, 1201 bp, Mus musculus
tgggcttcatatgcccctccacatgataatcctctagacggagattcatttagagcaccccaaacatcacttagcagagaatgaaaagcattgttgagccaatattgttacctttccctgtaagcatatataaatagctacagctgaaaactgataaaaatttaattttcacgattgttctctgttttcttcttctaatgaaaagccagagatagttgagtaaattctaatgaaactattatttactttggtacatgctagcattgatctattatactactctgtttattatgtatgtgctgtggtgattgattataatgctgttttaaaatttccagagcagagagcacttgttctccaatgtgaggtgaagtcgggaagacagacagccactgagatttgcgccacttgagtccagtgctgactgtgacaggcatctaagactgtggagttacctggatgggtttggccctattaaagacattaaataaacagaagcccattctgtattttttggtcaggttctgatgtgtggagcccgtgctggtctcagtcaccaggcagtcctctctccgtagcctctcccatgctggggctgcagcctctgctccccactcccctccctcacttagtttttaaaactttctgagctttaattgggtcttaggtagccgaggatgacctggaatccttgcttataaatgctgcgattgttggatcttgtagttctcgttacaggatactgtagtgtagctcaggctagtctcaaactttcagtcctcctggctccagcatctaagtgctacagttacaggtatgtacgtttcacttgctccgtttttctctattctaggaaatgtgtgggagctttaaaaaaaatggtgccgacaatgttaattgggagggttttaggattgagtactgatgaaatgttaggaccacatttgaaaggataagttggcttagaaatgagtttacaaagtaaacaattggagaacaggaggtttttgagactgaggtgaacgtgtaagaataaggggcacatcttaaagttgactaagcaggcagggtcacagatgtatttaaaatgctgacatgccgacccagggtcatttggttttggtctcagtgagaggtgtagatccccaagaacggcagcctttccctctgtggggtgagcacagccttcagccttcctagt

SEQ ID NO: 34815 - DNA, 1611 bp, Mus musculus
tatacagagcaatgaaaagaatacagattgaccaaaaatcctttcacttttccctccagccattttcccacctaaggttccttgataagtaatcctgagtttgtgaaacaggcccagtcaagtcactatctatgtaactccaaagtatctgaggctaggtgaggcacacctgtccaagtgtgatccaaccctggagcacccatgctcctttcagagaatccatgaactcaacctgatcctgagactcctagtgtgtcagtgtccgtacagaagcagcggtgcagtttacacgtcactaacccgagtcatctcagtggcaccagactgtcccaagattcctgtgcttttcacacacagtacaaatgaatgtcccgatgaaccagaagagagtgattacttctatcagctcttggcctgtgtgtttctagaagtttatgaagtcgaggggcacaaaggcttccctggtcatctgggaaggagcgctgatgtgtttgcgttgtaaatggaactaactcggaaatccatggaacatcattcactgtttctcaatagtgataaccaccctggctattaaggcatgggtgttaggcagatgtttttggaaaataaaatgagcctgtcgtttctagggaataatgggcgatgtgtattgtcagcaacaacattcaagctttgaatggaaaataagaattattaaaaagcttcacccaccacttcgcacttgatagattttctaagacgtagagacaactctcctgagagaggtggccatagtgatgccatgatgctgagttatggaacatgccagaagaactgtgcagcccagtgaatggctgatttctaaatgactatagtatgatgctaaaattcacaggtgggtaaaaaattcatggacagaggtgcaacagtggccagctgactgacttccctgtgaccgcatggaaagttccctgtcatggcttcaggtactacaccctgactatccattataaagccaacaattgcggatttcagtctagcatcagtacccatcaccatcaccaggaactactaagccctcttcccggttccaaccacatagctgtgtgaggctggtgctttttatattgctgaacacaaacagctcatggcaacaggctaaaacggcaaacatgggaagccaggtgtcttctagtaaaccaaacactaagagacttgccaagacttcctttccctaatctcatcccttggaaaatgtagctgtttgtgctaaaatgtctttgatagcatgtaatggatttgttatatcttaattggattagtaagaatcaatttcttgttttgatttctaatgtgatgacagtctatatgcatagcccaagtaaacaaatttctttgaggccctcaattaactttaaatttaaaaatgactctgacccccaagatgtgcaagccacacctctaatgtagtcctgttagatttatgattgttctggcctgccagtgcgtgagagtgccatctgctgacagaatagggaagtacaggtgctttttgaaaagcacagctggaagtcttggatgatttctgaaacttcttgttggaaatttatcaagggaaaaagacatcaactc

SEQ ID NO: 34816 - DNA, 1197 bp, Mus musculus
cacttgtccttaaaagccacacaatgtagcaaaccttccatactaagcgttaaaactagtatcttattcatgctcatgtctgatgaattaatatgggttttgagagaacataattttccagggacttctgagagtgcctgggtttaaggaaaaaaaaaaatcaacaacaacaacaacaaaaaaactgggtccctacagtggcttcatagtaaagctacaagggtaattgtgtttgtgtgtggtgtgtgtgtgtgttttccgaagtatgggcttttgtggtgggtcaaaactcccaatagaaaatatcgttgtatttttagttggtgttgctcaggcagaggacacaggaactatatccccccttcaggggggatgggacaactgcagtatttacatagtctgttctcattcctgtttggtttggtggcattttgattcacttatttattttttaactagtgtgagatttgtgtttgatgttccatggcatctgtacaggcgccataacacgacagaggtggtaagtgctctcagacaccgggcgggcgggcgggcgggcgggcgggcgatggagattcttaagtgaagcagacttctcacgcactgtcctcaggatgtgtgtggacctgagctggcacatagcttctacccagcaccgccctcgtctggcttccctcattttctcagaacaaatcaaggacttttggtagttctccaggacataaatgcatcgtgtcccattcggtcctattgtggtcctatctgtcacagcaacactaattataaaaattgaacgtaaatttgtgctgtttaataggtttgggtttaattttgcctcagtgggaagacatttgattaaaagagtcttttttcccctcctccttcctccttttttcttttcgtagaacagttagtaaaggcgtaggaaattgatttcagtgtcacaaaggacatttctgacaggaatgtactttgaaatgattcaaggcatctgtttctctcaaatgtgcccaacactgctgagagctgtacctaaattaaactgtttaacgtgtcagctcagaatccgatcacaatttacatcccagtggcttggctggagtctccaccatttcatgaactccctcccctaatttactaaacaagttctcgctcaaagtgaccatttgttctagatgccaatatgtcacggtcgga

SEQ ID NO: 34817 - DNA, 1150 bp, Mus musculus
ccagatcgccctgacctatgacgttgccatcttgttacctaaggtaacactgttaggggtggggagaaagggaaaggatgatgatctgctttgtctcccgcaggcaaatcagaggtggaggagtggtcggacatgtacactgtgaccagtcagctgatgctgaaggtgcacaaggaggacgacggggtcccggtgatctgccaggtggagcaccctgcggtcactggaaacctgcagacccagcgctatctagaagtgcagtgtgagtagccgagcaccttgttttgaggcctgtgcttggaagctccttcccttgaagtccgtatgcaatctgtatggtgtacgagggttgttcctctgttgttctggtagaagagtgatcaaaagatcatcctgctgaagggctactgtaataccaagtgccaatgagaacgtgaagatactgcggccaactcaaacatgaagctaaagcagtgccagtctgctttaatgtggcttaaaatcggcttctttccgtgttcactgtcatcattcctgggccaacaaagtcttcagtgattccccctccctctctaatccaccgtaaaccggatgtttacaattttattcccatttcttactaacattttgttctaaggtttatgttctatgtagctttagttagaaaaaggtgttgaaagttaaagtcgatccgtaattctgcacggtagcgagactgtccctagccatcccctgtaaaccagagaagagggtctccttgtcttctcctccaggcccttctgcttcagaggcagagggtggagggatctttccgtccaaagccgtgctccatccaagactgtgaccacatgaccctctgctctcacttttctccagaagattcctcctgtaggctggcctgtggcggtccgaggatacagtggaatgggtctagtgggtggtggtgtgaggatttgggtgggtgagcagtgattagggatctgattggggaaaggcattgccaactgtgggagttcttatgttagtgccttagggctgccatgtcaattggcagtgtcacagacctgtcccaaaaccacagagatccactcacaattctaaataccaaaggagcaaattgggggcttatttgggccaccttccctccaag

SEQ ID NO: 34818 - DNA, 2292 bp, Mus musculus
gggttttgggtttttttggttttttgtttttttcatttatatttcttcctaccaagtcaaacttgggtacttggatttggtttcggtagattgcagaaaattctgtgccttgtttttcattcgtttgttgtgtttcttccctcttgcccatttatttttcccaaaatcaaatttgtttttttccccctcccaaacctcccattttttggaattgacctgctggaattcctaagactttctccctgttgccagtttcttttatttgtgttaacggtgactgctttctgttccaaattcagtttcataaaaggaaaaccagcacaatttagatttcatagttcagaatttagtgtctccatgatgcatccttctctgttgttgtaaagatttgggtgaagaaaaaaaaaaaaaaagaaaaaaaaaagaaaaaaaaaagaaaacactgaaaactctttgctgctgcccatgtcttaaatacgtagagcagcgaagactagaaacgtagactgtgacccagacgctgtcgtctgctgtggatcttcattactgtacagggttatctgcaagtgaggtgtgtcgcaatgagattgaatctgtcgttaattctttatctgtaggcggctcagtatagattaccccacgctgtgcagaaagtttttggagtggaaaggtctcctccttcctcgttgccctaaacagacccgacatgtgaggtctgtctgttttatgtaagtggacaaatttgagatgtcacaggaggggaagcagggagggggtacgacagttctgctctgattatttctactctcaacaattccatccacctttcccaattggccttactgctcactaatgcaggagagagcaagtccgtgtgccgtgtgactgactggaggggacaggctttgtttaggttttttttacccccactttggttttggttctgggttgttttgctttgttttgttttcctttgttcttattaaggacggcagtgggctgtgtcctgtgtgtactgtatgttacagacaccgtcctgctgggacacttgtcctgctgggattcccagctcccacccccaactcctctcattccttcagatttggcttgacaaaggcaggaggtacaaaagaagggccaattttgttctggaaaggtcagagcccagagtcgaggtgggaaagtggcatatagggatttccagttacttaatcaaaactcaaaatgtgagtgtttctgtctttcgtgcactaggcctggcctcttacctcagccttaagaaccatctgccaaaaactactcatctcgcatgatggcagccagagcgcatagctactaaaataagtttccgtgaacatatcttacaccggagcctgaggaaagatagaggcgcaaaggaaccctttgcattctctaaagctaagtgggggtttgcagaagtgctggggtcatctagcagtagttctgaaggacagaacctaaactcttaccacacgtgtcggtaagctccagactccaaaacagcccctctggaaagatggcatcagaaaagatagatctatctatatatataaatatataaatatatattatatataacattttcagtcagtacttttggattttgcaaggtgcatttttactattgttacattatgtggaaaacctacgctgatttatttaaggggaaaaaagtgtcgactctgttctttgaaagcgtatttctttttcttgtctttattttaacttctgatagaaccactgcaatatgggggccttttgggaacggactggtttgtaaaggaaaattcattatggagcagtgttttgttaacccctctcctgcccctaggcacttaaccaagacaaaaagccacaaggaacatccctttttcaaaaattttataatgtgcatctattccgagcccttagcacccatcctgaccatagtgaccatatcaaagggtgacaaccagttagcatgtcgttgaaagggtttttcagctgttctttttagaaaaaaaatatatataaaaaatatttaaaaaaaaacaaaaaacaaacaaacacaaaaaaactaccattgttcacagaattggcatctcattttcgggaccgcccatctttctgttttgacaagtgtacagtagtgcagtgttctgatgtaactttatggcttacaatgttgacatgtctcaggttcctgtgtttcaattggtgtttttccgtctcaggtagattgcaaagtgtaggccccacacattggaaaaataataataataataaataata

SEQ ID NO: 34819 - DNA, 1200 bp, Mus musculus
catggcattgcattttgggtagaggtaatagtgaatgcaaaagctgtaagggggagttctcctcgccatgtttgaaaaatagccaaatggcagaataaatggaggagaatgtgcaggagccaatgtcacaaagatagtggaagtggaaaggggagatcacatccagccccgcctgtccctgtcagccacagtaagaaagatggcttgaaataagggcaggaagaagatgggagattgaaaaactccttgatgtgcacgtgtgtgtttcttagccttttgggatgctaggtgaagtcccgtttggagccacttacagatgagctgtcaagatttgagaggacatccttcacctcacaaaatgccttaaacatcacaccacactccctcttaaccataaaacaaaggacaggattgaccaacagagccatcatcccatataggactaagaatgaaggcttctcagacctacctacaattctggcccagcccaaggagagccacctggctggtatgtgtccgaggacatcctcacaagaggcccagcagtggccagctccatgtggaggtagagtgcttgctatttttagaggcgggcaggtcagagcatccctgtcccctgttgataccactgtcctttgagtgccttaggtagcacaggctcaggggggtgagaatgtccacagctcagcctacttgtgcatggctttggctcctccaaagacggaaaggatgggctttgaccaacccctggaagggaactttggcttcttcagcatctgtgaggtttgaagatgccaaatgtctactcctgtggaaaatctcacttgtgtgtgtgcagtgtccctccagagtcctgagacctgtttaggtttagtcattaaacagcagagtgtgacctgtgaatgttcggtgtctaagacccatgctgtgccagccggcctggtacctatgggagttttcacgttccggtgtgtgtatgttttacttttgtagcaaggaaggaaggagaagagctgggacatcggagaatgaacaaaggggatgagagacagctgggaagtgtggagaaacagaaggacaaagggtcagagagaaggatgcagcattcatctccagcagtgaccccctgagcagtgagaagaaaatcagaagcttcatggaaaaccagcccaccttggtgaaaacagagaggtcctacac

SEQ ID NO: 34820 - DNA, 1199 bp, Mus musculus
ggacaccttagtcaggattaggctgctttctgttgttgtgaccccaactataaaattatttttggtgttaattcataactgtaattgtgttgctgctataaatcataatgtaaatatctgatatgtaacccccgtgaaagagtcatttgacaacaccatcatcagcccccagccccaccccaaaggggtcaagacttcactggctgagaatggctgtcctggagcaccagcttgcttcttctctttcattcacaggatgtgactacctccaaggactgtattccagttccccttcttccccctccccttccccctccccctcctcttcccccttcctcctccccctcccctcccccttccccttcccagttgcctgcctgccttccagcctactgtcagatgttcaggaagtcttcacaggaccattatggagttgggttgatgttactgaattgaacctccagggtttctcccaactacctttctacaacctcttctataacaccccacccttcctgtcctcagttttgtctcctatttctccaaagatggatagcactctccacgtcagggcttccatcaaccaagaagcctcactggaacctgtgtgcctgccctgcctctcttgcctgagactgtagatcttgagctgctaagagacagtggaagggaagggcaggcggtctcattcccctccctccccccacctccctccagcgctccccggagagaagctgagagaagcagtttctcccaaccttagcatcgggacaggtgggaaagcagcaataatccaattaaagtgtctgacactctggccaggtggcgccgtgctggggaggaggtggcacacgggggctgttacaggttgtgtttcactggctgtggatacctacagggagaacacttgccataagattcgcagataaaaaccagtggcctctgctttctctccagagtgtttttgtcagaaattggtttggggcaggaggggaagagatcctttttctttcttttcccaccttgagggcatttagaggtggtagaaagaggaattgttggagggaggaaaggaataaatcaaagagccggcatgggcttggttagaaaagccaagagtgtctccagcagagcacggctgctcaggtgggaggcggggcctccacacgcccgacttagcccttccctctgccaccctt

SEQ ID NO: 34821 - DNA, 1148 bp, Mus musculus
acatctgcgttttatatttttatttttgtcttaataaggttatttttcaccatctcttcattctcttctaccataaaaaaatgaaatggtagctaggacaggtgaaaggcagaatgtcaccatttaacaacaggaagaaccaggagaaacttaagccagggacagtgtatactttcatctgcaaacttattccactgcgcagggtaggatgacagtgaccctggtcccttgtgcctttgatataagatctccatcaagttactgtcactgaggaacttcctttgggtagcagtttctccctccccttatcatttgaagaaatttgatgttgggcctatgtccgggagccatttattaatgtcctgtgtgtttttgatgtatgtagtctgatattctcccatatctggggcagtatcagttcaaagggattctgtggagatcgtggcaatttgctggaacttacagcagagacagtgctagcaggaaacatcctctccttggtaaatggggatgtcttattgtggaaccatttgatggccgtgttgggagcccttatcctgttcttcccacagcgtgggtcaggtgtattctccctcacatgaagaaagtgataacatgttcattattgagcatcctaataaatatgttcatatttcatttgaaaaaaaaaaaaagaactaaaggtaaaagccaggggtcaaggtcaggacacacccataatccagcacccacaagggaggctgaagcgggaggatcgctgtgagtttgagaccaatctgctctgctaaggtcagaaagcagatgttatccctgattttggaattcccagacatcaataaaaaaataaaagcaataatctgtgtttacaggggctgggaagacggctcagtggttagggtaagtactgctctggcaaaagactgaggtttgattcccagaactcataccaggtggcttacaaccgctttttccccggtgatccagtctcctcttccagcttccatgggcactgcatttacatacaaatgcccacccccaccttctaaatacacacatacatataaatacaaatagaaatatattttttctaaaactgtgtttcgggaactcaatttaaagcattttgttacagtagacgcaacagataa

SEQ ID NO: 34822 - DNA, 1181 bp, Mus musculus
actattgcatagtggttcccagactttgggtcttgggctgctgctgggaagttttccatgaatgtgtttggttccattgcagaaatagtgtatgtgtagttcaggctcttcttaggaattcacagaaccgggttaagttagtaaacgctttgcagaggacgttagagagggagtggctaaccgatcccctccacccgagacatgcgccacagtcctctggacccgtgtggggatttctgatctacttctaaaagagaaaacaaagccgcaccggcccctctccacaccagctcgaggccactgcctggctcctgggtgacttggaacaagtctcggttttccatctctggggtttggggtattttttttttttcttttcagtgtggtgtgtttgcttgtagggcactggatgacattagtgaaagcatcaaagagcttcagttttaccgaaataacatcttcaagaaaaagacagacgaaaagaagaggaaaattatagaaaatggagaaactgagaagcctgtgagttgatgccggttctcaagccgcagagcctggctctcagaagccacgttagcgtctctctctcctgctgatcgctcgacacagcaccttttctaaagaaaaaaaaatcttttttccagttaactttgcatcttcatactcctcaagcagacatcactcttccgtttcttctaacctgctgtttctgttctgacagcggctcctttgtaagcttcaggccacacccaccccctcagtccatatctgcacttgctcataggccggttccttttatttgaataataaataaagctagttctattgaaatgcaacccttcggcaccctctgctctttatcacacagttgttgggtacaggtgttttttaagtagtgtggctcaggcttaaattactcagaatgccattgatgaactaaaccgtgtgtttcgaacagggagtaaacttaaatttcttttgctttacccgtgagagtggagggggaggagctaggttgtaagatttgggctcatcattacccagctaacaagctctgggatagaccactctccaccacgtacaagaaattcaggtaagcacacaggggtatgtagggggtggtccctagcctctgttagctagagaatatgtgccaggcagtttccgtgttgtgtttagag

SEQ ID NO: 34823 - DNA, 1706 bp, Mus musculus
ttttcttacctcagatgaacagtgttttcagacagatgtcatatgctgggaaatttggttctccacatgcggatcagttgggattttcaccatcagctcaaccacatggccatacctttaaccagtcttccagctcccagtggcgccaagatgcactgtcatcacagcgtaaaagacagaattctcacccctacctagcagatagacactatagccgtgagcagcgctactctgaccatgggtctgactatcattacagaggcagccgagaggatttctactatgacgacaggaatcatgatggctggagccatgactatgataacagaagggacagtagtagaggtgggaagtggccctcatccagacactaacaagcattccaaggacactgtttacagggccattttaggtccttttaattaagttgttggagaaatatttctaaaagctgtacagagtaatcccacaattttccacctgtctttgaaaaaaattttttttaaacctagtaacagtttgacagaactgagaactgtggctccttgtgtgctactttaattacctaacctcaggggttctgaagaggaaggttcatacaagagtgtgtcaccatcccggccatgtcagacagtctcagaaagatgaaacggataggttggttgtattctaaagcaaatattttaagtatctcaccttttatgttgcaagaaatttcatggtaatgaatcaatttggtatatataataggaaacatctaagttggaagtctgaaatggctgtctgcattttgttaataaatgagaaaatagaacttttcagtcatctgcttattaatagtttatttaaaacagtttattggctttgtttggagataaatcatatttcctaactcagaatttaagtacaaattctgtggtatgctcttgaattttaccacaattgaacatacattataaatctttactagttcattctaagaactttaaaattctttcattatatttgatgtatgactagtcgctcaggaagttaaatatctcaatgtatatttttacacaaaatgacagtgttggtgaaaattcgttttagaatgatgttcatacatagagaaaatgacagtgtttgactgcaaggattgtaattttgaaattttgtttaacaaaacttccatgtttcaagatcctgttgctctttgactgcaaaactgtttctaagaattcattccatgaaaaatgtggatcctctttataccacagcatttatactatgttccttttaatatattaaatacacaaaaagagaatgtgtctctttattttgacgtcattgacatcaaggccatctgagttagcagtgtacttttaatcatgtcagttcacatttttgtaaggttgcccatcttacagcatcttctgtagatttgccttgatgcctggctagactgctatcaacataaaatatgcagtagagccttgtgaacattagttcttctgtctgctttttatacccagatgttctacatgtccagtacttgtactaaagttccattaagtagtcatcctcaattgattttttttttttttttttttttttttttttttttttttttggttttggttttggttttcgagaaagggtttctctgtgtagccctggctgtcctggaactcactctgttgagcaggttggcctcgaactcagaa

SEQ ID NO: 34824 - DNA, 1100 bp, Mus musculus
gaggtgggcatgcccacacatacctgtagtcctagcgctttggcacaggaaccaagagggcggccacaagtttgaggggaacctagtttacgtaatgaggtctagggtggcctggactacagaattgagaccttgtctccacaaaaccaaacttgatgaggaaaatgagtttagttttttgaatatagtaagtcttcagtgtcagtctttgagggagttctgatataccaattcacatcccatcgttgcttttgtaatttcttgacaagaattccttagcctagtgtgaatcaatgagaggccctctggtgtttcttgtcagtttctgtctgtgtgctgaagtccgtggtgtcccctttcccatgcctcagttctgtcgttaacaggcatttcatgaggagtactccaggctctatcagcttgccaaagagacacccacctctcacagtgaccctcgccttcagcatgttcttgtctactttttccaaaatgaagcacccaagagggtagtagaacggacccttctggaacagtttgcggatagaaaccttagctatgatgagaggtgagaatgtgccagcctgttcctgtgtggggtcttactcggcaacttcctccaatatggaggagctgccctgaaccctgccattgctttctgaactctgtccctcacagatctatcagtatcatgaaggtggctcaggccaaattgatggaaattggtccagatgacatgaacatggaagagtataaggtaagtgtggggctttgtttctttttaattccttccaaaaccttacttctagaggcaagtgattcttaagataaaatgaagttttatgttaccagactcaactagttccctatgaacttgaaaggagaaggaaaaaaaaaaaacaaagctgagggtggtgggccacactttaaccccagcactcaggaagccaagagtaagtatatcgttgagttcaagcccagcctggcctacataaggagttctaggacagccgagatagagattgaaaggggaaaaattgccgggcattggcacatgcctttaatcctagcacttgggaggcagaggcaggcagatttctgag

SEQ ID NO: 34825 - DNA, 1932 bp, Mus musculus
cttggcactgtttgacagtgacttcatgtatattgtgtgttttgaaccaagactgcaatggtgtcatggttagatgtttggttttgagtgagtgagtaccctttactgctgccatgacaaactctttccccaacatacacagacatggacatagactgagttatgcagccctatgtgggcttcttgcctagtgtgggagggtgagttgcaaaggcatcttcctcttagctgcagcaggatgcctgctgttgagttgaatgttggcccctgaaggccctcccggatgctatagccttgtttagctgtgtgtatgacagttcattttccctctacagagaatctgcagctgtgcttaggagagttcctacccaggcttctagatccttctgcagaaatcatcgtcctaaaggagcctccaactattcgaccgaattctccctatgatctttgcaaccggtttgcagctgtcatggagtccattcaaggagtttcaacagtaaccgtgaaataagccgctcatggacagtcaagactcagtctggtctccggtcccctgcctgttatgtggcagtctgttgtgacagatttccctggacagagggattgggtgtctgagcgagattcagaccctcccccctctcgtgatgtgtgtttaagggattaaggataaagttgcacattttaggtacagaaccacaagagctatttcactgaagaaggcaggagccagtgcattaaggttttgaattatcctagaagacctgaactgcctttgtaaatctcccataacacttgggtttgtctaaacctcgtgccacttttaaattacccttcaggcaccagtctttgacagcaaaagggtgactcatcagaactgagccaggggagcagtttctagttattttgtcaagttcaggtgacatttaaaagtcctcagctaccagagattggtagtaggggtcttgcctggctcttgccagtgatgaaaagaggtgctggtgagcccttccttccacataaggctgcgccatgaagccgccaagggaaagctgcatccccctttggtctgtttatactttagataaaccagaaaacctcacattcagtcttgagtgaaagaaaagaaagcatcctgggcttccagccctgtgctggtgtgacagatgccacacaaggaacacttaatagttaataatcatcagaagcaggtgtctaaggctacccggcctaagagaattttgatcctttctctcccttttttttttttaaagaaaataagggatgtgaatttgtataaaaaataacatctatctgtgtatatgtagaaagaagctgctttttaaagaacttctaattggaaactcatgttttaaccaaattttaaggattaatggagcaatcatgggagggaagaacacaatacaactatgcaggttttataaatgtgcaataaaagtatttgttttacctttggtatgtagcatgaccctttttgaaatacatgttttctattttggaaatcagtggacttcatcgaatttatattttagcctttctatttaaaagggtcacgggagaaaacaaaagatgagcaactttctctctcttccccctgacttgttttccaaaggtttgtttttacttatgtatgtgtatgtaatgtatgcaagtgcccaaagaggacagaagacgaggccccagagctgctggagtcttgagccacctattgtgtgctaggaaccaaactccacttagcacagcagttcttagcctgtgagttaatgcctttgggtggtcaagagactcacctaagaccaccatcagaaaacacatatttacattatgatttataacagtaacaaaattagagttatgaacctaaccactcagccctgtctttgctctgtctgtattagtcagggttctctagag

SEQ ID NO: 34826 - DNA, 1815 bp, Mus musculus
gagtgacactgatgaagaggacgctaagccaacagacgtcccccgacagcacgtgttcctttcccaagtacaaagtgacaagaggttagggtggccagacgcacccgtgttcactctgtgggccacatcccccagggttctgacacttctgcagtgtgaccagtggtgatgctaggttataatttcaaactgtgaaaaataatggtctcgtcctttactcagtgtggggttattttgcattttctcagctcccggggatgggaatggaggatcccagaacactcagcccagcccagcccctttcattccagggcctgcacagatccacagttcacgtacacgggtcctcaggaagagctatcgggtagacaactctgagggcacttagcagaatgggagagctgggtagcacccgagccaggtccttgcggtgaggggcagactccttgggccacagcctgttccggggaatcgctttcccatatggtgaagtcggcggctggaccggctctgccgagggcacactgtacctcctggaaatggtgtactccactgtttgtggttggatacattgagctcaactctgatgataagaagagacagaggtatggccaactccaaaataatgtggcccagagtagctgacgctcagaacactggccacacatttgctggaagccaagaccgcccacactttgatatgcctctctctttatacatatgtttgtctcgccatgcatgggttttcctttcttcctttttctgtttctttttatttttaaacagcagtagtctctctgatatcaaagagggagacagtgtatccccccctattcttttatgtgaagaaataagtatttagttttctgtagggttttttggttttggggggggggttgtttgtttgtttgttgttttagtttttggaaggagggatggactccaccagtgtcagtgtcggtgtgtcttatgtctatgtggcatacattgtatcacataaagaccagcatggccaagttccgtgggaaggttacccaggtgccaccagtggggtctcccagtcctgaagggccaaggtgtatccaacaggattctatgtcctcattttctatggaacctcccatgtcccagggtctcaccctcagctgtccgtctggatggtggtgatcacacctccattaacatccttacccagcattctgtacttcgggggccttctctcttgttataaaaactttttactgagtgaaacatcaacaccacctttgtttccattctcactgctgtaaatactgagtactaactgagaattttgactttgcattctgtcagaatacttgtgttcaataaaagttgaaagaaaaaaaaaagcaactctagtccaactgggctttctttctgctctgtgagagtagtgtgcaaataaatataggcatgcctgcgttctaggttttaggttttctttggttggtttgttggttttggggcagagcttgtggttgctttggttttagcacttagtaatcgacattagtgtgtctctgacacacgtaatagctcagctctgtaatcctagtattcagtagactgaggcaggagaattaccatgaatttgaatttaaattcagttcattgctgtgaactacacaataacttccaaatcagcctaggctacagtgtaagatcatgtctcaataacaacaacaaccaaagtgtatgtgtgtatatgtatgggtgtatgggtataaaaccatcttgagttcatgttgtacagattggtagagaggctcctgtttaaaaggcccaaacctgaga

SEQ ID NO: 34827 - DNA, 1355 bp, Mus musculus
aagaaagaaagaaagaaagaaagaaagaaagaaagaaagaaagatagatctaggctcggggaggctgcaattggtattacccaattggcacagatcagtttcagaaaaaaatgcttccaagaacttagactaaggaatgaaccaagcccacagtttatttttatactttcagtcaagttggaactctgtcgaacctcacaaataagttatactttccgttcagtttgtgtttgttccatatgcggagtgtggcactctggctagctgagttcagttcccacggggactcctgtttcttaggaagcatgccaaatgccagcttattccagttcttttgcttttgattttttttcctctactctttcttttctttccctttcttccctgtttatcaagtttgctttccagtgtttacaagttgacagactacgtttgactttggttgtgtttaatgtccctgtataaaatagctcccccccccccccgccccctgttttttctttaagcaacaggtaccccgtagaggcaggtagaatcctcacaggttgcttttagcatgggtgaaggttacaaaagatgattgtttacagtggctctatccccctaaccatcccctgccctacccctgaggattctgattcattacagtttttacctgtgtcaaactggggcgagagcccctccttctgaaatgattttgccttttttttttttttgttaattctgtttcttagggggagatgggggatgttagaccacttttggattagctgccacctgcctgtgtctgtgacactggacctactgcccaggtgtctgcgcacccttcctctgaaggactcctttggctttgttgaatgaagcagagaagattgtatagttggggctggggctggtcttggtgaacacacttttctttttttttcttttttcttttttttttcctttttttttttttttttttttaccccagacacctcctttttgtagaaagccaaataaaatatatacataccacttcctttagagcccagaatctagatttgaacggaagagcgcgtgtgcttcagggaagtagtgtctccttttggaaatctatggaagtaaagtgacatcggccttctgttcagttaggcaacatttgtaaaaaaaaaacaaatatcgtctggagttataatacaactctcctggatcggaaaccaagtggggggaaaatacagaaactttcaggggatgggaggggggagaagggaaaagccagccctttgtatagaaattttgcttttgttttttcattctgctttagaacgcaagcttgtgcactgtggatgcgtgaatattttagtgtgaaacgt

SEQ ID NO: 34828 - DNA, 1800 bp, Mus musculus
ttggcttccagcaggggtagacatctttcagagtcatggtgactgctaaatggttagtggtctagaaaaatagcccctgggacttccctgtaggatgctaagtgtatgcagatgttgaagtttgaatttgaaatttgatgagatttttaaaaacaaatttggctattgcagtgcactgctgtgattcaggataaagtggagcacagcattgaaactaagaaatttgttcactcctgaagagaggtccatcttcaggagtggtcaacaaaacccaaaaaagggaggagggataagagaagttagcgcaagtaaaatttatagaataagagagtgaagctttttaagggcagctcccacctccctcccctggtcattagtaaggatttaagtgacttgggcctgatttcagatgctttaaataaactaatagtatcgctcttgttagtggatcgtacatagaacagctgatgaagtcaggtgtttccccattccactctctatccatctgctcctacccaaaatcgcctgggatgcttttaacaagtaccggaaactctgcccatcagccagacgctatttactatgttccatcatgaaacactgaatgaagagaagagaggttaaggcagggactgaatcccatcccccatcatcaaatagctgtggtggagaagacacttaagtccctaccacagggcagcagggagtgaatttgtttgggtgagctgaactctgcattatgcaaactaagattcccctactgccccaccctcaccccttcccatatatccgaacctttagcttgaggtgcctctgcagagaagtagctttataggcattgtccaaggactatgtaaatgggacttccggtttcccaccatcagcatgagtgtgacaagcccgctcccctgtcactgtgttgcatgtctgagcatggctcccttcacaccctttcataatgatctttttttttttttttttcttctttagctactgaccctgacttgtgttaggcaatgctggttctgacgaactaaattctttaacacccactcttccttcttagattgaaaacatcactaaccgccccttccacgccctcctttatttttatttttttacagctgtgtgtttggagcctcggcctctgacaggtcgacacagactttctattctaattgcctttgttccgaaggatctcgcaccctggcggctcccagggtagagaggtagctgtagccaaggtcctcagagaggggcagtggagtattatcagcctgaagccttcgagtagggaccggatctccaaaggttaccagtgtgagggcaggaacatcccagtagcccacttaatacccacaccaatgttcatgaactagtgaagtgtggcgcctccttgtggctcagaaggagtagcagcgttcactcggtcatagttatttctgtcctaaattcttcagcctggatcagccccacaaccacaagcgaaaccttcatggtcagttttttttttttttaagggcaataaaacaaatataattggtcaattaatccgttggtgctttcatgccacccacaagaatggaatcggtgtttttgtggctcagtctgtcagagttcatttgttgctgtctaatttgcattttgtcatccaaatccctccctcctgctcccaacacacattcataattcctaagagaactgggcaggaatggactccgcaccaggtgcctcagtgagctcgggtccccccgaagttcaaggtcaaccttgggtctctgctaagacctaaggaactga

SEQ ID NO: 34829 - DNA, 1184 bp, Mus musculus
ttttatctcaagatgtccatcacacgtagctgaagacagcaggttcttctcttgatggatgcaaagattattaaacacatccagaaggtataaagatggacagagtgtgtattgcttacagcaagtatggagagcagtcaaactatttacagagatgcaaagaaacccagatgtttttggagaatctgtgcacactagagtcagagcatgtgggataggcacactacaaggtgtgcatgtgtgaacctacttacttgatggccataaatctcatgttttagaaatgtagaaaacaggcaccaacatttgtatgtggagaacttagaagtcacttcctgaacgagtgagtcacttcagcttagtgactttggctgtttccttgtaagtttctctaaaatgtcttaagtgaagcataaaatataaaggctggaaagatggttcatttggtagagttcttggctagcattctcaaagcagtgggtcccaacttcagccttggagaaaccgggcatggggtgagaagcctctaaagaacattcttgggtccacagagagttcaacccaatctagactatgtgaggatatctaaaaaaaaaaataataataactctgaatgtacatgaatagtcttttaaagtatcagcacttgtttacttctaagtttaagagtttgctatccccaaaacagttgtctggcttagtaagtaacacaaacaacactcagttctcttcagaccattgagacaagtcttggtgaagggagcaaggccaggtttaaaatcctagagatagtctttgttccagtctactttctttgcctgtctcttgtccactagacagcattcagtatgcttaccacatagatttcttctagccttgaactaaggccgagttgtgcttttcactgtttgtgagaacagcactgtattctcttgagtcctcttctgtttgaattgattccaaagatcgactccaccatgcatactgttggtgcctgttagataaatgatttgggattcttacccagaatctccagaggtggcctttaagaattattgtggaaaacaaacaaacaaacaaacaaacctctacgggtacttctattcacatttttcctccagataaaaaaatgaagtttattaggagcagtgtaataaatggagatcagcaaagctatagcaaga

SEQ ID NO: 34830 - DNA, 1113 bp, Mus musculus
catataaacactctaacacattcatacacaaacacactcacacattcactcacagtcacacagacgtatacacacagttacacagtcacacacagagatgcacactcattcatacacaattacacacatactcagacatacagtcacacatacagactcacacccacagtcacacatacagactcacacacacggtcatacctacagatttatacacactcactcacattctctctctctctctctttctctctctctctctctctctctctctctctctctctctctctctcacacacacacacacacacacacacacacaaacaggtcaaattttgaactaaacagctcctgcttttaatgtgctttttaaatgtctaaatgctttgttgaaatgaagatgcaagtttggtttggccatgaccattatcctaggacaaggaggaaagcatgttttacctggccaggaagaaccccagccttgggcagcctccctctgactccacatcttcctgggctgtgggaaaatatggctgccttccagcacctccctggagagacagagagaaatcctcaaaggtgtggcaggggctcaggagcagctgtcagcagttgggaaggtgaggcacctgctgggaaaatgatagtagtgcaagaaggtagcacacaaaggcctgaggcccaggagaggccttcaaagctatccttcctgaagcagcctcatgggagccatcttggagtacctgcagaggaaccctgtggactgagactacaggatgcaagacaggagagcacgctggagccagatccgaggctcagagacaccagcatgcattatttatacctcctgacaatacataccacagacaaatttaacggatagataatattattctttcttttgttcacttttgattggttccagctagaaaaaagaaattcctttattttatttcaacctgtctgctaaactaggccagtgtgtcatagaaacagacttttttctttgagatgagtgaagtgtccaactcgaagaaatttttctttgaatcagtggattatttctttttaattggctttttaactgtgtttcattctttgaggatcagtcct

SEQ ID NO: 34831 - DNA, 1166 bp, Mus musculus
cctttgtataatggttagagtatcgggacatacaggagaaccagtggttttcataatttgaatatttgtagtatatgtactcaggcctcactcatgctgtgcaagcaagttgcctctctgcctcatccccatgcctctctcaccttttattttgagacccaagctaaccttgactcactctgaagttcaagcaagccttgaacttgcaatctccctccttcagcctcctgagtagctgggatggcaggcttggcccacgaggctgatcctcagtatctctgaaggtgctttggtagaggcttccttagtctccagcttggctgtgctgggaagtggtgggaagttcaagaggcagggcgtcctgggaggccataggcaggcccttccaggatgctggaactctgcttccttgctctgtgtctgagttcttcaccaggaggtgcatggtttcattctgttgcttgcctctggcatggcgtgttttccttttggaagtctaaagccagtgcatatgcctgattgtagactgtgttctccaaatctgtgtccacatacccctttttttcctcatgaattgtttctgaggtgtttgtcatgctggaaagttcactgatataccttgctcacacaagctaatggcttcatggtagagctgtgtcatgggcattggttattgatatcatcacctcatctctgctacttccatactttaaagtttgatacccattctttctacaaggaaggatggaggaatacatctcccaggatttgacaagaggaacctgttcatttgtttttactctcattcatcctaactgtgaacacggtacatgcagttacattttataggaaggttaagatagactaaggatgtttttcttggtatgtaaaacaagttaaatgatatgaataaaatattaattagctgatactagagtggtgactatgaaaatgttaagcacattgtgggtgcaatcattgggtttgacaaacccttggattgctcttcaggtgaagctgttgtttctctctaataggaagaacatgtccttcaaggccatgagctaactaagcacactctaggtagatcattctcagattttcttctgccagaaagctttctaaaaccggtttatcttgctgttgtcactctcagaattctctga

SEQ ID NO: 34832 - DNA, 1138 bp, Mus musculus
ctccaaacagaggcttgataaattgtttccttgatttttgtttctcccccagtacaaccctcagcctcaacccctattcctgagagttctgagaccagccagaccataaacacgactccaactgtgaacacagccaagactacagccaaggacacagccaacaccacagccgtgaccacagccaataccacagccaataccacagccgtgaccacagccaagaccacagccaaaagcctggccatccgcactctcggcagccccctggcaggtgccctccatatcctgcttgtttttctcattagtaaactcctcttctaaagaaaactggggaagcagatctccaacctccaggtcatcctcccgagctcatttcaggccagtgcttaaacatacccgaatgaaggttttatgtcctcagtccgcagctccaccaccttggaccacagacctgcaacactagtgcacttgagggatacaaatgcttgcctggatctttcagggcacaaattccgcttcttgtaaatacttagtccatccatcctgcgtgtaacctgaagttctgactctcagtttaacctgttgacagccaatctgaacttgtgtttcttgccaaaggtattcccatgagcctcctgggtgtgggggtggggagggaatgatccttctttactttcaaactgatttcagatttctggccaaacctactcaggttgcaaaggacttatgtgacttatgtgactgtaggaaaaagagaaatgagtgatcatcctgtggctactagcagatttccactgtgcccagaccagtcggtaggttttgaaggaagtatatgaaaactgtgcctcagaagccaatgacaggacacatgactttttttttctaagtcaaataaacaatatattgaacaagaataccgaaatgtgctaaattgaaagataacccttaatgagtgataaaatacaaagtgttacctaactttgtttttagaactaggaataaaagtgtgtgtgtgtgtgtgtgtgtgtgtgtgtgtgtgtgtgtgtgtgtgttttcaaggacagatgcaaggttaatttatctcagttttgttttgtccagtcaaagctggtcatttcttccttgatgataatttata

SEQ ID NO: 34833 - DNA, 1365 bp, Mus musculus
ggattaaaggcttgaactaccactgctgggctattagcaactctattgcattttggtttccattttttaactgtgagttgcttgggctgttatgtcaaagcatagaaataattccacctgtggagtggctgtacaagatccctgtgagagcaaacagttgttggagtattcataggtagagactttgtattttggggtgttttgtattcttttgggtgagtggggtacttaacttgtctgcatggcctctaactgcccttgtgtttgacttttcattaggggccttggacaagtggttaccgactacgttcatggggacaccctgccgaaggctgccagggcaggcctcttggcactctcagctttgacctttgctgggctttgctacttcaattaccacgatgtcggcatctgcagagcggttgccatgctgtggaagctctgacctgggtgcagcactttgattgtgtgcctccttgcctctgctttaccaatgccgttcacctcgcagtgaggggggatgaaggataagcccattggtgggcagaatgtcttctaattacatggttattttcagaatttatttgttgaggaagaggtttgaggagttaggttcgaccattcgtgagtctgtgttccatactccactgagtgtgggcactagctcacagcctcgcggtgagactgaacatttcatgagctcatgttgcctttgaccaccatttcttaaggagagccagctgattgctgtcaggataagagcatctcttcagccaggagggaggcctgttccctcctgagttagactttgcatgaagctcgaaagtattccctttggaacctcccattcttgttcaggtgacaccagctctgttgatggctctgcttctagggaacatttaatcaggagatgctctcaatgactaatttgtctaagtcttaggaaggaggttgaggaaagctggatttagacaagttcaatttagggagttctccttgtttgtggattaaaatatgacagattgcaaacagactactcttcaaatgtatctcaattgtgcagaagtgagctgtccaaaagtataagactaagtgataaactgtcttcccaccgtgggagttgttaatgagaaagaaagtgtactctgaaaaaacaaaatttttaaataaaatattatataatgaaaatacattgtactttttttttatgtgctagtattctctaatatttgggttttggttggtgcttacatgtttgaaatagactcttacaagctcatactgatctgaaattctctgtaggtagaccaggatggcctcaaactttgcaatctttctgtttctgcccctcaagtgctggagtta

SEQ ID NO: 34834 - DNA, 2368 bp, Mus musculus
gttgtgtaccaccatacccaactcaaagtctgacttacagttcagatgttaataatttacccagagtgcagaatatgaaatagaaatgtactttttctttcctccgtaaaagttttgccttttctttttattagtagtgatcagcaagacattaccaatggaaaaaaaccatctccccaggtaaaatcatctgcccgtgaatctcgaaaacataagaagtcaaagaaatcccataagaagaagcagaaaaaacggtcacacaaaaaacagaagaaaaacaaaaaggaagttacggacataacagcagattcctcaagtgagttctcagaggaaactcgagcttctagtactaggaaaaggaagcaaccacacaagagcaagaaaaagtccaggaaaaagtctcctaaaatcactttccctttagggggagaaagtggtacttctcagtcagaggattctgcatctagcagttctgaggacatcgaggaaagagatactaagaaaaccaaacggaaaaagaaagagaagagtgtccatgtccccatgcctgaccctgaggtacaggagaggacaagcaagcgcaggaactggaaggtggctaccgacgccaggtctgctgagagctcggaggatgactaagtgggagagcagcagtcctgcttcccactgactcgttaggggggttgccagtgactcctgcagcacaggcaggcgtctgaggtcagagttgtcctgccccagataccttttttcctattttggcttgttaatctccatcctcttttgttaatagggaatctggtattttattaaggtttcttgaaaaaattatttttttcaattaatcacttagggtagaatacctatacagcaaattaaagaacccagaaagctgaactcagtaatgacctgggcacaccaattgcaatgttggatttgatggaatcaagagtccaggatggaggaggaagactgaagtagtgctaaatagaatggtttgacaaggagaccgtgctattcatacaggaggcatgctgccttcagctttggtgctttggttcttctgcagttgggccctataggcatccagtttactgagcgaggaaatagttaaaagaacaaaccttttcccttcatggtaatctctacagatgactgctaaggaacctagggttttcagcctaatctccctgctggccagggtctacagctacatttagcataacccaaacataacagtaactggatagtaaatgtttttctagttccattgctgtatactgcctaaatgggcttgtatttgaaattgtttggttgtcctatctatcaaatggaaagaattaggaagtagttatgttgccatgatgctttcaaagagattcagggcatcagccatctaaatgtctgttttttaaaaaaattttattattattattattattattattatttttgctgagttggggattgaaccgaaggccttgcatatactaggcaagtgctctaccattgagccatacccccagtcctgttgttttccttgttcatttctaattctattaatggattttagattttccctgaaaccagttgaatcaattccaaaatgaaacacacttctcagggacatacccacttcccagtctgactttgtgttttgattatcaagaacatattatttccccctgctatatactgtgatcctgatattaaaagaaaccaaaataccactggaaagtggctggtagaacagttggcttttcattaagaggaaagataaagtgacatttatcagggtttttgtttttgaggttgtcactttggtactgagcgaatgcatgaaaactcaagactgtgggccatggttctgccactaattgattgagttctagagcaggttaacctccctggccttactctttgcatgtgtaatacaaagatacttcatggttagcatgacatacaccagcaatagaatatgataatgctgacatcccatgaagtggcattttatagtaataactaaatttgtgctctttatggaacatatttctaataaaatgcttgttcttaaaatatatggttggccagatgtgccctatcccttgattatgagcaggtgccgccttttggggtactgaaacactaatgattttagtactcaaatgccaatattccatgagccttttggggtactgaaacactaatgattttagtactcaaatgccaatattccatgatatattcttttccttgggtctagtggagggagagtctagttactacctcataaccttctagaagcaagtgatatctttgttggaagtagttttgggcatgcattcttaatgcagttttgtgctacaaa

SEQ ID NO: 34835 - DNA, 1231 bp, Mus musculus
agggctagaaaagtagatatttctatattaataaagattggtttttattttgatagacaggcttagtcccttagctgacctctggcttttcacccttgctgttactgcaaggtgtccttaggctgtggaaaaaacagggatgaggaggaacgacttccagctcctattttagccacaaatcgtggtgttactaatgacataattcttgcctaggtcttgctaaatctgaggttgataattctcctttaggagctgcacagcactcagaactgtgcatactggtttgtgattgtacaaattcagtatgggcatcgcttggtgcagaggcactgcagggaaaggtccagcttgaccatttctgagtttcctgtgagataaacccggtttgaaagaggttggtatcatattttggctaaaaataaaaaatatttttcggctctgcctcacctccccaaaagatacccagagccacaggtgtgggtcttaacaatacccacgggaggaatcgggtccatgtccacccaagccaaggttaaaagcccactcatctacggatgagaaaattatttgatcacctcagttaagcgttgccttatttaacttaattaatgggggggagagagattggagacgtactattgaaagggcaagcccttcactgcctcccacccaaataaaaaagccaattggccttgtactacaagagccggtcgaactccttctccctgtttcccacctatcatccaaaaatgcggaggaatatcaacttagtgttattcttattatagtgtatttcacatttgttcagtcaaacttagccagagttccaacgccctacttaaaattcaactagaaagttacctaccaagtactaattagcattataaagtcagagcctacagctccaggcttttcagttagttgtttactaagataagaaaggacagtcttaagccagatacagtttaccataaaaaaggttaaggaatcccacgaaagcaagtatttttctttagccctagattccagacagaactattgagcatagataatttttccccctcaggccagctttttcttttttttaaattttgttaataaaagggaggagatgtagtctcccctcccccagcctgaaacctgcttgctcaggggtggagcttcctgctcattcattctgccacgcccactgctggaacctgcggagccacacacgtgcacctttctactg

SEQ ID NO: 34836 - DNA, 1103 bp, Mus musculus
atttaaaaattagttttttgttgtttgtttgttagtatagcatataagtgaccttaattctgtcatctgaatgataaaagggaaataatctacctgggtaggagtcagctcgtgggtggctgttgccttgggctcattggtttccttcagaatacccactgatgtttttctttctagctttgatgtggctagtgtgatgtccgttacactcagctgtgatcatcgagttgtggatggagcagttggagcccagtggcttgctgaattcaaaaagtaccttgaaaagcctataactatgttgttataatttacccaagaacttctactctttctctgctgacattatatttatatgttattaaagaggtggttcttttaaagtttcactagttaattttattattcagtccagataatttatttgtaatagacataaagaatcttttgtaaatgccagttacacccaaatattgtaccctttaataattaaacatcagtttaaagctggacactcctagtgcaggggacatgtggcctaactctggtgagaaggccttcctaggggcataggatgggcaggctcataaaagtaacctggatgagaccttggagtttagaatttaattgattcaacttatttaagtgtgaggagtttgaacaaaagtttttctttggaatctaaccctagttaaagtctcctgttacatgatctaagtttatcactcaaggaaaataagtgaaactttaagagtcatcattttcttagacctcttcaaccaactgttatttttatatgaatctctaaataaaatagcttcccctcaagataaagatataagcccgcttcttggtataagtgaagatttatgtatttatttataaacaatttcaatgtataacttgagaattctgcagtttcctccgaataaaagaacatgcatattgaagtgaacacgttgtagaagtggagctttgcttctgagatgagccggatggtgactgtacatggacccgagtgtcacgttattactgttaagagaactcggtgggatgactatgaaatgtatatgggagaagtgtacatatgtaatatatggttttat

SEQ ID NO: 34837 - DNA, 1190 bp, Mus musculus
aagtattggtggtaacctagatcagtggttctcagtctgtgggtcaagtgaccctttcatataggtcacatcagatagctgcataccagaaacttacactagattcataacagtaacaaaattacacttatgaagtagcaaccgatctattgttatgcctgggggtaacaataacatgagaaactgtattaaagggtagcagcattagaaaaattaagaaccactgacctggttgaaaagatactttgtgtgtctgtgcagagaggcgggtgggagagaggtttgttttgaccatctggaagaaatctttccatcttcctgttgcttttcactttggaggatgggttagggtgtctaatcactcttgttttaaaggttgatttaactgggaaagcaattagtacagacctttgtgatgggtgacaaggtctcactgtatagttggtaagcatgcgcttacctgaatgcttttatgcgtcctggttaagcagtgatgtgtggcatttgtctccacagattgttcttcctgccctctccccaaccatgaccatgggcacggtccagaggtgggaaaagaaagtgggcgagaagctgagtgaaggagacttgctggcagagatagagaccgacaaggccaccataggtgaggaggatggccatcagtacatttttttgtactgagtgagtggtaatgtgacatttacagtcctgagatttgctgcctgggtcatattttataaaaaggtcatcacagccacacgtgtcagttctgagctgtactcatcaatggaggatatgtcagggtctattctaaggcctgggttcactctcttggctttatttttatggtactcagaagttgtaccagcactgccattgtctaaacatgggaaaagaaggagggaggaggaagatagtcatgccctctagggcaggagaataccaaagcctttcaggtgcctctgagggaaaacagtacccagggtgtagattagtctcataatctgaaagtgccatggatgtcagtctttttctcatttccatgtgcccctttattgacttattcaccatgcagtcatgtactgtgcttgtgtctattgataatcccaggtgttctgaacctgtttccactcttccgtggtttccaggagcagaaggcccatccacgccatagtggcagagcaggacat

SEQ ID NO: 34838 - DNA, 1230 bp, Mus musculus
aagaagtctgggtaagaggagtgatgttgctgagtgagcagtcctcacctgtgaagataggctttttgtttttattttttgtttttaacataaagattttttgtatcagtcgttaaggattaaggtgaaacttctctgttaaatgttgaccttgcctttgccttttgcatctgagatagtttcatagctgaaggccttttgaggattatctagatgaagacagtctcctagtgttttcctggtggatgtcccgttactgttttctgtgcacctgagtggggagttagtggcattctcaccctctttgttcagggccatctgcttgcaagtttccaagctgagacttgagtaaagggattgagagacctttagttataaatttcttgcttcagactgacttgtgacctctgctcctgcccccaactgaagttctagcagaaatcatgttttcttcaagtgtaatgtttttctggtgatctggggtgaagggttgtctgttaagcaacaggtccgccatgtgttcttttcattcttctcgcttgtgtctctgacagttggcagcttcagttcattccatcagagttcagaggtcagctaccaaagcctttcgcagagggaccactggccaccaggactgttcccactcacatgaacgaccagaaccgagaggagccttccagatacgtaagggctgccaatcttctcttgctgctgcctagagagacagtcaccccagatcactaggcattgttccgttggagcattaaccaaacgagtgtctcagaaagctatttctcagagagacagagagagagagagagagacagagacacagagagagagaaagaacgatgcatgcgtggagggagtggcagcatcccctcttcccaatttactctcttaaatgtctgtggaaagcacacagttgagttaactgagaaggctgagaggggctggggtcttctcatgagagtcttgagcagtctttctgagtacattgaaacccacagcattccttgttctgttgaaacgcctgctggtacagttctaagtgagcggttctaagtgagcgggttaccttggacctcccttccgcgcccttttgttgtacttatatagcacaggaacacccagaaaggctgtccccatagtgaggccatggagcaggctctcctcagtgccacgaccttctgcctacttgccgtcacacactctggagtcctgtgaatt

SEQ ID NO: 34839 - DNA, 1543 bp, Mus musculus
aaaatgcggacccatagctcttgctagtctgttcagacttattaaggagacagattttttgttgttgtttgtttatttgttttttgttttggcttgagtaacaaggtatatggtctattattatgatctggtacctaaatagtagacttttctgtattcatatgttttctgtataaaacattatccttgatgtagtgcttggtttcttttaattattttcagagcattcagtaaaatgatgaaattcctccccaccccctttcttttctcttgcaggtcttccaagttgcttcgggcattctatgttcccttcctgtcagatcagtacacggtgtatgtgaactacaccatcctgaagcctcggaaagcaaagccgagcaggaagaaaagtggaggttagcaccccggtgactccagaggacagcctgtgctaactagggcttccacggagccgacttcctccaaggcatcctgttagagctgtaataaaggtcgtccaccaagagtgccagaagctggtgctctgagctcgtcatggtctatgtcaaagtctaatcaaagtcacacacttcctgctcctgggtctgttctgcatgtgagctctctgcagataggcacagtcctaactcctggggaagtccagtgctccactccaccttgttctccatgtaggtactcactggagggagaagagtagaacgtgcttgcagaaactgcgagaggacctaactcggtgtgggctagccttctccactctctggccagcatctgagaactaccaagcctcccttagactacaaggtttctctctcagagctgtttggcaacttctagcaggccttcttcaaatcctactgctgaaaagcagctcagcctagttgccaaccagatatggccttttcccggcagcaagacgtggcttctaaagtgttcccaggactgacactgtcctgaagctcaggaaaaaggcgaccactgaagaactgtgacctaatcatattatttaatgatgcctttaactttccttttattttctttaaaactggtcttaattatatggctttttgggaagtgttttaagatttttttaatgtttcagtctgctttattgaattctagactctgtatatatagggcgtctttggagaaaaaggtgtatcaatagatttgggtgacaacacattttaaagtagtctgaggccattttggggaaattaagaattccttttcgtaaaatgatagtcccagtgaaatgaaaatgactgatttcagttctcctgcaaggtatcctctagataggcattggcaaggagtcccccatcaggtccgcctgcctgtgacttcaccttctcttacaatatggcacagcctgtaagccattttctcagtgtctcatgtgatcctcacaactactgtgaggaggaccagcttcccagacaggagacaaatgaagacggagggctagagccttatggttgggcagaaggtgacatctctgctggctgacttctcatgcttgtgtgagtgtccgcgcctctccgct

SEQ ID NO: 34840 - DNA, 1172 bp, Mus musculus
ttctgtgcctgaaaaatgtaaagatccctgaaacagtgcctgactgcaggcacctgaccaagcctctacatacacacacatgcatgcacacatacatgcacaatatgcaaacataggtcctctgagtaagagctcaaacataatgtaacacaaaaatgctagatggatgcagagatttcttggaaatgtcagttcctatccctttgaaaacctctctttggttttctccattctgtcttctggtaagagcatgcgtggtacatctcagacatgatgccaagtgcctcttagcagcctacagaattagctttcttgggaaaaagaaaggtctctgatgcacagcccccgtctcctgcaaagactgttgacagataccactacttcggtacctagactaagcattaattggtagattgttgctctagctgtagctgtatctatagatctgcatgtgattcagaaaggcctttgatggcaggacaagggagaggacataactgtgtacttggcaaatctagacttctctgatctctgaccctaaattagcctgttttggaccttaaacccgtgactctgagtacgtgtgctgacccaatctaggtggtaggaatcacctagattcaagctctgactcttaaacaacttcattatgtgatttaaaaagaagaagaaaagacaggttagtctaatctctggggagaattgcagagaattgcagcctgtactccttattactgaattcaggtttagcagcgggcacgcttttaaatcagggtggtggttggtcacaatctttaggtcattttcctagtctggcattctgggaaagacatttgaactcctcctgtaagttactaggaagccgctccaccagagggaaccttcttacgtgttgtgcctcccagggtcgggtggatgagactcactgaggttccataacaacctgcctaataccagtctgctaggctcctcaggcaactgaggaagctggagtgggcgtgtgctcagctttaatggtccgtgacaggaagatcaaggcttctgtaaggcgatgactgggtttcctggcttcgctggcgtgtctgtaaatctttaattatcccagcctctgagagcaggtaattcctaatggaaatgacatcaggaatcagcagtgtgctgcccgacaccag

SEQ ID NO: 34841 - DNA, 1896 bp, Mus musculus
gttacatgctaaatggtgaagcgatcactcatgaaccttctgtaccactaatgtgattttgtttggaattttccagttcttgccttggcataaagatgaacaggagggaaaagcctttactaaattcttatcacagatctctagtcaatgtgttcttgccctgggtggagaaaaatggaaaccttcaagatctcatccaagcaaatggcaacaacatagaagaaatcagatttcagtgacttgattctctctacacatgacctcagactgacttgacttctctctgttgggataactgtacgctcttcttctgcccagttgctgatgctcctcatacagtcatctcttgagtgtctcccagggtttctctccagcaccattgaggctcctgcctcctcccttttgaatcaggccccagccacttacgattccagacagaccctggatggatttggaccccgacacggagtggagtgaatcccttattgtttacacatctctgtgtggcgctccatctttccaatgttaagagtaaatggtttagaataacttatttatatctgcttggagctaatattgagatttgactgtagcgaaagccacatgctcctggtttcgatggtccgcatcagcatctcacatgaaggagatgtggaaggctaacgaatggctggtctggttttcatttgctcagtttgactgtaatcatgtcatgcaggagctggaagtgggtgtatcttgctgctaatgtgtgatgttgaaagaaaacaatttcaacggctcagcactgtgactgccttcaaaaactcagaagaaactttagtgcctcctactaagttgtggttctactgtttcattgtgaagtgttgtgtttcaagtaagtgtaggaaccagtggccccaggctctgctcccagcactgttagtgagcattgtgctgttgcgataccgtgcagtaccaaactgaagcttccttgctcagtgttttcttgtggtgtgggtgatgctagaacttttttctacttttgcagtaaaatttcattaatatgtccagaaatttaaggtgacaggtcaagctgaagggtttgctgaagcaaattaattgtgtctatggaaggctgctggacactaattttaggaagtacccccttctcagtgggtgtgcctgtgaccagtgtccctgctctgtcataacccagcccttccaggagcagcgcacacatcacacttttcctgaatatccctgtgggtaatttaaatattttcatctgactccttgtctcgggtggactcaagttaatgaggctttactgcggcctgttttactcaatgcatcataccatgtagtttgatgtttccattttggtttctgaattgttgattttacttacaaatccttttagatataacaagccctgttctgttttgtgaaggcccaaagatacctacaaatctttgtacattaaacatgttacataaaaccaaattgtgtaaatgcttttaagtttatcataccttagaaaaacagaacagaccgtttctatcagagaccatgtgcctgcattttaaactgctggttacttcttagtaagttttcatttttgtgttctagggccaaagtttgactattttcctaagcattttagtgccttaaattagtctgctgtaaacattttaatttcacagtttctttttcgtcacctgcaggctgtattcctctttaatgattagttttatatttgagagagataattgtcttgattgtggaaatgtgcattgggacagctgcttcacctttggttggaaatgccacatggtacactcactcgggaataaacctctaaagtgtctctgctcccctaccccccagccttgtgcatttagctttctgccagca

SEQ ID NO: 34842 - DNA, 2529 bp, Mus musculus
ctcagccaatacccagagatgcagttgcagccactgccctctactcccggcccccaggctccacctcccttaccctcacaattgcagcaacatcagcagccaccacccccaccaccaccccctccaccacagcagccaggagctgctccaacctccttacagttctcctatcagacttgtgagctgccaagcaccacttcttctgtaccaaactatcctgcttcctgtcactatcctgtggatggagcccagcagagcaacctcacaggggcggactgtcccaggagctcaggacttcaggacaccgcatctagctatgacccactggccctctctgagctccctggactctttgattgtgaaatggtagaagctgtggatccacaacacaatgggtatgtcctggtgaattaatctcaatcaggaagtgaggtggctctagtgaaggcagactgtggatttgtatttttattccatccatttaaatttaaagcttacttttccccttttccctaatggggaaaaatcgggtttcccaactggaatcagggtttgactagggtagatgttcctcctggctctgtcctaccacagaattttctgtgccaagggctagaatgtagttggaagcgggagtgtatgccctaaggtaacatggagcaagctctcaaaggaggaaccaacaaatgtttgtataaagtgacagcatagacctaggttttacaccaaagattcatttaccttggtgaaagcaaggcaaattgtgtgttgtatatatcacatagtgggagggaaaggggatacatttccctaaagccaggctaggcaacagcaaagtacttcaaggcatatcaagatgttgatgcagggtgtcctcaagaccatcacaaagcagcagagcctaagttgtgtttccaggacacttgagtagcagctggtactgatcccagaaccctgtctgggagcacgcaataacaccttctcaacagtgcccctggatggccgagtgttaggatgcgcagggttccagagccctcacctgtaacaacaggagcctcatcccagtggaggctgaggcagaaaccagggagcctcaggaacttgggccctgtgctgggaagccaggctcttcctgcacagcctccaggaagcccctggagtgtgctgtgctggagtgattcctttggtgactcctgctccccaccgtgctgtcctgagcttatggagctttgcacgttgggcaggcagtttcatacagggcttagacattttaaagacgcacaacaaaggaactttcacatgccctgtgtagtgtgtgccttccccagctcatcacactcctttctctaggaaccaagctttccagttatgtcctgctaaacccaaaggttcttgaatctgtttccaccatgtgggatctgaattctccattccttaaacttttgatttgtatgaaatgttcatgtattatagcaatatcaaagaatctcagatgtgttagccatttatgagaaaagcttaaccctttaattgaaaaatagatgctgtacctagtcaacagatatctaaaagtaactagtaatctgttgtttgcacagtgacatccaggtgttacaggctcagtattgtttataaaattataatttctattctttagagtggcttgtccaatcagcagatgaatgcactaagcacaaagcgtcttccttaaagcacaagaagagagctactccacagatgctgcctctagaaacacctataagttgcctttcctctctgtagtaagtgtccaggcaggcaagggaagactaggcatgggaagtctccggagagccatcctggcccgcagcccagcccagctcagcccctgccagtgttggtgactcaagcagtccttgaggctggccagagactgtagttgttgggctccccactggtgccaggctgctttggaaatgcgctctgcttggaattgggctgtgggttacagcaggagtagatagcaggagggactgtcattttgtgatttaataactaaaaatccagtaaggataatttgtgtttcttttattcattctattcctcctcgtacttaagattgataatttcattggagagatcatttcattaagatctctgatatgtttaaagctttgcaaaataagccaagttataaagtggggcttgatttctttagactgaaggagaatgttgtcccagcatttactgcacaagtgctgtaatattgacaaaatgaaaatgccttccagattgaaaatgggggctgctcatttcaggactgcaggatcagaccacagcagattggcataaacccctgtcccccaacagggttgtgagctgcttagcccgggagacctagcagctatggcaggacagttaggcaacagatgaggggctgcggagaggctgtcagaagtttaaaggctgcagagagaagctgggaacgctcatcagcggccaagcctgttaggcactgacacagagaggaggtgaggacagtcgccttgt

SEQ ID NO: 34843 - DNA, 1183 bp, Mus musculus
agatgcttttcttatggacatgggccaaagtttggaatcacagatatggttggatgtctagcactgggactatgaggcttgtgattttacattgggtatttctgtacttaagtttcttcatcataggtatttgtggcttttacttttagaaaaaaaaataagttgtcatttggagaaagtgagacagctctatagttgagtttaaagattcttctttagacagtagaatttttttttaaatggtccagacagactgtagcaactgtatcttattgctgaaatatatgtctgttttccaattatggcctcccagtcagtgtgttttgaattgttaacaaaaatgaatactcttttactctttgctaaattgtcaggctccacatattttataattgatacgttatgtagcttatcatccccactgttgtagcgcctattatatttcaggctggttaggggagtgtcacatagtttcattctttttctgcgcatttgtctctccatctgtgagtgcagcgttttgttgatccttgcacatattccgtgtatctgtctatactctgactttgaatctgttaatcaaacactgcactggttggtaaccattgtgctctaaaatgatgcattgctattgcaagcacgtggtgattattttccctagcgtaggtaacatcttgtctacaagtgaacataaccaagtacaaggatttgaatatgagatatttatagtgctattgtggcagagttactcaataagatactgaacgatcattgtaattatctcagttcacttacgtgcttatgtacttgggattaataatactcatgctatgataatgcaacagagagtgagcatttatttatccacagggattatgcaagataatgtaagtcagagcatttttaaaattttacaaatggtggaacatggtacagttgtaggtctgtcctgttactgtgctcttttggaaaccagatggtagtggcaatgtcatgctggtggtgggagtagaaaaggaagagctcactggttccttttccaacttctttatcaaggctaacactaccattttccacagaagtgcttccacaagattttaagttatcctcacagcactcataaacatgtttgaacatctacctaaatctaagagaggaagaaagtatgcatgaaagtatactg

SEQ ID NO: 34844 - DNA, 1206 bp, Mus musculus
gtggatccttgggagatgcagctgccttggttgcagttgctcaaacgcagtcgtctacttgcccacttctctgccttagtcccagggtgtcgggaggcactggagtccagccatgcagccgggagcagcgctgcaggctatgttgctggcggtgctgctggccaaaccgagggattcgaagggtcgcctgctgagcggtgagtgtgtgtcctgggggagagggctggtgccagagcacctggggttgatgcacccagtaaacctcagcagttgaggactgtcttcagggtcactgcaccctggcccctttatgtagtggggcaatccccagatccaaccccggacccaatcagccttcttgaattctctgcttccagggagcaaaaatgcaaccagctccagttcctggggccaccctaggtatccgcaacgctggaagtcagttctctccccggggttactaaggggtgaggaggatgtagcttgggtggggcagttggcaaacttcttccagtgagtgccccttgagcgccatgctgcctggacccttctagtggaggcagccgatcctggatccgcagggctatgggaactgtacctgttactctcctctgaggggagggtggctggcctggaaatgcttggagattgggaaagcgcctagttagccaggaaccagccctgccaggctccaagagtgactctctgcttccttccctgtgtgtgtgtcactgcagcctcggacttggaccccagaggaggtacagtggtccgacttctttcttgttccactaggtctgcatggggcgcgggggtgggggggggggttggggggtgggtgggaggagcgtgggcggggagcgatcggtatctttttatcaggttccctttggccaagagggatggagtagaattggaatctccactgtattctagcttgtgggtctggtttaagaaatctaactttggtttcaggattgggagggggtgtttggctaagcagaggagctgctgacgccactgggagggttagggctgcatggctctgtgcttggtgacaggagacctcctgcctgcccttccccttcctgcaaatgagaaaagaaagacacttcctgaaggcaggggaaccagatgggtcctgggcctccttccagctctggtactccctagaactcactagcatacactagacatatgccgcca

SEQ ID NO: 34845 - DNA, 1206 bp, Mus musculus
gggtctggagttaatctctggatgaagactaacccgaatcactgttgctatcataacaaagccaacagatttctggggggggggggggtaatgattgctgagtgttccgcatatctgtggcctatggggagactgactccatccccaccgggttcctgggtcaggaaggtagttttcatttgttttcaggtgagagagtatgtcctcggtgtggggtggatggatagatcctcagtttatcccatcttctacatgtatgcaggtttattgatttggccttgcaggttaagtagtgatttaattcttctttcattgatactgttgtgtaagtgtattgatgatgatgtgtgtgggcacccatggcacatatgtgagtgtattgatgttatgtgtgtggggggcaccatggcacatctgtaaagctcagatgaccacttcttggagttggttccctcctccctttacatgactgccagggatccgacttaggtggcaagagcctttatcttctgaactatctccctagcccttaagatacagttggaaattactcacagtgctaaactgctgcttcctttcccagctcagaagataagataacagtccacttcaagaaccgagatggcgagacgctaacgaccaaggggaaaattggcgactctctgctagatgttgtgattgagaacaacttagatatcgatgggtttggtaagtgtttctgaaattttccaggtagccttcggaataagttacagggtttatttttgttttttgactttaaactgtgatgttctaaggaaatattataatttaggacatgttactctttttttttttttttttttggtaaagattattagagtagaggctggagagatggctcagtgattaaagctacatactgctcttccagagttctgttcccagcacttaggtcagttgccttattgcctctgattctggctcctaggatcttataccctctcctgtcttttcaacacgtgcacacatatggcacacacccaggcagagacatactcacatatacactaaaacaaaccagatggataatgtagtaacactactgtttacttctggaaaggaactcaaatagccacttggctcagaggtctattgtggcccattgcctactgtgtgcctgtttgctgcaagcccgagcagatgagagatcagctcagaagtagt

SEQ ID NO: 34846 - DNA, 1104 bp, Mus musculus
atgtttgttttatatttatttattttatatcttagtacactgtccctgtcttcagacacagcagtagaggtcatcagatcccattacaaatggttgtgagccaccatgtggttgctgggaattgaacctagtcagtctcttaaccactgagccgtctctccagtacctaaaaaaatgttttcttaaatgtaaaatgaagaagttgaactggagatggctgtcttacttacattttagcacatatttacaaatgatgcttcatttgtctttctgactaccttagtaactatatatttaaaaaatattttaggtcagaattgaaattcaagataatatgttattttagtaccattttacacttgttttagaaattaaaattttctcaacttgcaaatatttttttaaaaatatctttaaaacatagactactaccacatgaatacgtcttagatatctttagaattacctatcagtttacagctttgatgatggtagaggagaaagctttctcagcttttgttgtctgggactggcttgcctaggactgcatgaagaaaatcgaataggaccagcagaacctaaacccaggctgtgaaggactctgacctcactaactagttccatgccttcaggcaagcctcttaaccacttcttcctttctttttagaggtataggagttaggagttggaatactaaagtaggctggggagaaggcaggcagttaggagaattagaccacgtctgtaagtgcctttaaagtgagcatactgcagatgtaagatagtcttgtcttctgcacttcacttgggaactgcgtaagttgagagagagagagagagagagagagagagagagagagagagagagagagattactacactattaagctaatatatataataaactttttttttggttatttttaaggttttaaacctgagtgtgtgtgaacttggataaagttgtatcctttgtcacatattctgttatgaatgtagcagtatcagagaggctgtttccataagacttattagggatcttcataatgcattcaagttattttagtgtagtatttatttttttaaatatttgtaacttttac

SEQ ID NO: 34847 - DNA, 2496 bp, Mus musculus
agagatgaaaccaagaagacacagaacgatgttcttcacgctgagaatgtcaaggccggccgtgataagtacaagacccttcggcagattcgacaaggcaatacgaagcagcgcatcgatgagtttgaagccatgtgagagctgttcttgtgatccatgtccttcataagctgaaccaccaccagagaaaagcaggcctgtgcagtgcagatgcaatggaacgcatcccaccttgccaaagcactcataccagtcgactgtgctcactagcaggacactgaagggtgtccttcatcattaaggcagtgtgatgtcatgtttggtcatttttcttttgtccagggaatggataatgacattctgtcacccacccttttgtacatttttcactttttgtttgtttcatctttttcagttgaatattaatactaatggccacgtctgacaaatgtgtgtatgtgctttgagcactgtgtacatcttaggataatggtggacatttcagtgcatgtttagctaatgaacttagttttctttgccctttccatgttgtaggctacatacatctccatgttcattctcatgttttttgtcagtgtgaccttctcatgccctgtcatgatagagctgtaattctggtgtcacacggatcacttactggaggtgtataatatgagatagtgaggcagacagacagacagacagacatgggactacatcataagatgattagaatgttggacagcgtagtatgcagccagtggttagttattacaaagatcccttagttactgtattgtttgctttccttaagtgcagtcatctctgatagcttgagtgatggtgtttcaaatcctgtagtcctatggtggctttccttgcctgttactttagagatctagccactaggcagtcgcttctaagaaaattattgatgaagtggccttgtaagtacatggtctctgaaaaaaattcaagttttgttcttaggatgtccaatagaagataactgtggatgataactaattctaattgttgaagggggaaaaaaacccaaaccttggcctttctgcaagggcagcatatggaaacatcaactctgagaacaaaatactacctcactctttacgtacgtggtgactgtacgcacagtctgtgctgcatgtctgtcacccatacgcagtctcaatcatggccttcactgagtgcttttgagatcccagtgctaatgttttaactgcctttctgttgaactgtggggctctgatttgtgtctagattattgtatattctcactggtatgctgttccctggggggtgttctgtgtccgacgctgagtgaccctttgtgagaaagacgttgcctttgcagtacatgaaacatcccattctttgttcttgatgggataggggtcgttattgtagcatatttggtttctaaatcactgcttatttttatttgcaatctctaaaaacaaattttatttcaattacgtcttactgaagaagtctttccagctagaaagatgttctgacactgtctgatcgtgaagcacctgaatttacagaagatgcagaaagcctcgttttctctgcgtggttcagctactttccatttggtattatgcactcaaacttaacatttatctattaaaattgccatttcattaagcaattttcacgcacagtagattcaacttgttttttgtgctgttttttgatttttgctgacttaaaaaggattaatttgggcagacattataaaaaggaaagggttaatatatttttggactctgtaggacaaaagagaactggttaaccttgaagtgactgttgtacagtggctgtgcacgtgcttcagactcatttgcgagggaatgctttctgtatgagagggagacggtaggccttaccactcagacctggacgtataagtgctcacttttccaacacatcacagcgatagtccttattgctaaaggacttggcttccctcggagttttactgatttatttttttctctttgcattgtgtacattatcattgctacatcagttgttacagtgttgaaaggctaccagttatatttgctgttaatagtctatttgtagattaggattaaagtgggtttaatccatttttatagctgtatgaatttttctaaacaggaacagccatttgcaaaatgggttttcatagtgattgcatcaattataacatttatcattagcagttgagagcacatgttcatatagcaatgtaaaaacctactaatgagtatttggtaatttcccattagcataattttatgttgtacaagtaaattacaattccatctctaatcttggataatactggttggttaacaataaagtgacaaaagctcccgccttggaggtccgctgttgttatttaacgtggtttcgcacgtagctcttggaaggacagtctgagccatgaaccatatgaactgaaccctggatcctcaaaacctt

SEQ ID NO: 34848 - DNA, 1259 bp, Mus musculus
cagtgccctgcacatgcctggtattgtggttactttctgtctcacaaaatgtcattttaccaactacctgctctacatttgggttattttgtcccattataaatgtttgacttcatgctaatgagttaattgtttatgaaatgaatcattggatttgttcccaccagtgacaccaagaagaagcaggaaacaaggaagagaaacaacactgaagacgatgatgtaagaccaagaagtcgtcatggaaagaaggccaagtgggaaacggtagaacctttggatacaggcctgtctttagcagaggatgaagagctggtgttacatctcctcaaaagtcaaaactagacattctctgtgccttcctgtactttgatacctctggatattactatgtgggcaagaaattgaaaacagctttggaaaacagttttgagttttgaaacatcaaggaacgtactcagaataaggacgtattgtatactgttagaatttatgtataggttcttattccccaccattggaaatgcttgttttgtttattttcacactgttgaagattaaaccaaggccttgtacatggtaaataagagctctactcctgagctgtgtacctagtccttgcttgtttgttttacaggcaaggttctggatctgttgttcatttgttattgttaagtatacataataattttatgtatatttcattatctccaaagaaagagtataatagactagccctgacaaagaattttttttaattgagttcataaaaaaataaacttatttcttacaaaatactattgtttttattgtatccagtgatatgaaagacactcaaagatagattcataaaattaaaacgtgacaaattcctaaaacaagttttttgtattgttaattagcctgctcaaatgtaacacatcacactcacatttggagattgctggcaattatttataaaatctctagacatctgaagacgttcttcatgtgctctttagtaggtatcatgggactccacctagctccttatgagaaaatgagatagaacctctgttttgttaccaatactataagtctttaaaaaggaaatgtggagaaatctgggtattgacatgaaatgattgattttgatgtagattgttacacttgggattcttttcctaaccctttcttcctatcccattcacaatcaaaactaatttttagtactagcaataaattcaacctcttaaggaagaagatagatggtaacttgg

SEQ ID NO: 34849 - DNA, 1192 bp, Mus musculus
tatacctatcatttcctggtgtggctccttggactcaagagacattatccttccaacatatgatgtcacccactccacactcgaagcaatgaggggtgtcacaaatgatctcctctccgttcagggaaacacaggtaagttcagggaagaaatcttaaaaggtgaaaggagtgtttaatcagaaagaataaatgcatatgcttaatcagtctttcttccaaccaagaaaaatgtctgcctagcatgtctaagggcccagggtccattcccagcaagacaaagcaggggaaaacggctgaaggagaatgtttagggtgctcccaatttgaaaattaaaaacacatagtttgggataataatgcccaagcctgtattcatggagtctcctttgaatttagccatttttaaacatctttcaatctgctctacacttggttatatttgcatgaaaatttacagcaaaaattaaagatatttaaataatgtgtatatttggtaaacttgtcacctaattctgactccagtgctttttattattgcataaaatgagggcaaattccaaaaagcgtaagaggcttgtgaccatggtgtgctctgggcattaggaacccatcctccatcgctctgtaaggaatcctcttacatctgtgcctcccgagtctttagaactggagtccttctctctgtttacggttccttccattttgatacaataccccccccccttttcgggaactcactgggctgcaccacactttgttttgtcctttcgttgctttcatgtcatttgggggacaagatcagagatttgggcaaagtacccaaaggtgagaaaaggtaataaaaataagatgaagacgataggaaataaaagtgggcctactttcaatttgatgacagtgaatttctgacaagtaagctgagaagactggatccctcccattttcatcttatgatatctctgaggcgctgacaagtatttgaccaacaacatcgttcttttagaatagtaagatattttgtcagagattggaatttatttttctaagacatttcccttctgtaactggcatggttgctcatgcctatattcctagcatgtggaagccctgaggcaggaggattgttactagtttgagatccttctgggctacataacaagcagcagaacagccaagttcctagctcaagt

SEQ ID NO: 34850 - DNA, 1134 bp, Mus musculus
gcttgtttgtgcaccctagtggataaaaggctcataaatcactgggaatccgtgggtggcacgctcaggtgcactggcttgcttctgtctttatccaagataaaagtcgaattcacttacttttatattcaattatgaagggcaaagtgtttggggaggctcgactgtctcctccctgtgttgtttctcctcttggtttttttggttttttggtttttttttttttgtttgtttgtttttttgtttgtttgttttttggtttttcaagacagggtttctctgtatagccctggctgtcctggaactcactctgtagaccaggctggcctcaaactcagaaatctgcctgtctctgcctcccaagtgctgggattaaaggcgtgcgccaccaccgcccggcaagaatttgtatctttaactagatcttagaaatatcagcatgacaaatatcccatatggacatgagaagaaagactgcctccctcgcttctacctctttaaccacaggttcagaaagaaaaaggtattttgttagagacacattaatttttttaaattgatgtcgtttgaggctgaatagtcctagcagaactaggagaaaaagaagttgaaacaaactaggcagtttctattgacttgtccgattctcattttgaacagtcacaccttggaacattgcactggacacagagtctttgacacacaaacctgcaggggacattttacatccaaaccgtaacaagtctatcaagaaatctaggttaactccacttgaccgtagcctttgaaatgagttttacatggctttatggttcattaacttgcacataccttaggggaaccagctggtttattaagctccaattccttcccttccaacttaaccaattgtccatatagtccattagccacttttaatactgaagtatttatcaaaatatatctggcttcagggcccatgagttaagaataaggagaaacccccagagagggactggagggagaaaggggacagtgatataattataccttaatttcaatagaagaaagttttatatgactttcaaaaaagggagggatgtaaggctataaagatataggtgtgtttatttgaataaactgtcaacaatgttt

SEQ ID NO: 34851 - DNA, 2664 bp, Mus musculus
cctttaaaagctctgtatctacagcagagaccagaagatgagtccgacctccattccacccccaatgcagatgatcaagaatgcaaacaaagtcttaggtgggatatttcaggaaggacctgttgttacttagattttcttgttcccaggccctccatggttgcacctcattgtaatctttgtgttcttttatcattagtgatactgaccagagtttcaacaaagtagctgagcgtgtcttgatgagactgcaagagaaactgaaaggcgtggaggaaggcactgtgctcagtgtgggtggacaggtgaacttgcttatccagcaggccatggatcccaaaaatctcagccgactcttcccaggatggaaagcttgggtgtgaccttcacccttaaactcgaacttcagaaatgacatctcacccaccatatttggacaggaattacttaagtgaataactgcttttgatccaattttctacttgactgatcaccacctaaatattagtatttctactctcttctgttagaggtaatggtcactcaagatccattcgtaggatacgtgctgactcttaggtcatgcttgtgctactgcagcaagaccgccgcatacacactgaactgcaaatggtgggggcagcagagtgagctttactgctggtgtacatgaagacaagttcgtaacttctgctctaaaacaacctttaattaaagcatgttttccagactgtgtgtgtgtgtgtgtgtgtgtgtgtgtgtgtgagagagcatgtcacacacattaagtaatgaagtgcttaataatacttttcaaaagggactctttaaaattgtaactatcactatatcatgggaatccctcattagaatgaatgtaggtagggctggagtgtggctcagtgggagaacatgtgcctaacctgtaggaggccccatattcagaccagaattgcagattcaagagaaaaaaaaaaaaatagagcatgttgaaagcaagcagtataagttgagccttcttaattcttaagtccaaaacatgagacattttcatgttgaaaactttctgacatattgggctcattttagacttgcacattatattaggcacacagctagtcttagctcgctgtctgcatgaatgcttcccaacctggaaacgtctaaaactgaaagcaactctcagcacacatacacacactcacaacaataaagtaaacaacttttttacaaagggaaaagtagattgcatagtttcagctatgtgccctggaactaacagatccacctcctggggcctcccaaggtgcggaaggaaggtcggtgttaaaggtgtgccacaccatattccactttattaatgttccaagtcctggtctgtcactaaccatctttaaacaccgcattgggatcgtcttgttaaggcaagggctgggtgggcggttggttgtattgttgattcttgtctcgggggctgattggtcattttgtcattttgaaaggtgtgctcactcatacacacaagcacacaccgtgtgtgggaatccagagtggcttggttaagaggggttcttccagatagtttgcttctgtttcaccctcagggattttactgacatttcttggctccggagctttagatctcaggagtagtgtagattcccgagagcagcagagtctttcaggccgcagtagacctgttctctctaatctgtatgctaatgggcataatgttgaattgatgccccttaaaatgaaagctcgacctgtgtctcactgtggtggcagggtaaagggagatggcatttaatgcttctcttgtgctgtttgcaagcctaataccacacgtgtgtgtgtgtgtgtgtgtgtgtgtgtgtgtgtgtgtgtgtgtgtgtgtgtgtgtgtgtgatttgtattgtatatacaaagccaaactactcttttggtttctgtaaactgctatgaaactgttctgcatttcagctttcttgtgtattttgtaagaattgttaaatggatatttggcatctgcttgactgcagtaaatcaggcggatgtaatgaacttagaatgtctgtaagcaagtgttgatgtcttcatggatggaggaagaaaattagctaatgatgtctagctaaatgaatttgtaatttgtttttgtagttaatccactgaagaggttggaatagttgatccattcttcacccttgaataatattctgttaacagaatatattcagatttcttcagtggctttgataaatctatgtcaaaatttttcagataaacccagaagctgctacttgaaaggtgaaaaagactgagttagaaaatctttctgacaggtttgagtgagacgggctgttaccaggagcccatgagtgatagttagatttataggttactaagaatcaggtattttctttatgctgagtacctgacatgtctatcagcagcacctctgattcttacaacaaaactttgtaatattcctgacggtgccacagattatctggagaaaaattacttgcctgaggacagaagacattgcacatgtgttcctcacagaagctgctagaaaagaaggaggcagcatgtctgtctgtctgcagtaaaggaggcagcactcctcttccagccctatgctgctgtacccctcaaatg

SEQ ID NO: 34852 - DNA, 1217 bp, Mus musculus
ctgtgtttctgggttacaggtgcttatgaatccatgaaagggaaaagtatcttgtacaacttatatgacttgctagtgaatgagataagtcatataggaagccgagggaaatattcctcaggatctcgtaatattgctgtcaaggaaaatctgattgacctgagatttgattgacatattggtacttattttgctctcttaaatgttaatataaatttaatttttatgtaatctcatgtaattaaatataaatttaaaatttaatcctgttgaaaatacactatttgcagttttggtaagtgtccccagaaaataaatgtagtaccctacttataaatacttactaaaaatgtcattactgctatgtaaaaatatttatctcttaatgtctttagatatttctataacttattaataattatgagtccctatattttcagttgagaagtatttttctccccgatgattcatttaaaaattgtagcaataaaaaggtgttttttattttgcagctttttgatgcagataccagatccgtggagatttctcaatcttatgtgacacaaagggaatccactgattacagtgtaccttgcaaaagaaggaaaatagacgtaggctgggaagtgataaaagattatcttcagaagtcacagagtgattttgatctcgtgccttggtaaaatgttgtattttctcatttggtgtcatttcaatcatttcccccagaaagccttctttgctgagagttgttatttgacggtgcccagacctgctgttagtggcaggtgaagtgtgattgctgtagataatccctaaaaggctcatctgctgtgctagacaaggctacctttttagacatgtagacacggtttttgtgttttcctttttcctaactcttattttcattcatatttaaatgtgcacaattccacaatgacagattaactctgattaggatcagtagactgtatttagccaggccagttttctttgctgaaagggaccagctctagaaatgttaaccagcatgcctgaaggtacttagagacttaacagattgtgggagggggagggggaatatttttcaccttgttgctggaatatgtatgttattgagttgtgaagaaaagctatatagactttgttatctattgcttaagtttacatttattctatgcagttgacagttctacttcagattttatttattcttt

SEQ ID NO: 34853 - DNA, 1177 bp, Mus musculus
gttacttctcttagtaagaccttatttcttattaagaaattatattctttcagggatattaaaccatcagtattgctggggaatcagtacatgaaggagatatttacacaaacagagctttggttcttgctttctttggactcctttttgtcttttcctaaaaaggccaagctcttagaatgtttccccaatttatgaagacccttcgtatagtttagattttatctgtcatgtgattagttggttatgatcagatggttaatgatggtgggtaggcatttttgtagcacataaccagttaatcatataaaccatggcatcattgaacattttcaggtaatttctacgttgtttttgagctcttaagacaaagtaaagcagaacttaccaaatttaaccaaaaaattaaagctcaaattttaccaaagcatatttgagagtagaacataatgtctcaggtatttctagatggctatgcatttctataacaagtagcagtgatgcactgttttccagagccttttctcaaatacactatgcaagcttgtactgatttacaatgtatcatgaactatcatatctgatattcttttcccaaggcatgctagcacaattgatcatatttttcataggtcgtggataaatcatcttctttttgtttttgcttctgtttttgttttttcgagacaggatttctctgtgcagccatggctgtcctggaactcagaaatccatctgcctctgcctcccaagtgctccgattaaaggtgtttgccaccactgcccagcaattatcttttttgtctaaggcattgcttttcaaccttcatttcactgttataccctttaaggagactttgtaaagtttttctaaccacccttcccacaaatatttttaatctcacaaaaaaactgtacatctttttatattagatgtatatttcttgtattaaattttccgatttctctgaggagcagtttctaccctcttttagaatgctgccacttcttaggaatgaatgtgtgttctacaggaaggaaaaatgtttaggagtcctatttcataccgaccacctgtcataagtctcaagtgactgaatatacatctaggtgattaagcttttagatctctctatgatgaaaaacaatttatttggtggatctaatccaaatccaa

SEQ ID NO: 34854 - DNA, 1115 bp, Mus musculus
gaagaaccagccccttcagataaacagctctctaatgatgcagcgtctgttgacttaaatcctacggaaagcaagacggagccacttcagtctgccagtgctcaagagcccgagcccccttctgtgaaagatggagatactatttttctctctttgagtgaacataacagctgtgaagaagttgcactggttcttggagaaggtaatcctgtaaaaaataataattcgctttcttcagaatctggtggttcagtgggagtctctcctgagacccaaaatactgatggtaaaactagcaactcaacagaggtagatgcatcaagtattgtctctctcaaaattatcattagtgatgatccatttgtttcctcagatgcagagcttaacagtgctgtgtctagtatcagtggagaaaacttaccaacgataattctgtcttctaaatctcctgccaaaaatgcagaatttgttacatgcctatcttcagaagaaactgcaagtgctgttgtatctgttgaagtaggggattccggctccatggagcagaaccttttagtgctcaaacctgaggagcccatggtaaacaacactcagaatgaagatggcattgctttttcagccaatgttgcaccatgtgttcctaaggacggaggatacatacagttgatgcctaccacaagcacagcgtttggcaattcaagtaacattctgatagctacctgtatgactgattcaacagccttgggaccaactgtcagtcagtctaatgtagtggtattgcctgggagttctgcacctatgactgcacagcctcctcaacagcagttacagacaccacctaaatctaacagtgcgtttgctgtcagccaagctgtgtcgccaaacttttcacaaggtaacttgtaaaagcatatcggaggtgagctggggtatagtccagtggaaaagctcttgtacagcatgtgcaaggccatggactctatccagcactgcacagaacaagatacatgtatgtgtgtataatgtatatgtgtgtgcgcacatattttggagcttctctggattgcaatcttaattttcttgtgtgaagtcacagactaggaaaataatataga

SEQ ID NO: 34855 - DNA, 2204 bp, Mus musculus
atgttttgtaagtttatgatttgacacaaatgaccattttaaaggaagcatgtctcttgtctgaacattcatatatatactctagatttgtttttttgccttttgccctaaactaacgttgaattgggttaataaaacctgtctgtctttccctatggaaataaattctaacaaactcaaaaatgatgcaattttaataataaagagcctaatacggtgttttaggtgatttgctaagaaaattatctggcctagagtttattgtttttccttctcttcttttttgtttgttttgacagaaaaagaagctacctagttcatttccagcaggaatggatgtggacaaattcttgctctcattgcattatgatgagtgaacgaacacccagacacagagaccagtagctatttaaaactagtgtccttcagatggcgagtaggaaacgggccagagacagactgcgaacatgacctgcactttgactgtactgaggtttcactttatatctaagtcatgctgtttctgaagcagcttcctagtttgtaaatagactctcatggaatatttgtattctaaaagaacatacgcagaaatgtaagtaaacccaatctgcaaaactgtacagctttgacactgtatattgtacatgtgtatattgtgtaaaaatagagcttaaatcaacctaatattcccacactgtcttgattgacttcgcccgaggcttattcttctggagtactttctcatctcctttggaggaagatgataattattcttacaaattaccttcagccaatattagataagccactaagtaaaaaataataatgataaccacctcaactggttagtaaaatatctaatcagtaaacaacagttggatgatgatttccccctagagtcaatattttatcacccttcataaatttcagtaaaaactatatttctgaagttttatactttattctgatcatctattctctttgttttaaagagatttttataaaccatttattaagtgttctgatatttcacttacaactttttgaaatcttttacagaacattaagtggttagactattgagccataaaaatttgagttatgtagtagtcgagatttcttgattatatgtaaactttccctaagcactggggatacaaagaattgcactaattcatagactttttcacatactagtgaccaatgcacatttaatttaaatcttgtatgtaaaagcttatatggaggattgtcttctggtgtctttgaaagtcatatccatcataagatgtaaaaatgcaaatcatagttatattgtaatttagtttaccctgaaatgggatgtgtaaataactgtgttcatacataacctatagaaccttgtgttctttaaagtgttataaatagttactctcaaaaggtccttaggggagtgagaggtgccttctctgtgttggactgactcataaacaacagtcaagttgaaaagctggcctaaactttaaaggaatgacagaaattatcattaatacttgaccgattgtgcctagatattgaagtgttttcttaagttcttactgtttaaatatcagcatattaggatttttttttctacgggtgtatattttattaaaaagtcactttcttcaaccattttttgtactgggcctttaagaaataaatccatcctactgtaacaacaacaaaaacgtcttcaagatgtaaattatgtctttttaattgctagattttactgtacaaatttatattttgagaaatgttctatgactgagctgttctactcctaaggagctaactaagcatacagttactgtttgcataactcagtctgggtctgtcctacagttaggtttgaataaatatattttcattaactttaccagtttggatttatatttagaaattggttaaatttctttgtagcttagttaattctctgtgtttttcaggaattcatataatgcaggaaattacagattttctcctgtaactcatatctatgtgctgcataatgagaattcatatataaactaactcatgctcttttctatagctctatgtgtgtttttagtcagtgtctttcctgtaggccaggctggctttgaactcattacatagtccagtgactttgaagtcctggtcctcctcatctacctcctctaagtgccaatattgcaggc

SEQ ID NO: 34856 - DNA, 3447 bp, Mus musculus
acaccttcatctacatggcctagccgggccgctgctgccgcacacacgcccctgaaggcctgggcagaggctgtcccagccccagctggaggaagctttatttggactttgattacataaatattaaactctgccttaccttacaaaacgactctattttgccagtcacattagttagcatgatggcattcccttcatgttgcacactctttaacagcatgctgttttgtggagaaaattgcattcatgaagagcccattgtgaactttcaaagtcaattcaatttttacccacctagagaaataacatgtcggaagggtgagggtggggttctttttgcttcttttatccccttttcttcttcaaagaaatatacttgcacaaggaaggattttcagatattcatgcactgaaaaatgctggggatttttgtttgtttgtttgggttttttaaattctttttttttttttttttttatgaaattaaagctagacgtagcactaagctacttctgatgcaaagaatgaatcgtcaacactgtgctgggcaagggcaggcacacttgagaagacacgtgtgccagtgtcaagttgtttgtcaaacactgctttcactttagtgactggatcttaatggtaacctgaaatggtattaaatatttctaccttataaatcctgattttcaatgagcaggagagttctgtttagttatttgttgttaaatgataaagatttgggatttttcttttaaaccttgtacggctggagagcttgttttgaaaacatgaagtttataatgaatgttgcttcagttaaaaaatgtgtgggtatacgtacattattgattgcataatcagaatcttgaagcaaaaattaagtgtgttactaatacactcaattctcatacgtctaatatttattatactgtacctgaatttgttgaaaacaatgcagaaatattctgatgcagtgcagtgagagaattgctttcttaacctgtagcatagaattatttggtgattgaaagtgttgtgattagggatttaccacctcagttttctggaaagacattctctatttaaaagtaataattacctgccacttagcaggaagaaaggtgagattacaacctgcaacctgaaaagcactcaaagttgttagtcttaacatgagcagtaaccttgccaaatatgtacatatatttatatattttaaaaataaacatttttaaaatgttcagagggcaacacctaccttgctcctctcagtgatccagagcagtgactcaggactttacagagcagtggaaacttagagattgaggactcaagcaactgaagagaattattccccagcaggaaaaatggctccctgtggattttactcattgtggtgcacgtttcgagttttcttgcaaattttagaacttttgatgttaagtagtattttgaagtattggttctgaagctagcagaagatggagtgttgagaagcatacagtattatctatcctattaccacagagggctgtggatctgccctgctgctcagcagctggggtctccttgctggaaagaagtaaagtatatgttagatgtttaaggctttgataattatagtcatatatctgttgtgaaactcataggaagttggaagtgcatgtgtgcttgctgtgccctgcagctctgaggtgatggctaaagcaggtgtgcagcgcaaactcagtccctgctgctctaccacgtggaggatggaacatccggaatttagagggatagttttatcatgactgttcaatagcttggtgttggcaaattttcctgtcccaataccagaatgccaaaggaggaaacaatcaagggaaaaattttaggccatttaaaatgacaaaaaagatttgtcattttaaaccatcattttctttagaacatctttgaaatttctaatcgctttggtcatttaagaatgagagctgtgatgttttgatttataaaggcaaacttaatgcaaagtgggtaacactaaatccatagcaaagttttttattaaatttttataaattttttaatagttaattatgtcctaattgtattttggggaatgagcagcagtaaataccacagacttaacagtttcatccttttttaaaaatatatatataagagtgtaactactttttggtgtttatcaaaactatttagttgacaaggtgcctataccattgttgggattttctttaaatgttttatgaatagatttgataatttatctgaagatccagaaccactgacagcgcccctctctctccctgcagacttcatagtcttgctatctgagcagggccagacatgcacagggagggaaggagaggccagctcccactcacactgggaggcattgttaagtgaacggtaccgcaggctcagatttgagcacttctgtctacctaaggtggcgccatctgtaaatgctaacctgtcaccaactcacggccagagtaaggagacagggaacagatgcatgcagtggaaaggggagactcctggacgcgcagttagacaaatgtgaggccgtcatcagtctaataatttataaggatcctcaatcaaattctgaagtctccgactttcacagttcttggaagggatccctgagtttaccagcgtgctcactgaaagctctcactctttgtgcagaaatattaaagtctccgaaaaggtgaactgttaatcattcttattttttttaactcttcattaaattgaatatgatatcattagctctgctccaagggcaaattttcaagtttaatctgggtgaaatatttgctagtttacagaaagatttgctatcatatcaatagctggctcttctgtttttgtgtgaatgactgggatgctgacacaagttgtcccaaggtcacagttatgagagaaacactgttggagagcgttcctgtcatctgcactatgtgtggtctggagttcctaaggtgtagcctctcatcgtgacctgtacagttttgaatgtgcaccactacatacccggatggcactgtacagtttcccacggtagcagtctgtatgcagtaggctgaaatattttgatgaacgcttaatttttggattttattttttaagttgtataatttattttcttgcaaaataaaagtgtaatataaaacatttcatctatccagaaaatcttgatgttctaccataaaaatttttgcaacagtaaaaaattttggcaagccagggcagtatcatgtacctttaatcccagcattccagagacaggcagaggatctcagagttcaaggtcagcctggtgtactggtaagttccaggccagtcaggacgaacctgtctttaaactcaatgaaaattgtttcaattggagagggctgcatctgtcgtccagctgcttgggaggaggtggtagct

SEQ ID NO: 34857 - DNA, 1203 bp, Mus musculus
atccgactttgccatgcttagggtgtgcactcacgcatgtatgtgcacgtgctctctcacacaccagcaatgtttatcctgcccagcagtgctggcccacaactttaattggagcactcaggaggtagatgcaggcggatcttgagattgaggtcagcctggactatagagtgagttccaggacagcaagagctacaaggtgaaaccctatttttaaaacagcaattaaaaacaaacaaaacttttctcttaaattttagactaattatagctacatgatactaataatatatttcaaactcccaagtaacatttcttcagaatcttatgactgaagacctagctgccaatagtgcctcacaccttgggaggcagagggaggtaggtgtcttgagtttgaggccagctagggtgtagtgagatcatgtcacaaaataaaaaacagaaggccacagacattaatgaagaaacaattttattcttataaagtaattatatgaatgtgttgtgtcctttcagagttacatttgatgttttccttgatggacaaagttcctaatgggatagagccgatgttgaaggacttggaggagcatattataagtgcgggcctagcagacatggtggccgcagctgaaaccatcactactgtaagtagttccaaagccacatctacaatagtggttgaaacagcagactagtaaatcattcagatttacttttaagaaaataatttcccccaagtttaaaccgtattttcttttaaaagctaatatgaaaacattctgtttccaggactctgagaagtatgtggagcaattacttacactgtttaatagattcagtaaactggtcaaagaagcttttcaggatgatcctcgtttccttactgcaagagataaggtgatcttctctttttggccattttgtataaacgctgacactgtagagttgactgactgagcagtggcgtcatactgctgagttgagaactaagaattcaggaactcagattttctgtagagcacagcagctctattttttacattttgcttagtctttttgtattattgtgaactcggattcaaccaggaagcttctcccttcttcattttttccagggatattttcctgtgttttgaaggttcctgctggttagatttttcttcattctccattctccctttaagaccagccttgcta

SEQ ID NO: 34858 - DNA, 1197 bp, Mus musculus
gtacaattttgtttttcagcgtgtactgagccatcaagatgacacagctttgctgaaggcatatattgttgaatggcggaaattcttcacacagtgtgatattttaccaaaacctttttgtcaattagaggtgactctattgggtaaacaaagcagcaataaaaaatcaaatatggaagacagtattgttcgaaaggtatgtgtctcacccttttgtttcttgatgttacctaatgccctttatgtcatttatttatttatttgtttggttatttattatgagtacactgctgctgtcttgagacactccagatcagatcccattacagatggttgtgagccaccatgtggttgctgggaattgaactcaggacctctgaaagagctgttggtgctcttaaccactgagccatctctccaccccccccccccccccaattaggaagaaggtgttcattgatttatgtcggctttgctctcacatgcagacactttatggctgttagctttgttttttcatgaaactttcttttgcactcaaatttttgtttcagctttccttatctttgtatgtcctcttaaactgtaagtctgttttcaaacataacctcctctttttttcttctttagcttttccttcagtatctttttgttttattcctttgtactttatctttttatgaattatttattcattttctctttgaaaaaccatttcttctaattttccatttaattatgctgaccaactgttatctttatagttactttatgctagtttaaacttggtatatactgtgttaatttctttacagtgcatgttttctaattaaaaaactgtgcccggtacctacttgtgctttagtcctgtgtgtcacagggtttctttccactctaagatagttttttaaatttgtcgacctacttaccagttaccttcctactagtgagacatgagtgaaacttacacgcttctgtgtgagcacatacacgcttctgtgtgtgagcacatacatgcttctgtgtgagcacatacatgcttctgtgtgtgagcacatacacgcttcagaagctttaccactgagctgcagcttcagccttaacaaaagtgacaaataaaaactgccatttgaatttcaaaaactgtctgctgtgatggttaggttaacagaccagtaccagaattgtgtggcctgg

SEQ ID NO: 34859 - DNA, 1139 bp, Mus musculus
ctgtacagatggttgtgagccaccatgtggttgctgggatttgatctcaggacctaggaagagcagttagtgctcttaaccactgagccatctcaccagccctagtcccaacatttttgaagctgaggcaggctgatctctgaatccaggccagtcagggctgtcattagagcctgactcaaagcaagagagaaaaagaagtactgtaacttcatgacaatatactggaaagaccagtaaccaactgagtgaagtcagatgccagaaataggaattttcaaaaagatctttgtagctttacctgatcttggtactcactgtgtagaccaggctgctcttgaacttaagagaggattctgggtgttccccacaaggcctggctgatagtctgattttctatagctagtactgttgtaatatgaaggacataataaacagacatttgattctgttatctctacattgtcaaacatttacctattttagttgttggaacttttggggagagggattccaaatactcatattttgaaaagtactaatcataaaatggggagactgaagtttgtctttggaatatgtgaggaccagccagggtctgtctatgatttaatatatgggattattaaattcagggctgttactaccttgagtagctatagagcttactggggagtggccaaattagcatattttttgttggactagtatattggcttatttgagaaatgccttggacttatgcaagtagattttaccaaagagagaattagcatgtccatcggtcagacaagagtagtgtgagtcagtcccagatctaccagctgtacctgacacatgctgaataatgagcccgagccccttcagggggaaaatctcagcttgcttgtgacttccagaaaggtggtttttttgttttgtctcatttgtttggggttaggttgttttgtttttatagttgacagaattcagagaaataactactagtacatttgagaaaataagattagaaactttatgaaatttctaagaatctgatgcaataagatctgcttttatattggcattttattttatttgggatcatgttttctggttagatcaagtgaactgtcaattggattttggcaattttttga

SEQ ID NO: 34860 - DNA, 1204 bp, Mus musculus
cagaaaagcaacgcccggcttcttagcattattgtttatataataaaatggattatcagatacaattaaatactatacacatctggcagtcataacggcatataacttcaatcccagggtatctgatgccttcttctggccgccatgggcactatacacatgtggtacagagacgtacatgagagaaagtggagtggggagagagagagagagagagagagagagagagagagagagagagagagagactttttatgcaagccaggtagatataagctataagatcgtggacaaaccaaagattctctacacattaattatcttacttagaaaatggcacttgccaggcgtggtggcacacgcctttaatcccagcactcgggaggcagaggcaggcggatttctgagtttgaggctagcctggtctacagagtgagatccaggacagccagggctatacagataaaccctgtctcaaaaaacaaaaacaaaacaagacagaaaatggcacttgagtctacagccatatcaccctgaacacgcatgatctcatctgatctgatcttggacactaagcagggttgggcctagttagtacttggatggaagactacctgggaataccaggtgctgtaggctaaaaaagaaaaagaaagaaagaaaggaaggaaggaaagaaggaaggaaaggaaagaaaagaaaggaaaggaaaagaaaagaaaagaaaagaaaggaaaagaaaagaaaagtaaagaaaagaaaagaaaagaaaagaaaggaaaagaaaaaagaaagaaagaaaatggcacttgagaggtggagtgggaggagcaggagttcaaggttttaagggaattttaagggaatgaccacaaagttagttggagacaacctggatttcatgagaccatttttcttttttcttttttgttttgttgttgttgtttttgagacagggtttctctgtatagccctggctgtcctggaactcactctgtagaccaggctggcctcgaactcggaaatctgcctgcctctgcttcccaagtgctgggattaaaggcgcgcaccaccacgcctgactgagaccatttttcaataaaataaatttagtttcataaaaaataagaagctctttcctccaatgacacctactaatagtacattgaaaactatttcagggaaaagtgatgggcaaaaccta

SEQ ID NO: 34861 - DNA, 2060 bp, Mus musculus
acaaacaaacaaaagccaaggatccagttagctgtcaagccatctgagtccagtatttacctgtgtataggggagggctggggtattgtcatctcctatgatgacttccagaaagagactgtgaaggtagatgtcaaagaacagctgacaacaggccacagccccttgcttgtatgagggagtgcaactaactgcctgttttctctccacagttctcaggactctacatcctgtcgttcacagtcatcatggttggcttcatcttgtactgttccaccccaacgcgcacggtagagcccccagaaagcagcgtgccccctgttaccagcatcgggatcgacaatttgggactgaagcttgaggagagtggtctcccggagacccactctgcagtcttgtagctggacaagccacagactctggcatgtcaccaggagagagcagaacctgccactgccaagggcgcatttgaggcgacaccagcctcagaggcgaaacccactgcattggattacatccgtggttagattgtagaaaggagcactgaccagtggttccaaactagaaatactaaaatagagcagagagcccaagggtagtgagcgcgtgtgctgagtaccagtacctgtcagcgtcaggtttcagagacacatgtaagaagagaagggcttcagggctgtttaggtagttaggagttgggacagtctgggatgttggtgcaataagattcctctgttggaagcttcacgttttcatcctgctggggcagtcactgtccatggaccttgtggaatttagacacccatgaccgaaggtccctggtggcaggtggtgggaaaaatgggcggggcagcacttgagaactcccaagataaactgtgacgactttgaaagcagctaatgagtacaggaatccaggaaccctctcccagtcatatctctcaatgttttataacatgtctctcccctttgtccctcttgcttgtccctaggcacgtttgctcctgtgttctgagttctggagcaaactgctctcaaagcctgttatattgggcatccctcccattcagtgccacactatacgctgagagcaaatacgctcaagttacccttgggtaatgtcctggtgcccgggaagagtcatcccaattggcctcacctcaccaagccacagtttagaaaattaacctgctgcaacttctcatagcaaggcaagagcttgagaacttggctgctatctctggttggaaaaatgcattattgttaaaaggaagacgcactgctaatcattccccactgaagcgaggaacactgaccaatggttccatgctaggaatcctacagtaggttggtgctggggttctggagtcctgactgtaagaggagagtgtcttccttcttcccacaggtttacaatgcttgtaggtttgtgacaattcctcagtatggtgtcaacatgtagccttagcataacatcagccaccagagtgccgccttcagaaaactttatgtaaattgtttttgtataagaataataaagaaatttggggtaagtgttcgtattattaaaagactttaaactcatggaagtagaatcacaatgtgtttgtttgtttgtttgtttgtttgtttgtttgagattaacctgttccccttgcggagttctatctgtttgattcttgtttttatctttacatgtgtgtgtgtgtgtttgcatgtgtgtgtatatgatatatgtatgtatgtatgtatgtattcacatatgtgtgggtgtgagcatgcatgtgttatagctctcaaatggaggcctgaggacagctgcgggtatgagttcttaccttcttccttgtttgaggcagagtcttgtgtggtaagtgtggtaagtgccttgcctactgagccatcttctcagctcctgtttttgagactgtcttactacatggcccaggctggttttgaatttctgatcctcctgccttagcctcctgaatgctgggattgcagctgtgcagtatcatgctgctttccctgtagatattaaacagcttggtacattcaca

SEQ ID NO: 34862 - DNA, 1277 bp, Mus musculus
agaaaaacattgctgataaaattaacctcatagaaagaaaattattttttaccaccgctaatgctcattttaaagttggatgtcctgttttagcccttgaagtactttctaaaattcctaaagtaaccaaaatatcctccttaactgcaaaaaaagatcagcttgactctgtttctggaaggatggagaacgggccatcagaatcaaaaccagtgagcaggagtgatggtggttctggggctgactggtcggctgtgacttcctcccagtttgactggagtcagccaatggttacagttgacgaggagcctcttaggctcgattggggtgacgatcatgacggtgccttagaagaggatgatggcggtggcttagtaatgaaaactacagatgccaagaaggctggccaggagcagagtgcctcagaccctcgtgctttgctgactcctcaggacgaggagtgtgctgacggcgatactgaggtcgatgtgattgctgaacaactcaagttccgagcttgcttgaagatccttatgactgagttaagaactttggctacaggttatgaagtagatggagggaagctgagatttcagctctataactggcttgaaaaggaaattgctgccttgcatgagatatgcaaccatgaatcagttattaaagaatattcgagcaaagcgcattctacagtagagactgagcgtctggatcaggaggaaatggtggacaagccggatatcggttcctatgagcgccaccaaatagaacgacgacggctgcaggctaaaagggagcatgcagaaagacgaaagctgtggttgcagaaaaaccaagatctcctgagagtatttctcagttactgtagccttcatggagcccagggcggtggtctggcttcagtaagaatggaactcaaatttttgctgcaagagtcacagcaggtatggccatcacttgttactttctgctagttcaggaatttcagtagctcttccaggtaagttgcaaacttttttaaacaaacgtaaacattttcagctcctgtagtcctgggaggcagatatttgttcctaagtggctttcttaggtggtggctctagaactagaagttggtcttgtttgttctctgttgctttgataaacactgatcaaaccaacttgggaggaaggtttaaggaatttagttcattgtcaagagaagtcagggcaggaactcaaggcaagaactgatgtagaaacccatggaggagtgctactttctggtttgctcttaa

SEQ ID NO: 34863 - DNA, 1600 bp, Mus musculus
caagaatctttgtgcctcagcccctccgtgctggggttggttgtagcagtgcaccatcatgcctgacttgggagtgtttctcggtacgcacctcatgggatttccccaggcctcgcagggtaggtaggtggtgtgtgatcgaacctctgcctgaaatcagtagactggttagtatcttgctcagttcctatttcactgagtgctttaaatgtccttgttttaatttagtgtggtgatgaatgtttatttttctctttctattctcagagcttaacaaaagatctgggaggcaacgcgaagtgctctgacttcacagaagaaatctgtcgtagagtcaaagacttagattagcactcctgctggtggatttgctgcagtcagtcaatcactccaaaaggataccctgtaatcctccttgagggcgcccaccattggtttgcttgcttcttgacagagtacgttttttgaatctggccttttcttaacaaaacccttgcaatggatgcacatgatggccccaggccttcattcaaagggttttcccaagtgctggttgtatttattgtccgtctggtaaaccttattttgtaaactgtaagtgaactgtatcatttatcattgttaacccattttacacttcaggcaaaatcattttcctcaactgtaaatattctgatacagaattaataagagaagatatttaactttttaacaaaagccctggatttttggtttatgaaaaacaaactgggaataaaacagggttttaacaatcgcacaagataacattattctaatactaatgggtacaaaagaaatttactgggaaagttcacagcaaaaaaatggtatatttcttaaaaatatggaaataaagtatttgtcctatacatgaattactattaataaaaatgtaagctccaagaaatccataatgaatgatgtaattttgttactacatcggtaatccttgtcaaggccccggatgctctctgtgtatttgattcttttgttaccttgagattcactattttgggggaagagctttcagataagggagatcactcctcactagacagatcgtcagcattgcgagctgtcagccatgagagccagccactgcagatcccctcccacgtggccacactccagccagtgctgcaggtgaccctggaaaggcctggctgccccttgactttccctaaagcaaccagtcactgccttctgccccagtagcacccattacagacttaattgccgaggtggagctgactcagcccacgctcatacaaatcaggccaagcgggggcctgtgttaccagctgctgaccatcaggttctgcccctcattcttcccacagcctctgctccacagcatgaacctagcctttggcccacaccaaagccaagctgtcttcccttagcccttgcactagtttgcaaactcgtggctttgcataatgtaccctggtcccaaggggatttcttaacaacagatgtccctgtctgggtcatttttttaaagcttttatttggacttacaatcttctgtgtattttactttaaaactgctgctttccctgtctcactggattgttct

SEQ ID NO: 34864 - DNA, 1146 bp, Mus musculus
aggggctgaagaagtctacaatttgcagatgtttagcaaaacaatggccagattgtatgagtccttctccaaaacgctcctgctttataattagctaattaggacatggtatgttttcatctcctggccctggctaagcttgacaagtttttccacatgagtgtgcatcatgtaagagttgtgaggctgtctgggaaggcagcctgttctatagcggaaggtgttactctccttagagctgaacctttcttttgtcttccattgtctgcttggttttgtagcataatgggaaatgtattgtctagtttcttattactaagtaatttatttttaaaattacctatcttatctctcaccctctcctctaccattatatcctagtaaaattaaagtatctgtcttaccttcatatgctcctccaccttcatatcccagtaaaaccaaatatctgtagatccatctctaattggcttttttttacattgacagcaacctggaatttttaaaccatgaagctgggtattatgatcccagtacttgggaggcagagccaggtggatctctatgagttcaaggccagcctggtctacatagagttttacgacaactagggctacctagtgagaccctgtctcaagaaaagggaaacttcctctgatttctccatagtttgcctaccacaaagctcaggtgaatctgtcctttgtaagtcaagagattgtgtgaatcatacctcaaggactagactttggctgcttcttcgtaaaactgtagataagtatacttagagtttatagccctactgctggctggtactatgataccattctgctaaagattacaagacttggccaagatccctgaaaatgtattaagtcaaatctggttctcagcttataaaaagtgacaatttttcctaaaaaagaaaggagtttgaggccgggcagtggtggtgcacacctttaatcccagcacttgggaggcagaggcaggcggatttctgagttcgaggacagcctggtctacagagtgagttccaggacagccagggctacacagaaaaaccctgtctcgaaaaacaaaaaacaaacaaacaaacaaaaaaaaaacaaaacaaaacaaaaagaaagaagtttgagagtctga

SEQ ID NO: 34865 - DNA, 1176 bp, Mus musculus
gaaagatgtttggaatggaagtgaagccctcatatggcctaaaccaaggttagcctccaatctcaaggcaagggcacggcctgacagtgataattcctagtaattacacagttaactcagccacgttcattgtgagagagaaaattggctgtatccagttcagtgcacagccaaggaaatgagtggtgctcaggagctcttggctctttgggaaagggtaaatattgaccttgttgggggtaggcatgagtggtttgtattgcagttttccctacaggctcctcctggaagcatagtgctggcccaggcaggaatacacttcatggcaggaccctggatctgaatctttgaaagggtagttgattgtcgttatcttagagagaagtactattccatagccagaggaagtggtccacttagagattaggctccatccttgtggaccttgggctagtctagattcagaaggaagagtactcactccttaagcattccttaccaaaaaaatacaggaattagaaggctttatggctttatttctttaatttgcaggtttggggagtaaaatataatggaaatggatcaaaaattgtatctgttggagatgaccaggaaattcatgtctatgactgcccaatttaaacaccagcatcctcggggctagggcctcagactacacagggttgatcatgacattcctcagattttttggcatacttaaagtacagcatatattgtagaacttttgtagatacaatataaatttttcctgttttattggaaatgttcttcatattttaatgtaaataaagcattcttaatgcaaccacctgcatttgtgaacgtgctgttcttttcctaggagagcaattgacggttagtgaaggagagtgcctgcctgagagcggagatccaggtgctcactgggtagaaaggcagctctctgttcccaggtgataccagcctatttcagaatggagttctgaaggaaacaggctgagtgcactggaacttggtgtcatcctacctgcctgagcatccctccatgtgtctatttacaatgccccctttaccacaccctctctccctgttctttttagagaggtctgacctactggcagcctgccttagcccttgtgggctcaagactagtggacagggctaaacactgctgtg

SEQ ID NO: 34866 - DNA, 1168 bp, Mus musculus
gggttgacatactttagttaaaaagaacagtttgccacaagtagaactactgaagctgaaaaacaaattctgttcatttagagtctttccagaactatgtgcttgatggattaggtttttgttttagttttggcaggtggtgctgtgtacacgctgagttttatggcctgaattgtacttccatcatggggtcagttgtgctaaggtctgggggcctgttaaaacagacacatctgggacatatcaggattaatctttcgggcctgatctaggactcaaacccctttcttttgaccaggaatcacaggcttgacttttaattcctaattatgaaggaagagtctgttagttccactgggcaagaataagaccactaccacagtttttgaagcaagctttattaaatactgtctaggacgacggatactggccacgtctgtgccggggaatcccagaacatggcaccgaattacattagccaggggcttataaaggcaaaccccacaagacaagtacttcccgccttcatgcatgcaatcaggagcaagcatacattctgacgtacttcctgccttgggtgaccaagcacagactgtgaagctggggcaaccaagcttgttgacaagtgagaacacgtgcatgaaccacagctgccagagttccaggaagtcatctgcccttgggcaagtggccttacaggttaaaagtattttttttttgtttttgttttatagatatctcatgtacagtgattttaacttaaaacataacttcagccctcacagggtccctttgcagtgccctccaggcctgttaatatctaactagatactgaacaactgggctcttaatctgttcccagggtggccaaattgaatcttttgtaaacatgtcagtaagaatgaagatattctaaagagacacttatgtcactccctttggctaacaggctattgcaccatgggccccagcaaattaaaataatttcttcagaaatatcaagctgagaggtaaggaaaaaaaaaaggctaaagcctcctgtcagccagaagagagccaatctcctgaaaagacattccaaacagttctgactttccatatagttctgacaacttgtaggagagactgtagcctagacagtaataaagggcaagaccacattcaacag

SEQ ID NO: 34867 - DNA, 1204 bp, Mus musculus
cactctgagtggtgcctgcattttaaggtgtaacaggtgttctaatcttattctgttgctttgacaactgccatgcctgaaagtaactaagggaaggaaagggtttatttcatcttacaattccaggtcacagcccatattttaggatgggaactcaagcaggagcttgaagaaaagctgtctagtatacactctggcttactttcttgtccaacccaagactgactgtccacagtgggctaaatcttcctataccagttgataatcagacaatccccaatatgggctactctgatctaggcaataactcagctgatgaccccaggctgtgtcaaattcacaattgagactaactgggacaatagggttgtcttcattattgtatttaatttctactccatgcttttcaatatgtatttttactgttgtactttttacagtgtgtagacatgacttcttgtttacggtaatattttatcttgaatcagatattctgccttactcaatacgggtcctattggaagctgctgtacgaaattgtgatggctttttaatgaaaaaggaagatgttatgaacattttggactggaaaaccaaacagagcaatgttgaagtgccctttttccctgcccgtgttgttcttcaagatttcacgtgagtgacagcattgtattgacagtctctaatgtgatggccttgttcccacgtgtgaaaccccagtatggaatgatgtggttaaaaatctaaagttattattaattcctccacatatatcgccttctatcacagaataaaatccaaattctttacagtatcctgaaagactgacccttcttgttctgcctgtttatgggatatttattcgaagtgtgaattttacaataaatgttggaagagagtaccctgttatcactcagagttatacaagtctagcttctgtgccactgatcactaatatgtggtaactcccatatgttgctgcttaatacatacattactgttctgtaatcagtaacgtgtcctgtttgccttgtatccgtggtatgaagactattgaagccatttggtacatgtttgtttacacacacacacacacacacacacacacacacacacacacacacggatggatgaatgtaaaatggtaaaggctattttgaatagccttttgagatactgcaaggactgtaggggacgaggaagg

SEQ ID NO: 34868 - DNA, 1197 bp, Mus musculus
ttattgcatgggagatttaggattatgttttaaccctcctgaataaaaactactttaatttgggatggctgagagagttgagacagtatctcactgtgtggccaaggttagccttgttcctgtcagtcctcgtgcctttcaagcactgggattacaggcggctgccactttatgtgatttgaacatctttcacttccagatctatttaatcttttttttttgtttgtttgtttgtttgtttgtttgggggggggttgtttttttttttttttgagtcagggtttctctgtacagtcctggctgtcctggaactcactctgaagaccagtctggccttgaactcagaaatccgcctgcctctgcctcccaagtgctgggattaaaggccaccaccgcccgccccagatagtcttggtgatgtgaatttttttaagttaaagttcttgttacttgtaaattattactttgtttcctttttgaaataatagtgcaatacagaatgcaccaaatcctggaggtggtgacctacagaaagcaggaaagctctctccacttaaagtgcagtctaagaagcttccatgtcgaggccagactacctgccggggatcgtgtgattctggagagctaagccggaactcaggaacattttcttcacagattgagaatacacctgtcttgtgtccttttcatttgcaaccagtgcctgagtatgacattgtttctgttaatagttttagtgccaggttatttttcagttaagaaaatcacatttctcctgattactgttgtattgctttcacaactacatttctaataatgctttctataatgctagatataatcttcctgcctcagccttccaggtattatcacaaaaaatgtgtaccaccattcttgcattctataaagttgctaagttgtgctctcttactcagttattagcttttaaaaaaattttagtaaacagagctggagagatggtttaatagtttttttttgtttgtttcttttttaagatttatttattatatgtaagtacactgtagctgtcttcagacactccagaagagggagtcagatctcgttacggatggttgtgagtcaccatgtggttgctgggatttgaactcaggacctttgaagaatagtcatgtgcatctcaccagccccccgggttaatcgttaagagaacttctt

SEQ ID NO: 34869 - DNA, 2990 bp, Mus musculus
gtgtgttgtggaagagacctgtaagtatgaggggtatattttatgagaacattttgtaaataaagacagaatttgaacttgtgttgaagattcatatgaatagccgttctaaagctgtttgttttgttttgcacctttaaaactggactactgtttgttggtttaagaatagcaagttgaaatagaagaatccagactagaccctaagattgtgggaatgggtacctgatttataaatgaatttttttaaaagtgtttttctttccagaattgaattggacacagttggcattcccagtttgtaaagtaagtcaggtttagccttagtctcagtatgtctgcaaggcatagaacctgccccagatcacagtctctgaccagtccagccagaatgcactccatgtctgaagataaacgactgcaaaatatagctgatcatgtggtatcatgtattagtaaaatatatttcctatggtacagccctgtaatttttttagtaatttgccactcactatgaccttctggcaagcccaaatactggtgtattaattgaactagattttgctcattttacgtgatactgtaactcctgtaacctcaattaggtgtcaccaagctgacattccacactccttttatgaatgctggaacaatttgaatcaaactctagctttcctttagatttataaattatccatccaaagttatagatatgcacccttaagggttttttgggttttagttttacagtcctttaagttgatttcttgctatttgggtctttattttatctgggctacatcactgttaatttcattataatttgtttttttaatcaaaattgaccataaagaaaagatacttggtggtcacggctgtttgcatgtctgtcatgtgtttgcagttgcatctgtatctgttacaccacatcacatgcttagtccatgtttaacatcaatttaaaaggttggaaaagaattttagaaagccctatatctctttttttaaattaagttaaacttagcagcaaaaagttaagtgtagtggtttttaaaaaaattttttttttaaatctgatctgttcttatgcactgcacaaaatgaaaagtacttcttttatgctaaacttaaggactaccaaaccagtgagtgaagaacacttgagaacttcacacatgatcagtcgtacagtcttttgagaatatttttcaaatatgtacttagttggattagagtttgacaaaactagtctctttagttaatgttttctttgctactttgaaaccatactgtgttctggtagataccatgtgtctgtctgtgtaggtgtgttaatctgtggaagcctgaatcaggaatggagaattcacaagttgagtattaaaatactggtacatgctttgaaaaaaatgctaattccagatgtatatatggaaaataatctgtcatattttgaaggcatactccgtctatagtgtgagctacaagtctggacataaatgtctgaaaaatggtaaactcgctatgaatcaaatattattaatcaaacatttccagtacagtaatggtatagaaagtgcattccaggaacaaagtgaaggttctcttaatctctcacccagaaacagtgaactaaactcttgatcagcatggttttaaatgtgggaaggaaattaaacacatgtcccaatgtgtgtatcttgtgattctgcctccagccaaataatgcaaaaatgtggcacctgtttttattgtgttactttctttgttgacagtttttattttctaaaaattaccaatatttggagaaagaaagtgaacacaaaaaaagcaaatcagtattctgaatgtagcacagttaccaacagcagcattttaatctctgaagaacgttgtgctccatgctgttgtgtgccttagttgtgctgctcatacaaatgaaggaaaggaaaggcctccggccactgaactgccattgttagttattcctttaaggttcccaagatggcaggtacctctgttaatacttggatgagaggcacagcatcttttcaccacactgcttggattttcacagggattgtactaaaagctgtaactcagccagaagcagttatttgcttatctggtaacaatgtagtgttccttcctcttctccatggtaagtgacatgatgagaaaaactgacatttttcagagcctttttacctttgagtctagagagaagatgctaaggtactggacaatgatactgtatttgatttggggagtaaaaaacggggaaggaaatgaactttggcttttttccagtgggttattttccctttcaaggtgactgtgctgatttgtttgttttatcaattttatgcataatatgtgactgtaaaaccttatatatctcttaagtaactacaaatcattgttatttaaagccaacaaaatagcataacagttttaagttcaataatgttaagtattgtatagaaatatattggaggtaaagttcagttatgaaattgtgtatatgttattgatgctgtaaattatttttaataaagaaaattgtattatcacatttgactcgttgtgttttatagtcactcagaataaagcataacttaaatgggatccagaaatctctcatcaaatatattctataatgttcagattttgttcattcccaatataacagccaggatggttaatctcaccactatatctctaagttcctttctatgctaagattaatgagaataaaagtctgaaatatggttagtgtccacttaaacagtaaatgaatttaattctgggagtatcacaatggataatcaagttatagagtcagtttagtaggaaagagtaatctgacctaaaccaggatcttctgtacaaacacaagtcaggcaagttaacattaaagtgacagagtatcctacccagtgatccgttctgatgccgaagcttgaatgtttaaacctggatttcaccag

SEQ ID NO: 34870 - DNA, 1210 bp, Mus musculus
tagcgccggcgccaggcgtggaggtagctgtgttcacagtcgaatccgaaacccgccgtggcctcctggctgctgtgctcagggccacctttctgtttctcctacatgttggaaccgactcctggcaggttaactctccttaggcctgacgactcttctaaaatgtcacttcccgtggtccttgaatccagcccgtcggtgaagcggtcttaagtaagataaaggtgttttctaacatctgggcgcgcagacccttcaaatgtctgcttagctttccagccacgatgccttccttatatcccatttggcaacataggaattgaactgccatttttctactaaggcagagtttccattgctgtctttcgaagaaacggaaataaggaccaggtttaccacctaacccctacacccccaaatttaggaccatgtgaattatccactttgttaacctttctcagcctgctctacttggaatgcccttccttcaccccttcacaattctttttctttgacttgaggcttttcaacttacctttgcctctcccacctctaatttactctcattatctgtattggtttcctaaaatcttacttgctgtcgattctgctttccctccccaccctgaatgtctcttccatgttgctttataatctttgtctgtcatacctggctgctagattctgagcttttcaggacaccatggtttacctttattgtggtggcccagcatctgtataggtcccagtggtggtgcagttcatgttagctgagtgatggtgtggatcaagtggtattaacagtggaagacacttcttaaaattgtgggggttttgttattaatgatcctgttttcttttcacaggaatcaacataaagttcagaaaccatggtgagttcatgacacgtttcctttaacttttgcctgggaacattatggcttgtttgaagctcacagcctgacatggaagaaaatgaaaccaaaggggtagagggagttgaatggggtcttccgtcttctttccactgaactcagcaccagggtgtcattgtatccaatgcatggacatccggaagttggcgtatgtcagtgaacaggcatcatctctgtttttcctttgcagtctcgaagatatgactccaggaccacaatattttctccagaaggtaaattagaagatttaacctgctccaaagaaggttggggca

SEQ ID NO: 34871 - DNA, 1137 bp, Mus musculus
ctttgctgtatattggctgggataagcactatggctttcagctctatcagagtgacccaagtggaaactatgggggatggaaagccacatgcattgggaacaacagtgctgtgagtattttcgtgccactgtaaaatgtagtgaaaggctaagaggacagtaatgttaaatagtgatgtgtgtgtgtgtgtgttagagtatctaccataggatttaacagcttcataacttcttcagtgtgaagggaatgcctgtttgtagtgctacatcttgatagtttgttgaagctatctgtagctaagggctagttttcccttataagtagtagaactcttaaagacaagtctcttgaggccagggcctcatttaaaggtcctgtccctgccctgttcatgccgccttcccctgctgtcagcagtgggctatacttcttcagtgtcagcatgaattcaggccttagttcttctaaccatcctgtgccctccccaccatgcgcagattggaaggaaactctgttgatgttttgttttcaggcggctgtgtcaatgttgaaacaagactacaaagaaggcgaaatgactctgaagtcagcgcttgctctggctgttaaggtgctaaataagacaatggatgttagtaaactgtcagctgaaaaaggtaatcctgtgtcctcctgctttgtctaaactgaggattttattgaatagccacagccttaggtttttaatgtgttttagttcattgaagctgccacttaggggacactaaggaccccatgtcttgagtaagatgagtcttgatgaactgaaaagccacagttctgcaatatagggcaggcttaaggacttgagcctgactgtaactcctggtttggagatcctgtgtccgcagctggccttgaactcagtgttagaccaaagctggcctcaaactagcattgcccttcccctgcttgttcctcccagatactgggatcccgggtgtgtaccaccatgcctgatggaagctgctttttaggtcatttttttttaaaaaaagaaatgagaaaagtccataaagaagtgttgctttgtttaggattctgtcttgttcttctggttaacttgtgtgggtaacaactgccagccagatatcaga

SEQ ID NO: 34872 - DNA, 1167 bp, Mus musculus
gatttttacagtaacctttctatattgagcctatggggtatgaagatttgcaaaatcttgtttgtttagagccaataaaagtttaactgatggtcaatactggtttagaaattttaggtcttctaaaccatagctttttcaggtctgaaataattttattgccaaaattatgacaggaagcctcctcattaaattgttacactttttcacggttgtgtgaaagtttgaactaatctaaaagtatgatcgtaattgtaccatattagcgtacagcaaaacgaggcagccacttgtgagcagtaatttccactggagcagcagggtcctagtggaccaaacctgcttcctgttggttcagcatttcttgtgaggaagagccacagtgcagagcctgaagttctaaagtatgaggtcattttacctttccatttattagcggggtgttgcaattgacgataaactaataaacttatggaatggttggcacaaagacagactctttgagcaaaattatgaaagatacctaaattggagatccttaaatttttgctgtagtcatgcagtggcttttacatcagaagaccagtaggagttcagcctgtgttaattcttttttaaaatgtgacacagatcaatgtactttgcatttttattacctttcctgaatcaatcctctttggttggtaatagacttttttggatccatgtttgatttgaatctagctacttaagcacttttaaaagaaacctcgaagcacactcctgcacgacccagtacagagttaaacggcttttcttatatatttgatttgagattttttttttaaactttgcaaaccacatctaggagatgtggcacttgtgcattttatgtgtggtgttagtttctcttgattctgttggttaagagggcagaaaagatatctggtattcttggtcacttggttaccctaaatatatgattgccagtggctcagatgacaagtgacaagacagaattcttcaacacattattaagttccttatgcctaaggcaaaatcttgaatacattattgaattctaatttcctaatggctagcagattgacagctgcacatttggcatgctttggggttgggtttttttttttttttgattttatttttcattgcagatttatttggcaa

SEQ ID NO: 34873 - DNA, 1230 bp, Mus musculus
tgtttgcagccggcttaaacgccaggctgcctccggtcccttccgggcggaactgtgcaggccggtgcaccgccgcagcggcgtgtccagtaccggaagcggcccaccggaagtggcgcgcgcctgctcagggagctcgggttgtaggtggtgcgccggccgctccggtacccctgagactctgtagggccttcgggccggtaggcgaggaatggagccggcaggcggcggtggcggcgtctcctcctccacagatccgcgaagcacctacgtgctgagtaaccttgcggaggtggtggagcgtgtgtttaccttcctgccggccaaagcgctgcttcgggtagccgggtgagggcgaatggggcgggaggagaccttcgtcccggagggtggcggggtcgcctctgccgggacctctgcccgggtttcctagtgcttagctggcgctgcgaggctgctgacggtgggaaccggccgcccggcggcaaccctttgtgcttttgcatccccagagtatgccgcctgtggagggagtgtgtacgcagagtgctgcggacccatcgcagcgtgacctggatctccgcgggtgtggctgaagcgggccacctggagggacattgcttggtgcgcgtggtagctgaggcgcttgaggcaagtatggagttatgcgttggacagtcacttgcaggactggtgggccatcttggagaactttttaaaaaatcaagattgtgatacatatccttgctttcgttaactcggagaacctatgctcgtattctggcttttgtagtaaacgtcaggttttgtaggggcgtactgcggtttagtcattattagatgttgggcaattgaagtatccaggtgtccactattacaaggccgtacagagccttccttaacttgcctcaattttgcaatgaaggtgttgggtatcgcttgcccagggtctcacactagaaccggaagaactaaaacttctacctaaatacgtaaaccacattccttttctcatttttgtccctggatccaggagagtcagtgttcagggaggtgaagacagattatagagctgatagatagtgaatctccagtatctcactgagtggcaggggccctcgtgaggaaattgccaatttgatgccctattatcgcttagtatgtataataggcaaataggaatgttctacttaaccacaatatagtctccacattgggaagttatcattg

SEQ ID NO: 34874 - DNA, 1149 bp, Mus musculus
gttacttatggtataaggctatatattttcaatggatattaaggactcttgtaatatcactatgaaagttcaaatagcttttaaaaaattaaactcatggtgagacagaaacatggcgactaagtcatctatgctgttttctctgtgttttccagaccaattgtggactgagtattttaatagatacaaggaaagttgcttaacttcctattagaaatattttgaactttttaaagacagcttgtcatttgtaactttgaatagtattgtcctagctgccttatgctacagtgaatgtctcattttgaggcttttcgtagtcagttcccagtgagaattagagatgaagcttgtgtttgtttaaatgtaggaagctcaagaaactaaatacctgctttgtgaaagttaccttctgttgatggcagaggcaggaccaggccctgactccttggatcagcaggcattacagacagaaataactcagtgtcagaaagaagcccaagaaggtctagtggctgtaggtattggcaggtctgcatagctgtagctgaaaggcaagcagtctgagtgttgctgttattttatcaaaaggattggaaaagtcctgtggaattttaaattgtggcaactagttagattttctagaaatgacaggtgaaatcaaggtcttaccaccccaccctgcagggtgtactgttcagtgcgtttcatgagtttatcatgaccctctctgaaactgtctgcatctcccctggttaccaggcagtgatgttgtgctgctcttcactccattcctggaggaaacactttcatttagttcagcctttgagacctgtctgccatgtgaggcttaggaaagccagcagtctgaggaggctctgctcagagttgagactacacaagcaggcagggctgtaaaggatgccgcatggaggtacagatacacaaggtgagaggtttgctctgcagtgcctagcagcaagggaacttgtttgtaccagtgtgagcaggtctgaaatactgaactgaggggctggcatggaaggccccatgaggggtgcagccccctctgacaagaatcttcttactgtgacctctgctctaaaagatcagtgagctttgtgaaaatgaactcaagctgataagagt

SEQ ID NO: 34875 - DNA, 1100 bp, Mus musculus
gagttaagtgggattatcctgttcaacactgactggtctcaatgaatgaaaagaaagtaccagaggttcagtggaagctctggggagagatggccactggctctcggagctctgctgcctgccagtgatgcaagctgctttaagaccacatctgagaagataagctcgaggtcactggtgtgcgaggaatgaagatgtggagctggcactgcagttattcacttcaacatgtctgtgtatagcactctgcaaaatgcccttgcttatgtgaggcatattacattcaaatagccataggttttattaatggaaaaatcataactaaggcttgagtgagtaatctcaggctctaagaatcggagaactgagcacttcagcactgcagaacacactgggagtgccagtcaacaggagcaacagttcatgctgtttaaggctgtctctgtccctcacttctctgcaggtcttctggacaaccctgaacttcgtgtggtccttgtctttggctataactgctgtaaggtgggagccagtaattacctgcatcgggtagtcagcactttcagcgatatgaatatcatcttggctggaggccaggtggacaatttgtcttcacttacttgtgagaagtaagcctgagtactttgctcttcccccgtgggtaaatagaaatatttgatttcaggtcctcaatacttttaggtttttaaaaaagaaattagaggaatcaagcagagtatagtgttgttatgcctttaattccagtaactctgagtaggcaaaaacaggtgagtctcttgaattcagggccagccttatctatactgctgacttccaggccagtgatgacctgtctcaaaaaaaatacaaaagaaaaggaattgataatataccaattcattccattttactgttgccaagatgctcactaaacataattctgctggcaggcaaagaactaaacttggatttgttgttttttaagaatgtcagaatcaggctcttttagcattacccgttgatatattttagagctctggtccttgtgttgctcctgcaaatgaagaaatcatttgagtaaggctaaaataaattaatac

SEQ ID NO: 34876 - DNA, 1196 bp, Mus musculus
agaggtggctcagggaaagagcagctcctgcccttacagaagctcccatcttggttctgagcacctacatcaggcgattcctaaccacctgtgactccagctccagagactagtaacctctctggtctctgcgggcacctgcactcatgtgctcagtctacacagacagcatttggatggagcgctcaggagtcctttctcttgtcacctgtgtggccaaggattgaactgaggttgtcagttcttgtgacaagtgctgcatcagccctgttaagacttttttttaatgaatgggacttttatccttacaaaagaaaatgcattaagttataaaacttatactgactactcactgggaagaaacatacaccttaagtccctatgacatttatcaacaactgactctatagaatgggcaaagttctctggggtaacaagaaacaaagctatcaagcatcactggggcatatacatacacgcaaaataaaatctggtatacatttcccaaaaacgaagaccaaggaatactagtaatatacccataagctgctgctctctgggggaaaaaggttagagatgccacagagagatcctgcctccaatgcaagtggttagagcctgacaagtttttccatgaagacctggcccatgtaacaactttatagtctaaccaggataatttgtgaaccacagagatgtctttaagaggctgaagtttgctttagacataagaactcaatcttcaagtaattgcttagaaagatgagcttgcagggtccaactgtgggacttctgctcatttgctgcccacctccttgcaatcgtccctcctgtgtgtactcagcatatgcagagatctcagcaccaggctagtctcagctcatttaagatgacttccacacaagggccatggaacactgtttacaacaaggtgcctcaacctcaccttagaattcccctttcccttaaaaactcagtcttccttatttgtttctatgaaacctctactgcccagttacactcaattctactgaagtaaaagccatgtgtattaatttattttagccttactcaaatgatttcttcatttgcaggagcaacacaaggaccagagctctaaaatatatcaacgggtaatgctaaaagagcctgattctgacattcttaaaaaacaacaaatccaagtttagttcttt

SEQ ID NO: 34877 - DNA, 1189 bp, Mus musculus
gtgttgatggttttctgtttctatttccaggaaccctctggatattgatgccacaggtgtggttggactgtcatttagtgggcaccgaatccagagtgccacagttctcctcactgaggatgtaaatgatgccaagaccgtcgaggctgctatgcagcgcctcaaagcagccaacatccctgaacagaacaccattggcttcatgtttgcatgcgttggccgaggctttcagtactacagagccaaggggaatgttgaagctgatgcatttagaaagttctttcccagtgtccccttatttggcttctttggaaatggggagattggctgcgaccggatagtcactgggaactttatactgaggagatgtaatgaggtaaaggaagaggacctgttccatagctacacaaccatcatggctctcgttcacctgggaacctctaaatgagccgcctcgctgagagcacctttcacaccatgtaactttgggggtttctcttttttaggaaaatggaaactcgggatccaaatattttaagcaaaactagctatgtgtgttttgtagctttgggtgacgctctgaggtcactttgggatgatttttttaatacatagatgaaggacagcattaacattgtaagcacacaagtcaagaagtgaggctgtggttaggcgcaagcaaagctgccggggctgaactgccccagattctgtagccactgcataagcgccctgcgaggttgagggccaccaggaaggtggaggtttaaatagtgcttgatgaacttttagcagaatcatgacttaagaaaggagaaaattgccaggcgtggtgatgcgcacctttaatcccagcactcgggaggcagaggcaggcagatttctgagttggaggccagcctggtctatagagtgagttccaggacagccagggctacagagaaaccctgtctcgaaacccccacacaccccccctaaaaaaaagaagaaaggagaattaaagaactggtttgagaagttttgcagaagctgtaacaaatattactgactttttacttttctgatgaacagtctgttttgttactgtataaagtcgttctttttgtgagttagctttttcctcttcatagtaaagagactgcaagggaacagcctttatcacacagttctgaaaatcatcaccatattt

SEQ ID NO: 34878 - DNA, 1191 bp, Mus musculus
aacatataactgctatgtgcctgtatcagccagaccatgtgtgtgtgtttctgagattcaatttatgtgtgacacaggctgctgtgcttgatctgtttatacaacatgaacttgacaaaggttgcaccatgtattgaaattttttcttttatattttctagtaaatatatatagtaaaagcttttccagtgttttactcttctagttttttctctttctcttgtttaaattcagggatccataactgtcacatattgtacttgatatttattagggcagtagatctcataatttatcaaattgaatcagcttcttattactataaatcttctataactcctaatatacagaaatggtaggtactaaatttcaaagactatctcaaaagctagatatcccttatcccgagatacatgtgaagtgtaaaatgtttgaattaaaatttatgcagaagctaacccccttttaaaggggtttagaagataccgctgttgatcattatatcagtcaacttgcgtttgtgtaactcactgctttttttttttttttttaagaaccttctgcccagagtagctgccaaacttaatgttgctccagtttctgacatcattgagatcaagtcacctgacacatttgtgagaactatctatgcaggtaagttctaaggaagataatcaacatgttaatttttacagtatacataaatcttagaaataggattaggaaacaaacctacgattaaatggaccatcttaaaggtttctgaaaaatgctttaattgagaatagctactgtccaatttattatgtgcacagtgcttttatactgccttacagtttatggagtgagatctttccctccagtggctaataaaaattaagtttgccatccaatatatatgtattttaaatgtttaattgtgatgtaattatatcactcctccctccaacctttcctgtcatttccttttctgtcagttgatggcccatttttctttattactgttacatacacatatgcataactgtataaatacaactactctgtttagtttgcttgtgtgtatatgatttcagagctggctagttctgtttggatagccagttgtattggataaccaattaaagggctcatgcctgagagagactagttctctctcagcagtcattgctgtcctgtgcttctttgtct

SEQ ID NO: 34879 - DNA, 1265 bp, Mus musculus
atgcatgtgtaatcgttttaaaacgtggaatttactgagctcctggtatacctatgtggttttggcaaatcacactaacctgagcattttccttacaaagactgattctggacactttatggtttattttcttttaaaggctcttcatctgattgatgagatggatttgaatagtgacaaaaagctctctgaagaagagattctggaaaaccaagacttgttccttaccagcgaagccacggattatggccgacagctccatgacgactacttctatcatgacgagctttaacccccgagtgcgccccagcaggatgcggccttctgtagtttgctaccagcttgacttttatgatgagatatagatgttgtcctttacactcttaagtcttaccacttcagatgatctaaatgtagattataacttttggccttttcaaagaaaacaaaacaagaacttgtcatttatttcaagacatattgaaggagtaaactattaatgttgtgccatatgaccacacagtctttcctaagtactccatctatgtagtgctgtgttgtggaatgttgagctctgttgccatacttgaagacatggaggatttagacatgtctaaacaatagtatttaagtagcacgtgatgaagctgtcagttttcgttcttgtactagtagacttacttttgaaactgacaaaggacagtgtttagatttagtgttttatcttaaagcctttaaaggaaccttcacaaggacttaaacctcacatagatgttgagaagttctacttaattttaaaatggtttctaaaaagggttttgtcgtatgaaatagaactttatatttttgcatatgtatagatagtaattatatttaatgtataactatagcattatggtgtgtggaaattgacattgtccagaactcttcacttttgattgattaaaaataaactgtcctatctttttatatgtttgggtttttgttttttttgttttatttttccagataaatcttaaattcagcatgggttttgttatattaaacattattcattcctttattagatagtgaatgttctcaagattgttaattattcttggtacatagtcttatttacctttttttaaaaaaattaaaagaattatgttataattgaacgtgcacctgagacattttcaattgcttttatgctgagtgtgattttgcactttggtgctaacataatgtttttgttttgtttgagatgctaggaatcatccccg

SEQ ID NO: 34880 - DNA, 1154 bp, Mus musculus
cttatcagaactactatgacagggaggtgaccccactgattggcagccctagcgtccagccctcctgtggtgtgataaagaggtgagcacccgatgaactgcatatgatcaggacacagccgcggggtcagcctgacttccacatctcatggctgaacagctcctgtgggtctggtaccctgttcagaagctggccatcccattgagatagtccaggatcaaactaccgtcagagcgccccgggtccaagagcatccaagtactaattactcacactccagttattcaccaacggctatgcggagagtcccgggcaagtgcccactctggcttccttgtctgtctggccctactgagaggcagggtagtgtcttaactgagaggtagcacgggtgacttccaggtggcttatgaatggcccaaagcccagacatttggattcaccaggcttttagagggccatctccctggcctggctgtagtcaggtgccaaggccctagttctgtgtcctgtgggtgacctggcctagtcattgcgcagccaaggaaaagacgacttgcttggcccacactggctgggcctggcaagatatgtgggagctgaactttaaaggtagcttcctcctccccacagagcctggggctggggatctggtggggatggggccctgctggctgcaggtgcggagatgaccaggagagtgaccatgggaggagaggatgctgagaacgaagggactatcaggaatggctgtggggaggcctgctgccatggaggcctgtggtggtagcaggttggcagaggtcctgaagcgctgagaattcccaattatcccctttgcttccagtgaggtaaggcaaggcctacccctcttctctcctccctaccaccaggttctctgggctgctacatggaagtcccaagaccacaccttctgctcctgctggtaaataagggggaagggctaatgggagaggggacatgtctcccaccagtggggatgagaggactcctgtatagcattgatggaacactaatgtcccagagggaaaaggtattctgtccaagagtgtggatggtgtaggattaagccccaccccagcagtctcagattcgggcctcatcctgctctcagcttccacagagactctga

SEQ ID NO: 34881 - DNA, 1608 bp, Mus musculus
ggtttggggagtgctactgcacactgttagtggggattctccgtaagcacgcctgccttgcctcgcgcctgcctcacctcgcgcctgcctcgcctcacacccgcttcagagttcctgggtataaagcaggagctacttctggtaaatagtatgtgttcataagaagcttcctttttcattgttactgcgttttgataatttgaggttattaaagcttgaactaatgtcattgccaagaaagaaatacacacttgccaggggccgtcagccttgattcacactgttttcttcctgcagctgctgggcatgctgtgcgcatgcatcgtgttgtgcagacggagtagagatcctgcctatgagctcctcatcactggcggaacctacgcgtagcggacagcacgtgcctgagctaatttgtagtatccttgttctgattcagaaggtgaattgagcaggcctgcagcagttggctcctgagttcatctagtcaaagcacacgtacactggtgttgactagcaggttggcatttcatgtacccaccttcctacctgcccctctggctttcttacccttgttctagatgattctccatgcccttaatttcagaaccatttacaagttctgtaatgtggtagagctataggagggtgtggcctgcttctgtcacctctgaggagtaatggactgtgttgtggtatcactgggcccttttcgtcttcataacgagaactcttggccaaaggtttgagggtaaagagggaggacgccagctgtctggtgccgcacaccagtgtccttttaaagaatatatactgtagtacaataatatagcaattgtacaaaatggctaacatagattttagaatcaaacagtatgtgtctttgttcatcttcaaaatcagagactgatctttgaaattagtggtttttaatcaaagctggctttataggaagactataatgtatgcactactgttttaaagcagttggtgtgagtgtgtgcgtttctctgtgtgattgaacccattcatcataagtcttacactcgttagagataatgtacccatggagactagcaaaatagtatgtagatgtgatctcaattgtaaatagaaaaatttaattcaataaactctgtatcagccctaccatgtacattttaattatttggggatatttcagttccacagcagcagtatacagcaggataatgtttcaaatgctgctgttgactgcagttctcatgatttgcatgggcttctattatatgctgccagattctaaaggctgtggtattctgcaaaccacaggtgctttctggagtatttagaacatctgcagagtacaaaggcctaggggatagacagtgatggcgctgtccttgacctaaggactctgaactcctaacacaagagacgcatacaagagcaggaatttttattagtgcagtagtggtagtgtaaaagaacagggcccaaaggagacacccagagagatcagggacgtggcattgcgtagaaggtttagtgacatcacttatgagctcctggaggaaatgcccaagcatagaagctagaaggctctgcaggggtcttgggggatggtat

SEQ ID NO: 34882 - DNA, 1203 bp, Mus musculus
tctctgtatgcaagtatctgagcacagagctggggcctcatgctaacgaaaccaaaagtgataaagaatgtgtgtaggccccctggagaaggaaggggcctggagctgcaataatgctttctgcacccgtgactcccaagtgtccaaagagtttttaataatgaatcaggaatgttctagctttactgacttaagagtgatgggagttaataacctcctgggttgaagacaagttcagctgctagaatgtgtgtataatatgagcaaagctctgggatagagcccagcacatcacctcagctgaggtggttggcagtgcccactgcaattctactcttgaaagtagaggcaggaagaacagaaatccaaggctggctaggatacacaagacacagtctcagaaaaaaaaatgctaacctgagcaagagtaggaacttcggggttgggactcaaaccagtgtttcacctgctcttacagggggcagctggcatcctctgctacgtgggagcctatgtcttcatcacctatgacgactatgaccacttcttcgaggatgtgtacacgctcttccctgccgtggtgatcatagctgtaggagccttgcttttcatcattggcctgatcggctgctgtgctacaatccgggagagccgctgtggacttgccacggtaagttaacactcactctccaatgtcagactatggagggctgtttatctggacctctatcttgaatggagagcaagttctgtagatgtagatgtcttggctcttctaactataccagagtattaacacatgccttaaacctctagaggttgccccatagttttttatgaagggaatatttagaactttttaaaaattttacttaatttctgatgtttatttacagtttgtcttcatcctgctcttggttttcgtcacagaagtggttgttgtggttttgggatacgtgtacagagcaaaggtatgttgtccactgcgcctcacccagagccttgaaagctggcttaagctttgcaggtagagcaggttcacttgatcaaagtcagcattgccattgtcttactgctgctctaatatacctacgattaactggcaatgacttatacaacttttctcaattagctggggacagatttttctttttcctgtagacatttgatagatgcatgtgggacattgcccagtgcgtagat

SEQ ID NO: 34883 - DNA, 1142 bp, Mus musculus
tccccatgcacaatcttgaagcccactcagtagtgggtcatgcaagctttccaagtttgatttatccagtattgggaaatcagcaaatattagctggtaacctacagtgaggatttcccaaagcctttacctagagtgatctgaaaagatgcaggctagtctcagaaactgggatggatttaggaagcttcattatattctaagtaattctaggcttataaagcatccacacagtgggaaacaggacagaactcggctctctgggccagctctggcatgcttgttatttctctcactagtggataaggattgggattctggtccagcctcgtaactaaacagaatggctgcccataaaactgggttattagatttacctcattgaagctcattttctgagagacccaaagtgctgcgctgagacaaacccaagtgcaccgaagtccatccgctcatgctcacagcggtgcacaggtggggacgccatggaccaaagccaatgccccaagggaagtcagaagagccataatgcaggaccctagacaggttataccaaagaaaacaagccttcctcatcctgctgcttctcagatgacggggtgagctgtgacagatgccagaggaagggtttgcaaacattccatggtcaaggtgttcaacgggtaagtccatccccaaaccagtaaaataaaataaaaagaagggttctctgttagttagtttcacgcaggccgtttgtacgtcagaagaaaaggtgtagggagcggcagcagccagagcagatggcaaaaaaaaaaaaattctctgctatcttaagaaggagcttttaaccggcgcactctcaccacacctggctagtgccagaccttatgcacgggagcaccgcatctgtaatatcaaagcttgggtttatggtgatttttttttttcctaaaaagaggtgctgtcaagagatttgtttaaagaactcttgggaaattttcttaacccactgtaccattttatgaacctccccacaaaaatgactctcactcagcatccccatcatctaacatgtaagtacccagactgtctaaggtgctatacagctgttacacacctacccctgcagctgttttaaattagagacttctgcatcagct

SEQ ID NO: 34884 - DNA, 1312 bp, Mus musculus
tatctccaccttcctcatgttaccctcatgtccctgtcctggtatccactcagaatttaaggaaaggaaagaagccaactgccacccttgtccagggacatgggctccattcagcaaggtcacctacagctttctacagtgaatggctgagtgtttctttactgtacagcagttcagctgcacaaacatgcagtcaccttcccttggagcatttgtcatcccaatagtctcacaaatgtggggtaaaaagtgaaaaatgcacagccatgaaggagcagctcccatggaatgatctcaccaagctgcatacacctcttccataactctgaagctcgcctgcattaactagctagcagtacacacatcaccaacctcagctgtcacccactaatgctctcacagcagattcctctcccttgaagtgaccacctctttccctagaggacatcccattatccttcttggctccgttgtagtcactggggactagcctttgctctggcatacagtgaaaggaggggaccctacatagagagccacccggcagccgcaaccctgctgccactgcttcactgtccttcaccttcaccctgtcccgcctgctgaagtttgggtttatcattcacttcttgtggtggcccattacaaagctgaccaaaggtggtatcaccgatgcctcagcaggatgaaatatagtccagagattatgaatagttggcaggatatgaagaaataatgtccttatgtgtgcaattctccaggggccctcagggaacagactttcaagtactgttctttgattcctgtcagacctacccgcatggcagccaggcctggtggtgtctgtctgagtcagagtttcttcccccacaagcagtaattggccagcttccttccgtcagtaagccggtattaactagtctgccaaatgctgtcggcaacagccctgagtgagatggttatccgtttagcgtcaccatcaccttagaaagctacccgaagctggctattggaatggccggaagacaaggggaatgggaaaggtcacgaagatggctgacctgttcctcggagtgcgagcctcttccagaaagactgcctcccagagtgagtggcacgttgctcctaagactctgcagtgggtctggagctcggctcacaggaaggctgatggctgcagtgggtgactgagagttgttccccgtggagcccgggctctcccgtgaattatgtgcaatttttgtatgtatttttaagctgtatattacagtgtttatgttgcaactttccatgagtgagaactgcagaagcc

SEQ ID NO: 34885 - DNA, 1530 bp, Mus musculus
ttgaaaggaaaaggatctacctactccacattcactgcagtggtaagctattgaaatagttactttgtgtcaggtttttcaggctgccataacagaatattatagattaattaggtggcttaaataggttgtgtgtgtgtgtgtgtgtgtgtgtgtgtgtgtgtgtgtgttgctgggaattgaacttagggtcttgtgtgtgctggacaagcacctgactgccaattgaaaccactggtccaacaatagaaattgattttcttatgtttctagaagctgagaagtccaaagtcagagttgtaagttggttattttttggtaaggactagtctctctgagtcctcacatgtgatgagtgtcactaagagggctatcttttcttagaaagacactggtcctattgtattcaggtcccaaactatatgacttacttaagtatctctctctttgtgagctgtatcttcagatatgccctcattgcacttcagagtttcagcgtctaaatgaggagacacaattcagtccataggattctaccttcagtccctccctctcatgtctctatcacaggcatttggtgtatgtgcttggctgaggagccaatggggcgaagctaccatctgtgggattatgactgaacgcctctaagtcagaatcccgcccaggcggaacgatacggcagcgccgaaggagcctcggttggccccggatagccgggtccccgtccgtccccgctcggcggggtccccgcgtcgtccccgtcgggaccggggtccggtgcggagagccgttcgtcttgggaaacggggtgcggccggaaagggggccgccctctcgcccgtcacgttgaacgcacgttcgtgtggaacctggcgctaaaccattcgtagacgacctgcttctgggtcggggtttcgtacatagcagagcagctccctcgctgcgatctattgaaagtctgattatttccttttccccagtgtacagttacccttgtaaaaggccgtaggtccctctggggaagaactggagaaagggtaacagcccaactgccttaaaagtcttattcccaaggatcaactctaaagcccttatttaaagcctcatctacatgttctctaaatgagatatgaatgaaacttaaggtatgattcaacttactgcagcgttgctatctgatatctgggtaaagctagacaacttatttgctttccaaatacagttgtgcagattccatcctgaaatatgagaaatcagaggcaagagagaaaggagagctgggtaccaaagtccaaatctagcaagtctcagatacccacccgtaactcataaagatgctctcatttgatgctctcatttgatactctgttgctcatatagtgcctcaaaaagactctctaccctgaggcacaatttattttccccttaactctctaaatctagagaaacaggctaatcatttgttgacacctaaaaggaaacagccctatccactggtcccttattaagaagaacaatattgattttttt

SEQ ID NO: 34886 - DNA, 1170 bp, Mus musculus
taagtaaccagaactctgagcatccctgcagcctgttttgaggagtcatatatacctttctgaaagagatttcctctgtgagcaccgtcctcctgctcatttagtcttgttctaggcctccagatactcagccttttttcctatctaagaccttcatatatattgtttacttagaattgaaagtacaggattactttttaatgaaaaccatctttaaaagggtcattttatttttgaaaggcctttttagagtacagaaatgttaactatatacaaaagtaaatacacacagacaggcaggcaggcaggcaggcgggcagattcagatatttaccactgaagggactctagccagttcacaagcatggctctgacaggttttgcctttctcccttgctaaaaagcattagattacattccgacagctagccaccaagatctgttcctcttcctcctcctgaagctgactaccaagctatcaaggtattgatgtccagcaatgaaaggcccctttggctcacgtaattaacctgcccaattaaaattaaacacctcattctaacacaaggttttcccttgtacctttatatttttgagcctagcctgtaacacctgagccatctctctagcccctcttatacctaagctgccatttgcctctgggccacatctgtcccctctctatccagaggcagtcctgtgtcccactccaggacaaacaccctgacccctcccccttgttcacttccccttcttccttaacctttgtctcctgtcagtctcttccctgttctttgtatctctgtgctgagaacttgatctttgaggtcctgagctgatatggttccctacaaccacaaagccacgctttccattttctaggtatagtatagtttatattcctagcactcaggaaggctgagtcaagaggataatagaatcatgagcctaagctagcctgggctatatagtgagacagagggggtggggaggaaggaaggaaggaaggaaggaaggaaggaaggaaggaaggaaggagagagagagagagagagagagagagagagagagagagaggaaggaaggaaggaaggaaggaaggacggacggacggacagacggacggacgtgggcattagatagatggctcaatggttcagaaaactgaca

SEQ ID NO: 34887 - DNA, 1220 bp, Mus musculus
agatcggacctatcagagtctagtaaagatactatcaaccttttcttatacttggatgtcagacccctgcactacgcattttgcctgaaaattgacagatacctgaaactggagccacagagacaccaaaatactcattattttcacaagaatcttgaagtctgttaggtatttaaaaatctgaaaatttttatatcaaattaaaaaacaatgctgtatgatttttgctgttcacaggacagcattcaatttcatatgtcaaaacacataaagttacttgcctagatttgtcataatttttttaatgctgctatgtcttagaaagcatcattttgatcagttgttattcaccttagagacttctgtttattcatttaaatgcgtaaaatccactaaaaatcccaaatttgtacagtagttttaattgtcaaatcctgggaatgagtatatatggtaatgtcataaatcatgtcataaatcacaaattcctctcataattcgtccttgatccagccatgttttatgaagtaaatgcagccgccgtcaacgttaccactgtacggtgtccctggaattagtaatgatttagtctccggctctctggaaattctgtctcgctggatggcatccatttttaatgctctaccgcataaattttctcaatgtactatgtaataatacttcattaaacatgagattttggacagaatttcattgtcttttatattaatccctctcttacttctaaagcaccattggtgatgacaccagtgaacaaagacattttttttttttaatactgcttcacacttgttaaatgtctttgtttggttttccagtctcttcagttccccctggccagtctatggagacaaactgaagttagaaacatgcctttttcttaagaccatatagttaagtcatgatcttcatgtataatcttaataaactcagcagtaagagatcttagttattttgctataacaatgctttccgtgtaaatttaaaaagacagtttattgagaagactgattttcagttttactcctttgtacttatgatgcagtccttggtgcacactaaatctgacagcatgttttgtatacagtgtctttcaaattgcagtctttgaaaacttgaacaaattccttacaaatgaaacagagggctttatttatttggtagtcttctatcttcttttcattgaacatctgttcttc

SEQ ID NO: 34888 - DNA, 1231 bp, Mus musculus
ttgcacctaaaagtaaaacttttcatgaaggcagggacttcctgttactattatattcctggcatcttacacatgatctggtataaattatacgttagaaaacatatggtagctaccgaggagcagacgtaacgttgtgagcgtttcgtagcggacgtcggaattagtgggagcggagtggggcctcgggggcctcgctagggccacagcggccggcagttgggccccccgccccggccggcggtccgaggagtgcaggaagggggccggggggacccgcccccggccggctgaagtcatgaactccaatgtggagaatctgccgccccacatcatccgcctagtgtacaaggaggtgacaacactgacggcagacccacctgatggcattaaagtcttccccaatgaggaggatctcacagacctgcaggttaccatcgagggccctgaagggactccctatgctggaggtctgttccgtatgaagctcctactggggaaggacttccctgcctccccacccaagggctacttcctgactaaaatcttccacccaaatgtgggccccaatggcgagatctgtgtcaatgtgctcaagagggactggacggctgaattgagcatacgacatgtgctgctgaccatcaagtgcctgctgatccaccctaacccagagtctgcactcaatgaggaggcaggccgcctgcttttggagaattatgaagagtatgctgcccgggcccgtctgctcacagaaatccatgggggtgcatgcagcaccagcagcgggagggctgaggctacccaagacctggccagtggggcttcagcctcctctgctgaccctatgatcccaggggtcctagggggagctgagggtcccatggccaagaaacatgcaggtgagcgagataagaagctggcagccaagaaaaagttggacaagaagcgagcactgaggcgactgtagtggggctctttctccttccctcccttctgtcccctcccactctgtctctaagttatttaaattatggctggggtgggggagggagttggggggggcaccagaacctggatttggttttctaaataaaaagttggaaaagcaaaaaaaaaaaaaaaaaaaaaaaaaagaaaacatatggtaaacaagaaaatgtatcatggcacattaaactgcactttgaggagcaatagtgatgccccatgccctgatcataaagagatt

SEQ ID NO: 34889 - DNA, 1101 bp, Mus musculus
ctcactggagaatctttgaaaaacctaggccgttaccagtctccttggtttttaaccaaaagtattttgtccttgaaaaaaaagtctgaaactgttctattaccacagatcttacagtttccaatgcaaacataaccaagccccccactcccagctgtcaaatggaacaattaggaagactgtgattaatactagcttggtctcattatacaaatatgtatagacagacagctaggcctgatgtccccagcactcgtggtgcaattaattactctgacaccagcttggcaaaggcttcattctactgtcaggagccagtgactaaagtgagccttatagaccacaagtttacaagttttaaaggagcatatcagagctggaaaaggcctttagaaatgtgtgtgtgtgtatctgtgtgtgtgtgtgtgtgtgtgtgtgtgtgtgtgtgtgtgtgtgtgtcccaaagaggtaagatgtagcatttgaagatgccagtgctaaacatgattgtgtaaactgtcatttaagggcctccaaagcacagccctaacatgacagggtggtagtagagctaaggtactcaaacaacaaggcattaaggtaaatacagtgattatgatcttggtgacttttgttttgttttgtttttttgtttttcgagacagggtttctctgtatagccctggctgtcctggaactcactttgtagaccaggctggcctcgaactcagaaatctgcctgcctctgcctcccaagtgctgggattaaaggcatgtgccaccacacccagctgatcttggtgacttttgtccagccatttttaatttttttcatagatatacaatggaagaattaccctccctttcttgtggctaactagcatctagagacacagacagaactcggagggtgtttatgctgagatgtgatcactgtgactgtcatagtccgtgtattgcccagtttctagtgaatcacagagtttggctatttgaagattagagattattatttttgtgtatctttattacattttattcattgtatctgtctgtctttatctatgcacgtggacatggacatggcacaatgtgggtatg

SEQ ID NO: 34890 - DNA, 1326 bp, Mus musculus
gatgatgggaacttctgtggaagaagtctcttgagctcacaaaaaggcatggtggactctgcttatgttttgctttcctctgtagccaccaactgccgaatctatgaaatctgtggaaaagacagcttccttctctccctctccttactaaggaattttgttgttgttgttgttgttgtttaaccacaaaaacaaacaggttctgtttctctcctcagggttggttctcggtttttgggttggatttggggttttgggttagttttagggtttggtttggttgtaggttttgggttggatttgtttttttatttttcttttatgctctagagcacaaggatagaggtggcagctgagatctttggaaccaaagcagagcatgctgagcccattatctaggcactaggccaccaaaggcagggggatggagtatggtccctcacaatctgcccataagccagagcccccatgctgtggctgcaccacacttctccacactgcgttctctcctgtgtgctctattagatagtccaaagggagcagcagtagtaacgagctatgtgagcacattgaactccatgcactgaaaagacccagtcatcactcactgctgcacagccagccagctttgcagcctgtgtgctgccccggctccccaccctcgtctgctgttttttgcttcttagattgcttgcctgctaagcccatgctagaactcactgtctgtggcagaaggacacccaagccggttctgggagtttgtctgtcttcaaccagatgcttcctgccctttcttccttcctcctcttattgctgtttctctctgtatgcagttccgagccgtttccatagcactgatcttcacggccagataaagctatggcttggtccaaagatgatcgatcattctcctctttacagatgtgatacctcatctcgtctagacacattcgcatagccagaattcagtaggatagcaagggaatctccacgatggagttcttgtcacagcagtagcttcctttcaaatactgcctctctctcccagcagctgccataagtggctgggcttcagtcaggttgtatagagctggtctgttccaccttctctcactccatgctcaacacagaagagaggatgtcagggtgcaagctggcacaagggtttatttccctggaaggttcatccatcgctgatcctgcgcctgcaagctctcctcaagaaggaagcagttaccaactcagtgttacacattccattcttgctttttttcttaaaacacaggagcagctggggaagggagatgagggcctttatttctgaca

SEQ ID NO: 34891 - DNA, 1139 bp, Mus musculus
gggcaggcattgagggcactcctgcctggctggacctggcttgggaggagacccaggcctgacgaattgttcaggctctggctactcacctgggccaagctggcaccacggtgtccttccttcctgtcttgatctccaggatcttcagtcattgagagacatccttagggccatctgaattgggacacagtttaaggctggagggctgtgtgactagtgggttgtttcttgtctggtccttttgcgatagtcctgggatagagccaaggtcctgcttggcacctaattctctgcctccttctagaggagaagctgcagcctgggaggcaggaagaacccaccttctagacctcaccctcccacttgccgcatggctgaaagttgcactcacatccttggcttgctagaacacaaactctgggaggggctctgagcctttggcattttctgccctcattgcattcatcatcttggggccacatccttccatccatcagatcttaaaggtctctcagaggctctggggatcaggcctgtgctggatggtcccacatggaaacaccagacggctccctgggaaacgcaggtggaggctgctgggagggagctgggttttctaggtacttcccctcctgtactctcctccgtgatctttgccttttgtggactactatttgaaggaggattaccacggtgctccctgagtcacacacccgtgaaatcacgcctatgatgtgcctgtcatgttttgcgctaacacagagaaaaataaatgcaagccaatgaaagtcaaaatgtttgcatcccgcttaaatccccccatgcaatccagagacagacatgtatctccactctgagagacacagatctgggacccctgagtaataactcagaaaaggattcaggactttgagagggtaaagaaactgagggaaagagagagagagagagagagagagagagagagagagagagagagagagagagagagagagagagagaactttgctcagggccacaggatcacagagcaggagagctgggagtacctgctttgtttctggccttctggtagtgtcatgtgagagaccccaggctggatcccttagcatctttcctgcttctgtctggggaaccct

SEQ ID NO: 34892 - DNA, 1147 bp, Mus musculus
caaaaccatctctggtgggagtggggtgcagtggccccatctgtccacccttcagctctgtccttccctatgtctacctaggtctgagataactgcagctctgtctgtctttgcacctccatttctcggatgctctgccctgcccctcttctgtctctcctgggaaccgcccagctattttctcattaggcagcagtgactaggaccgccttggtgggatggggacagggaggcagctgtcatgctcccctctccttctttctgccagtctagcttcaagtcatgtggactgacaaataggctttatccctgttttctgaaaaagtgttctttccggagggcaagctctgagccagccctagtcttgcctccaccaggaagccctcaggacctctttcctcttttccaaagtcttgggctaggtcccacccttctctcccggatgctctctcctgctcttgctgtctgagggcttcttctggaccggttgttacgtctcaggccttgctttccacccgtgtaacacaggcccatggaggcaatgcttgctactgttagacagagtccatgcaggatacgatggagctgacaggccggccagctaggaatcatggggagaggaccttgttatacacaaggagctctcagagcacgtgcctagctcctgtcactcctgacaagatcaagttcctacagaggccattccattcctcacccacctgggcaccttgaacttgccgggcggtgttgtattgggtctggagagaacagagtctaactggctgtctacggacagaactcaagtccctacttctttctcagctgcatgcaaattctccccacccttccacctctaaatagtcactgtactcagggtatgaaaggggacactttgcaaagcctagcttaccataactataacaaaatacctgaaaccgccatcttatagagcagtggttctcagccttccttatgctgtgactctttaatacagctcctcatgttgtgctgaccctcaaccatacaattatttcattgctacttcataactcttattttgctactgttatgaatcataatgtaaatatctgacatgcaggatatctgatatgcgacccctgtgaaaaggtcgtttgaccacaaagga

SEQ ID NO: 34893 - DNA, 1322 bp, Mus musculus
aactgcgtgtgctgcggcggtaccggctgcagcggcgcgaggagtacacgcgctacaaccagctgagccgagcggtgcgcgagctggcgcggcgcctgcgcgacctgccggaacgcgacccattccgcgtgcgcgcctcggcggcgctgttggacaagctgtacgctatgggcctggtgcccacgcgcggctcactggaactctgcgactccgtctcggcctcgtccttctgccgccgccgcttgcctactttgctcctcaagctacgcatggcgcagcatctccaagctgctgtggcttttgtggagcagggtcatgtccgcgtgggcccagacgtggtcactgatcccgcctttctcgtcactcgcagcatggaggactttgtcacctgggtggactcatccaagatcaagcggcacgtgttggagtacaatgaggagcgcgatgactttgatctagatgcctagcgagtcttcttgtcctggcttctcagctacaggtcactgaaccggggatggggaggattgccccggtgtactgggaatttttcctagaatttggactgacaattaagtgactgtgtcttgagagacagtgggaagcagttttgtaccgcactggggattgctagcttcttgtgccttaaactttgtggtgtagaagcaggaatgttacctcttcccctttgctttcatcttgaaataggaccgtctggatggagagtttgagttcagtatatttatatcgtttaaagaaaccctttcctaatgccaataaatgtcccaccgacgttgtttaagtgcacatttttgtctggtcgttcttcttacctagggtcctacatagccatatctattatcttgctagctgaagagcctaagggcaggaaaagggttgaaggcgtgaggctttggagcctcacgtggaggttgcaggatgttgtacaagctgggcagatttgtcacttaaccagtccttttctcggaatgaatgttttggcagagcttttatccacaagacttcctgttgatattccagccccaggaaataccatattaaagtcctggagtgtttgcttgcctaaggaaatgatcgccctgtagtttggccagctagtggttagaagggacccaggaggttcctgaaaacagatgttcttcaaggtcctggcttcagagttaaggacacccccccccccaaaaaaaaaaaacaagcaaaagggcgaggtagtgctggcacagcctttaatcccagcagttaggaggttaaggcaggcagatctttgagttccaggccagcctggtcgacatgaggacaaccag

SEQ ID NO: 34894 - DNA, 1228 bp, Mus musculus
aggctaacctgggctataatgtaagacactgtttcaaaaaaaaaaaagtaaaactcaaaataaacctgtaaggatgacttccttaaatcacccactctggagacagattcatgtataaagtcaaatcatgtatcaactaaattcaacaataagcaaaatttgatattgttgaaataaatatttcctagtatctttaactgaggcactggttttattggccatacatgatagtatgcctcccagtcatatttctttgggaatgatggaaccacttgccacttacttatggttttgtaagtggttgaatttgccatagactttaagaacaagtactataaatttagtcttatgagtttgattaaaaggagagagccttgtgatattgatgtgagtgattggcctgcactgtgacctgatgccatggtaaagtctgagtctgtgctgctaccgaggttcgaagatcaaggatcctgtccatggtcctgctgcagccatggtctatgctgatgactggcccatgttaacatctgaagccatacagtctgtgctgccacctgaggtctcgttaatgtccttggcctgtgctgctgccaagggctgtgatagtatccatggtctgtgcaggggcagaggacgggctgatgtctatgatctgtactgccacaggagaccaagctgaggtcagtggcacctgctgacactgagaccacgtggatggccatggtccatgctcctgatgactgtaaagggtcaggaagctacttctgccatgtgttgatgactatagactcagagtcgagaaagaaggaaatggtggaaggcttctgtgacaacccctaccccctccccaaaagttacagcctagccagaaagttatcaagagaacttttaaaaattgtgataaggatgctgaagtgtatgtagctctctactcctggagggtgttgcaggtggggaaggactcagttttctttaaggagtgggccactgggagatggaccatgctccagtgagtatatgggcaacacaaattggactttttgtgtatgtgtgtggggtgggggtcccaacggtggggagcagagttgggaggactaggaagtaagagtgctcggggttcatggtgtgaaattcctaaaccaataaaaagatgagagcgcgagtaatcaagtgaacctatggtggaatgcatacctgtcatcctaacatttggaaagaagagacagga

SEQ ID NO: 34895 - DNA, 1949 bp, Mus musculus
cagcctgttggccatggacggtcaataactgctccacaagtttccacctgctggtcagccttccttaaactaccctggacactgctgagcctataggttgccatcagttatgctgaagccatggatcaacctctttcctgtgtctcccagcgcacatgtgcacgcaaggcagcctttccctttggctagataaatgtggtgaacttgccactagaaagggccagcagcaatgtgttcttaattcctagcacctgctatcgaactgtgccttatcaaaaccaaattgtggctattgatttttgccagggtccctgaggtaagtggggaaggacccctccccccacccccatctcccagttcctctggacatctcctccttccctttgctatgatttgacagggaggtctggtgagcattcaccttcctacccagaaagcttgaccaagttacatattctagagaatgtcccgagtgccaagcacgtttatacatagggcgtgtattccagtcttttctgtcattctgtgtgtgtgtgtgtgtacgtatgtgcacttacgtgtatggatccatatgtatgtgtgtacataatatatactctgtgataattatggccgtatactataaatacatatacacacagatactctttgtagaagtctctggggatttatgttgcagttcagcattccttgcttcttggaccctgctgattattctggactggctggggttagggatcatggctcatgttgtcagacagcagagtgatagaagaaaacacatacttttttcctgggccacaggtcttcttccttaatgaaaattttccctctggactctatgcttgttggagccaaaaatactgacttatggtaacactggttcaatttagcatgggtgtctttcatctaacaaattctctgttgtctttgctgatttggggaacagacctccactgtgattccagactctgtcttatgaccccattgatggggaccaaggctagaaataaatttacagagctgccagagtccaaagtaatcggtacgaagttttaaaaggaataaaggagagcccagagtgaacaagaggaacctaccatgaaatccccttcttgggaggacaaactggggcctctttttcttgtgttggaagacacctttctttatgcaactcttccttgtctactgaatgcccagctctccctgcctgctagcctgccagatcctagactgcaaactgggtgggcctatgtctttataaaacataaactgggtgggtctatgtctttatgaagcataatccctttggctgcatgagtccgttccttggaatcactggtccactgcccgtacaacttgttcctgtcttttcccagtctgattcgccaggaatggaatcaagagttcccaacactgtgttcccacaaaaccctacagaacccctaaaccttcccttactccacacgatgaggttggcagctggtcagagctcaataattttatactgtaataagatctttgaatgtgtatattcttattttttacaatcatttcattttgtatttaacatcaatggactgagtcaagattcagtaaataattgtaatgttcatatgcgatatcttatagtggtacaattttgtatttacctataaatataccaacatgattaaacccttttagtttcatcaatttgacagtctggggtcgggaaggtgaggagggagtccaggagttggctctggacagatggggaggtatggggtggaggagatccacaacttcagtatctgagacttaagttctgagcggcacctgtttgtgtactgtgtaggctgtgacaggctgagtgctaggtgctttgtctcttatgtcacttcattgaaactgcacagttctaatgaatatcctctgtcctttctattacatctgcctcccaattctcc

SEQ ID NO: 34896 - DNA, 1112 bp, Mus musculus
tatgtgagactctccaatgagatgtgaagaggtactcctcttcctccaatagtattagagcccggaggagggattcggcaatcagtctccaataggcggggttgagttagggactctccccgccaataggggcgtggagaaggtgagcggctcgctctcccctcccagcgagggaagagggcgggagtaggtctttgcggcatagtgattggctaaaccattgacggatgggtaatatatcccgtggcggagcgaggttaagccttccctcggcggggcgggccgggagagtgggcgggatttcccgggtaacagagaagcggccgcggcggtagaggcggcagagacggtttctccatcttcccccctccccttccccccttagagtttccctccctccctccctccttcccagtctgggcacccaggcctgtgaccgcttcgtgggcgcaaaggaggttgccagtccgctcttgcgggcctgtgcccgcgccgttccggggcctccgtgctgggtgcgaggctcacgccgggagcgacgcacaggctgagtggctggagcttttgcggtgagagcacgccgcaccgcggtccgcccagcagctgggtggcgggtaacccgggactggagggcgtgtgtttttcgggggggctgacctcggcttcccgtgcgtggctgtggggggcggagcggagccgcactcagtgcgggagggggaggagagcgtagtcccggtgcgcacggaggggcgggtcctagtcccgccgatcagaggcggggccggcgcgcgtgcggtggtggagaaaggggcgggacgggctcgcgctaaaggcccgcggctgtgaccccgccccttctcccttatgggcgggaccactggctgaactgctttgggtccgcggggcgtgcgggacgggaagagggtcccggcgtgtggctttcagggcgcggtggcgagggggcgtgaagcctgtgttcccccgccttagcgggatccggttggccggaaggcgcgtccggggctgtgatgccacgcccctcccgccccgccccctccgggatttccgcctccttagcagtgaagaggagctggggaaagcccgctgtggcg

SEQ ID NO: 34897 - DNA, 1196 bp, Mus musculus
tagctgggactctggttgctgcccagaaagttttttttttttattttcatggttcaatcgggctttacttacaagatggttaccctcagagaatctagtctgagaacaactagaatatttattatgcccagtaattcttactgggtatagtaactggttagaactagaatgtgtgtttaggagcccacttctacttaccttctttgcttaccctgtaacatcttgtcaggatttttaaggtcactagccatgaagagaatgtttgtttcatattggaagtttctgaggataatttgtaaagcatgatacatttacaagagagcatggaagacattttctaatgtcttctgttttatcagcttaattaaaggaaagtcatgtgtttgtaggttaagatgtgtcattcagcaccttctctttgctcaaaagactgcaatcaaaacagtaattaaaaactttaatgtaactgaaataacatattttagccatatcaaacatttccgaaaataattgttttgtggtttcggattcaaaacagtagtcctcctaatatcatccgcccattttatccttcttcagaaagaacagcggaatgccaaggaagctggaggaaactacactccagctttgactgagcaagaggtgtatgcccaggtggctcgactcttcaaaaaccaggaagatttgttgtctgaatttggacagttcctgccagatgccaacagctcagtggtaaatctcatctagacaaactacattatttaaaattgttaccataagtttgaaagctatagcaagaggggcctttttagatgatattttgatcagaattttaatctgtctcgtatgtcttcattagcttttaagcaaaacaactgctgagaaggttgattctgtgagaaatgaccatggaggcactgtgaagaagccccaactgaataacaagccacagaggcccagtcagaatggctgccagatccgcaggcactctggaacaggagccacacctccagtgaaggtgagcgtaggcaggtagaaggtatggtgctcggaccctgtatgtctagatcaggttggttcacgtcacagaaattgcccacaaagcttcttagcagctttgcaaaaggcaggtcagaaaagcacttgctctgtggattatatatagtgtgtgtttttcagttcctatattttttctt

SEQ ID NO: 34898 - DNA, 1104 bp, Mus musculus
agtttgacttctgtatctgattttgtccttggcgtcaagttgatgattagcaagcaggttccacagtgaggtaggcagctggtgggcttctcacaggacacaagtctgaattggtgtagtcattgttacactatcttgtacctctgggtatttgcagaaaacaaattatttaatagccttttctgtctctgtgactttaagagctatcctgatgaaggataatggtaatattacatacacatataactaaaagagtgtatgtaatatctcaaagtcttttttaaattcagtaaaagaaatggttatggatgatacagaatttgtatgtgtttatcattttggttgagtgatttgattaggctattaggctattatagctattgttggctatctctctactttttcataggcttaaaagctgataaattaaaaaccaataactggcatacagtacaaaaaatgtagtctgtcaaggattgtccatctgtgattcccagtgtgttctgtgtggtgcctcctgcaccacaggaggacataatctgtactaacaaacaggtgtgttgataagtcctgggcagaagatgcacagtgctaataattgtcttttagatctaaaactccagattcatagacctcgttatgtagttgtacattttctgtaaactgttatacattctacaactttgagtctttaagaaatgttttcaatgctgtgagtagaataatagcctatgtgcatgtgtgtgagagaaaacaatggtgtgtgcacatgaaaggcagggtttcttcgttgagcaccactgaccgctccagacagctggccctggcgcttccaggaaatctcatgtttatgcctcctatcttactgtaggtgtgctgacagttcagatcaaaccctcctgctgcttctggctttgtgatttctggaaatccctcctctgacctcaaacttgcttggcatgtgcttcattcattgaaccatcttttagtcccttgtttgtttggggtgtgtgcattagtgtgtgcattagtgtgtgggtgtacttgtacctacctgttcctgtatgtcagtgtgtatgtatgtgtggaggccaaaggtcaggt

SEQ ID NO: 34899 - DNA, 1107 bp, Mus musculus
gattgtttccttactatttgtaacaggtttatacaatttcagaaaagttcataagcaagatatgaacacattttgtagtcccagcctttaggtggcagagggaacaacttgccacaaattgaagggtagtgtggtctacatagcaagcccttgtctcagaacgaactaaggtgcaaggaaaggcagtgctgtgatagctctctctgctcccactggcctctggtcagcagtgctaaacagtgtgcaatgggttgcagttagcattggtaactgctagtcagtttatgtatcagtattaaactttatgaattatgtacatggcattttttttgccagaaaataaccttatgatagttgtaggtgtccttgttcatattttactggtaagagatccttacataccttgtatggaaatcacaactcaaattgggaggagtttgacaccctccttattctcccagctctgctgtgttctggtgctaggcctgagaccctctttgttcttttgttttaagcttgatgtggttcttgagaccaatcttgcaacaatccgggttttagaagcaatacagaaaaaactttctcgcttgtctgctgaggaacaagccaaatttcgcttggataacacccttggaggcacgtccgaagtcatccatcgaaaagcactccagaggatatatgctgacaaagcagctgatatcatcgatggcctgaggaagaacccctccattgctgttccgattgtccttaaaaggtatgtatcttctggcttttgtgtgctgtgtgacaggttcagtgtcccattaaatagggctctagttttctacctgagtatctaattggaatttcagttctttcctcagtagctcaacactagggatagagtagaatggcagaacatacgttaggggttttgtggaacaaatggaacagatgttgacaggtgagggtgaaagacttgaggtgcagctcggtggtcgagtgcttgcctatcatgcatgagtcctgagttcacacagagaaagcctgatgagtgtatggtagagtgtagtgcgttcacatttcagggttgggctttgtttctgttggtagaagggaacttaggac

SEQ ID NO: 34900 - DNA, 1579 bp, Mus musculus
tttagcccagtctatgtagccctggtctacatagtgagttttgggccaaccggagcaacatagtgaggctctgtcttaaatacatacatatatacataaatattgttttgtatttgaagggcttatttgcctattttatctgtttcttctttctctcttactttcattttagtcccatgagcgtgtaagcaagcgtctgcatcagcggttccaggcctgggtggataaatggaccaaggagcatgtgcctcgggaaatggcagcagagaccagcaaatggctcatgggtgaggggctcgagggcctggtaccctgcaccaccacctgtgatacagagactctgcactttgtgagcattaacaaatatcgtgtcaaatacggcacagtattcaaagccccttaactgcagagccagagcaggtagctcagaggtgtgtgtgtgtgtatgtgtgtgaatatgtgtgtgtatgtgtgtgtgtgggggcatgtgtactcatgtacactgaagaatcaaggaagatgcctttcaagccaccagtgcaaccaggcaccagcaggatacacgaaaggaatgcgaatggatggataccttaggaagctggaactggcacttttcccacgggtactacccagacccaacagggaatgaagtccatgcaagcacagagacaggcagcttgcttgcacacaccagcagagctcaactacaacttcctatgacctgagcaaccagatgctgtccccatttggatggatggatggatggaggtgcatcttgtcactgctccttttcccacctccaaaaaagagaggggaggggagccaggatttgatgataccctgacttgagcacagctaagatctctgttagattttatctgagacctgtttggctttggaattaataacttatggatttggtttctgagtccttgaagttcaccttcttccctcttctggttctcggcctcaacaaattccagtcagtcctcctttttagctcccatgggactgttttgtacctgcttctttactagtctgccctagtgccatccaccagcttctctctcacacgcacacatgcacacacacacaattttaacttggtttttcttttttgtaaataatgtacatactgtcaattttttattaaagaaatatgctttgatgtgctagcataactgctctagcttcttgtgtaccatagtaccatgtggcttcagatttagtacctataaacagatgtacaagacatttattacactttttaccaaagggagataccattgtagtacttttgtgtaaaacttgtctttcccccaacaacttactttctttttcctttttttttttttaaatgtaaataaagcttgattcttaaggaaataagtaacataagtcccttgtcctctccaaagagctgttgtaaagttgggactggctttaatttctccaggttacaaataggattttgctttaaataaataagtacttgtaattgtcaaattaacatatcaacagtgaggccagtgggatggctccatagataaaagtgtttgccacataagcctgacaagtt

SEQ ID NO: 34901 - DNA, 1071 bp, Mus musculus
ggtagaggttggtctgtgctgctgagctgccaggcagtcctcacggccttagccaagggagagcgtttccccagccatccgctggctcacgggtgggacaggggcggcttcgagcatgcgcccatcagctgctcctgcccaggctcttcggggacagctgctcggtgacactctccagcttcctgacgcccgagaggcttccctatgagaaggcggtgcagcagaacttcagccctgcgcaggtcggcgacagcttcggacccacgtgggtaacgcccagtttggcgaagctccgccccacgaccaaaccctagtctgctagatagcagagtggcgccctctgctgagagaagctcctttatccttcggcgtcttcacttgagtattttcatccctgctgcctctccccctttccctttattctttgaccatttctctgatgctgcacatgcatggagaacatcttaaagccgagggtttccactcctaggcccatcaaaatggctctcttacagatggtggacctgctggtttcgggtagaactggtcatccctgaagtttgggtgggccaggaagttcatctttgctgggaaagcgatggagaaagccttgtctggcgtgatggggaacctgtccaggtgaggtgtcctctcttagagccagatactgccacagattagcctggtttttggagaagccacagctgaatgaatgggtctccagagtaatttcatgatttcggaactgaggaaattgccagtgtttagacacacccgaagaggttatcagatcccattacagatggttgtaagccaccagaatttggacaccagtgttataaatccccagttttcataagctagttttattgtgtatagtacatatgtattgggggaaacttcaaatcattctaaaatgatataaagtaaggtattaagttatcttcccatgaataatgaatttcttttaactgcacttcacattccccagatgttaaatgttaaatgtcataccaggtttaatctttgtaatgctatgtgatgacactttatatccattatagattttaa

SEQ ID NO: 34902 - DNA, 1146 bp, Mus musculus
cctgcgggagctagggggccgagaggggggagtgcatccggcaataccacaggggcttatatctggggcagcactaggtaaagtcaggagttaggcacaaaagcttggtttgactgtcacaacctcaggcaaaaaaaaaaaaaaaaaaagtgtcggcaagataccttttgccaggcacaagggatcgattcaaagttcaggaacagaagctgaggaaggcctgtgtggctgccgcaggggtgagtggtgatgggtaggctaggggagaacaagaggagagaaacattggtgaggctaagcctcaaacgtccctgggagatggaagcagcattattaaaacgtataaaagagaaagaaagcctctgcaggtgcgttgtgctgaccaacagcggagactcacccttttacacacttatttctcttgttcctccagtcacccatttactcatttcttatattttttaggagaggacggttaaagagagggtcttgctatgtattcctcattgtcctgggcctcagactggttcccagcttcccctgatcttctcttcagcctcctcagtaagaactgggatgataggaaagggccactgtcgtggtttgaatgagaatggcctccacaggcttcccgtctcatcaggcggctgtactcacgtgttcaagcatgaactagcaagctcgcacacacatggggtggggagggagatgataaaaatgtcttaagaaacacagcgtgtggaatataagcagagtggaatattatacactgcctgccacaggtagcagcataggtgattttgaggatattatgctaggtggtaggtaggtcagttacagaaggacaaacactgagattccatttatgtgagaagtccacattaatcagacacacagagtgaggagaaagattgttgaagatggggtaggggaggagaggttgatagtaggaataaagttccagttgcctaagatgagcaagtgcagcatgcggtctgtagctaacactgttgtacagcaaactctctgttggattcttttttattgtcgttgtgctgtgtatatgatgtgtgtgtgtgtgtgggaggtattcatgtaccacagtgcacatgcggaagtcggagtcaggtctctctggccagttga

SEQ ID NO: 34903 - DNA, 1175 bp, Mus musculus
ctacatgtagatagagcactcatacataagaaaaattaaaaacaaacaaacaaaaaccaaaaaagaaaaagagggctgggcatgtcacttgggaggcagaggcaggtggatttctgagtttcaggcaagcctagtgtacagagtgagttctaggccacagttgtctcaaagcaaaaccaaacaaacaaaaagaaaagagaggatgatcatccattgctatggtagagtggtcaccgggtgtgcacaaggcacttcacccagcaggtggccagtctgcgacattccttcccacagtttgtcagacttagaagcagtcagtcccttggctccctgtcgttccctgagatgaatcattcaacaaacagaagccctgtatggcaggggagaaatgtcagttccccgaccctggctccaggatggagctgtgcttcacttagccaggggatcagggtgtctgattccagacgagactgtgtgctaataaaaagccagcagccagtacctgctctttttctggtaggtgagttctccccacactgtgagattttttttcccccctctataatgacttcaaagaagtatttctgcttagcctctcctccgactcctctcaggagcacagcatggcgatcattagattttcctactttgtgtctaactaatgttgggagctgtagtcaatatagtgtgttatggctgtgcctggcatgctcagaaggaaagcagagcaggaaagattgtcttcatctgcatccctctacccatcgagcaggtgccacacctggtagcagataagcctgttcagcagccagcgctccaagggtaccaggttccagacagcttttgtgaagcgattgctgttgatcctaaaggtcacagagtgggtcgtatgactacgtcctccagtggagaaactcaagtcctgcaaagacatatcctggccagggtgagggagggtagaggccagggtaggatcagcatgtacagatgactctgtgaagccagagctatgtgcggtagagggagggctagagaaatgttggagggagagcgtgggcatgtggattgggctggtgggaagccatagcccagggtgactaggttgtagagctatctggggtccgaggtttgaggttttaatgaaagagtctgtagttgagggtgcaatgacagac

SEQ ID NO: 34904 - DNA, 1130 bp, Mus musculus
gtgaggacacgatggacctggctggtgcagacggtggtgtgctcaaggagaggagcccacccgggcatctactagctatagtgtagaacctccgtacatgactgaagcagtcacatgacccctgaggtgctggcctccttggtaaatggggataaaatctccttcctaggaggctgttggaggtctgaaggatgcaggtgggagcgcccacaaacaggcacttggttaaagttcccttactcctcaatgggctggttctcacagcagtactggggatcttatcggggaaagaccgggggcggggggggggggaggtgttacgcagaggacgaagctggctgggagctctcaggaggtctggtggacacagaaaagtagcctcagctgcagctaaagaaataggggggctgagcgtgctggcgcacacctttaaccccagcacttgggaggcagaggcaggtggatttctgagttcaaggccagcctggtctacagagtgagttccaggacagccagggctacacagagaaaccctgcctcgaaagaaaaaaaaaaaaaaaaaaaagaagaagaagaaggagaaggagaaggagaagaaggggactctggagagagggaagtgacagacctgaggagtttctgaaagcctacaggtcatgccccaattgctcaagtctttcgggaggcagccttcaggggagatctcagggaaagatcaacctcagagcctaaaacaacacctgcccttgcctgagagcacctgtcctatcccagggcttgggagataaaatgggctcagggtcagggtgtggactcatcaaagcagacttcaaaagggaaaaggttttgcagcagctgggaccatggcctggataaccctccatctctggaggtagcccactttcctagcagcccagaatgagtcacccaaggatttacatttatttacatatcatttacatgagcctgtccccaggataagtagcttgatcgctctttgcctgtcttttttcactgtactcagacaatcccgtccaaacccaacagctggaattaggaaatggcaggaaggccagctgaggtcatggaacacagatggtaatggaaccaaatgtagacctcttattcac

SEQ ID NO: 34905 - DNA, 1361 bp, Mus musculus
aaagcagaggcagccactggggaagggtcacgtaatccctcacctagctctggtgccagcaccagcccaccaggtcccaccctgagggcccgcttccgcaacctgttagaaaatgcctggctcaatggtgtggcactgcctacttggggtcacaaggcctccggagcagatcgatcttcgcctcacccccagctcttgggcagccagacccatcatctgtagcattgttaccagggctattgggacagcccaccatccggggactgctgtgtacctgtcctgacatccagctgcccacggctaggagtggatatgaggctgagcccacctaaccgggcagagacttgctgaacttttaacttgaggatccttctcttgagaaaacctgtgggcattggagccaaccccacctggccttgaatcctgactgttgtgtcctgggcaagcacttcacctctcatgagcccttgttccccatttgtagaataagacaacacagcctacctcacaagggttgttgtggggatgatgtctgaaatacaactaccatgctttggtttgcttcttgcccgggataggcctgggacctcagtcaggctgtggaataacaagactgaggttggcagaactttattgtcaagtcttcatgtgtcttggaacccagttactctaagaggtacctggtacaatgtgtatgactcacgtgcttcttcccccagaccactgcaggtgtagggacctggcctggggctggcttgaagagcctaagactgttctggagtcatatgtctgacctacctgggctgcttctcacacccctgtagggttgtgtagagttgtatgcttctagagccaagcagctgcagggaccggacccgacaggctgagctcaatactgggagaaggtccagactgagcactcttggtatttcccaagactcttggggtctcctccctgcaagtgggctgtattcagctggtggctgataagttcctgtcttatttaagggttttgatgagactgcgccctgggggacagctattaaagcatttgggttgtttttggagctgggatctagctttgtacttgaggggtcatagatgagtgttgcatatcacccgtcaccatctggctgtcgtccctgctcctgttcaggatgtctacagcttctagtattccactcctacaggcccgctcacacctacctgctggccatccactccaccctgggaaagaccttcccgtgactatggagaatcttagaggcgggtgcctttatgtgtcaccacatctgtgtgcctgtctcctaggactgaagatggaagtgtcaccctcctttagtgtcccttcagtttcacca

SEQ ID NO: 34906 - DNA, 1390 bp, Mus musculus
tccagcccaggccaaacgagcgtcctggagtgcctattgttatccgggacagtccagttccccgcacctcaccagcactgcacccctgtgccaaggagcggcagtctgtcccacagaaggatgccaggcctcccagctccccaccaatgcccgtgattgacaacgtttttagtctggccccttaccgtgactacctggatgtgcagacaccagagcccagggctgagcgggactcggctccagccaccagtaagagccaagacaaagattgcaaggggaacctgcctgctcaggatggagcctccaggtctcactgctctcttcgtgaggaggtggctctggacttgagtgttaaaaagacgatggcagagggtgtccctgtcaaggtccccagtcctgaggtgcatgaaaagcccgctgaagctgtggatgggccaggtatagaaaacacagtgtcaggtctgcctggcctaaaaaagatggtcacagaaatccctgaagtaactgcagaagccacaccaaggaccaacttccatagctctgtggccttcatgttccgaaaattcaagatactccgtactgcgcccgtacctgcagctattgtctcatctcccactaccccggctcctgtccctgcgcctgcccctgcacagcctgtacccaaccccccgtctgtgccagtgggactgcagatcctcactcagcctttgccagtggcatgcttcaacctggccctgcctagcccaccagccatagtggcctccccggccccagcctctgctccacctccatcaccagctcctgctcctgctccagcctcgggtcctgctccatcgtctgctcaagttcccactgcagccccagtggactccccggaacagcacttcacagggctgcacacatccctctgtgatgccatctcaggctctgtggcccattctccaccagagaaactgcgggagtggcttgagacaactgggccgtggggccaggctgcgtggcaggactgccagggtgttcaggggctactaggcaaactgctgtcccagctgcagaagttcgtgtgcacacagcggtgccccttccctcatgtagtacgggctggtgccatctttgtgcccatccatctggtgaaggagcgtctctttccaaagctgccaccggcctctgtggaccacgtgttgcaggaccaccgagtggaactacggcccaccactctgtcggaggagcgtgcgctgcgtgaacgtgccctgcacggctgcacctcgcgcatgctgaagctgctggcactgcgtcagctgcctgacatctatcctgacctgctgggcctacagtggcatgactgtgtccgccgccagctgggtgagcatggggcagctctgtagccact

SEQ ID NO: 34907 - DNA, 1105 bp, Mus musculus
ttctttttaaaatgattttcatttatttgtttgttttattgtatgtgggtacactatagctagctgtacagatggttgtgagccttcgtgtgattgttgggattgaatttttaggacctctgctcactctgggctaccctgctccggttggcccttcttggcttgggtagttccttggcaggctcggtccctgctcgctccagcccaaagatttctttattattatagataagtacactgtagctgacttcagtcgcaccagaagagggcgtcagatctcattatgggtggttgtgagccactgtgtggttgatgggaattgaactccggacctttggaagagcagtcagtgctcttaccagctgagccatctcgccagccccaagatttttcataaaataaaataaaaatgacagggtcctggtatgtattccagtctgaccctgaacttgagattctcttgtctcaggctccagagggctgatattacaggcgcatgtcaccatacctagcattcaaccatggtttgatatcaagcttgcatgacttcagaattcaaaatctcaagactctgagttggaaataatcagggagggaaggtctgaactggtctgctctggtgtgtgacctggtggtatggtctggctttgggagatggtgaggctgcccagtcaaaaggatggctgtataggtcgctgtttgtatctgtgtgaccttggacaactgtttatctctcagggagctgcagcttgcccatctctgaacaagggacaataccttccttatagggctacagtaagggttcttgagataatggatgacgaagggtacagtgtgctggatgttttcattctcagagtttagttgtagaactgttgctacccagaagtagaactgttgctgagtagagcgtgaacagtctggttcctagctttccagtgaatagtgaagctggcctcctgtccccctgggattgcttctctgtccttcagttgtgagcctgtgtggagacttaggctgttgggcagggtcattgtatacaggatggaggtctgttggaggtatctgggtcactgtgggtgctgattgggtatctcctgtgtct

SEQ ID NO: 34908 - DNA, 2762 bp, Mus musculus
gcctcttaaatcatgatcctccttgcccctttagggcttgcagggtgcaacactgtgccctgcgtgctgtcctctgcttaaccattccctgtggttgcttctgcaggttcataagttctaccggggtagcggaggcagtttcagcaaggctcaggaggaatggaccactggagcgtggaagaacccacatgtgcagcaggcagcccagaatgcagccatgggggctgctcagggtgccatgaatcaaccgcagactcagtattctgccactcccaactacacgtactccaatgagatgtgagccagccaagcccaccaggaggcagggctgggggccagtgggacagggggcttaagccacatcttctgtgtggtgaccaagcagggttcccccttcccttttctcctccccaactttgtacaaagaatcagagttatatatatatatatatatatgtgtgtacgtatatgtatatgtctatccctgcccccacctttgggtcctctgggaactttgcactgcacaagaagtgttttctgtgcattggtagccaagcctatgtccccttgtgagataatgtacagtggcgatctcttgttgtggtgctagatgtatgtttagaactaaaccagccccctccatccatcaggttgtcccctctgaccctggcccagagactccacaggccagggggaggcctagcagggagccagataccttgtgcagggtgatgagcctaagctatttctgcctttagtcccattgggaagcaacagtattagtgttcatggtgataggcaggttctaggcgatgggacagagaggatgtccccttgctccctgtagtcctccctccacctcctcttcccctcgttcctccctcattgtgagattctttgtgctcatttccctagctggctcctccgtgatctttttcctccccatgtagcttttcgttgtcttcctaaagcggggtgtctcagttatgtctgcttttaagactacccagatacccccaatccgctccccagttccaggaagctgacatgggagctcagccaaccctgacgtggaaggggcacccagcttggggattctgagcccatttggtacttgatacgggggaggggggggaatggaaatgcagagctgatctccttgattctgcaagcctggcccgcagaggcaggcatctccttttccctctcctggcttccaccccttgctgcccagatccaccttgagccgctctgcatttcccgctggcttgtatgaggcacttgccaggtgtaaaggccgtggtggaacagagggcatcattggtcgctgggggaggtgtggctggccccagctcagaagggcttctagcttctcaaagtgaccactggattcctggaaggagtagctgttctaattgagtctggcagaaaggatagaggtcagaaggttaggtctgaagggggaagatctgaggagaagtcaaataggacccattgagagggtagttcacctctccagtctcccttgtcctggctacaggacacattctgcagagatgctcccaggcccagttcaagctgcaagcacaatgtcctgagtaggattcctggttggcaggaggaagggcaggatggctctgcctttagtttttagtttagtgttctgtccttccctcctcttccattcacgagaacgacaggattcgattccaggcctttccttagttctcttagaaccctcatctctctctagactgatcttagttcctgggactgtatctttcaagcagggtgtggacattgtctggtatcttattcctctgcatgaggcctgaggtgggtaggccttaccaaggagcagctggctgtttctcatctccttgcaacagaaacccacctaggctagggagactggaaaaccataccacattggtttgccttggaccctaagacttggtttcaggccaccttgagctttgatttttcagcttcttccttgtaagagaatccaagagtgtctggaaagttcctttcctgttgactccctaggcttagttgattctctcccctactgttttctctatggagagcagttgtcatagctcctgctaccctgagagattctagggctaggctcttcctcctcttcccttctcccagctccctttctcttagtcctctgttacttccaggaaagctgtgatccagctgccagcctagcatccacagctgttgggtgttacccccagtcaacttcctgtcctatcggcctctcctctttcctggctcacacctattggccatgcctggcactgcccttgggaaagcctgtcaccagtgtctggcccagctgctcaggcactgggatgctgcatcttcaggcaactatgcactttgatgaggagagagtgagagagatggggccgggcacagatggtttgcttgaggggtgggagggcctggtggatgctgggagtcctcctgtctgtcgccagccagtgacctgcttttgcattctcctggtgcccactgccccttgtttctgagagacacaaactatcccctcattggcagttgacctgcccgagccagtgtctatctgtgtaactggatgaatataataaagggatcatttgaccctgtatgtccctctgtgttacttgtctccatgtgggtctcaatgaagccttgatgtgggatgtgaagcagggttgtggaattgagttgagtggatctgtgatgccaaaaaccatgtattttgt

SEQ ID NO: 34909 - DNA, 1547 bp, Mus musculus
cagatcaccagaaagcctttaaaaaaataaaaaaagccctactgatggccagcctttgcctgacctaaccaagcctttcactctttatgtggaagagagatcacgggtcaccagaggaatccttactcagactttgggactttaaaaaaggccagtggcttacatatccaagaagttagatcctgttgccagcgggtggttttcttgcctgtaagctattgctgccatagctctgcttgtcaaggatgctaataagctcactctgggacagcaaataactgtagtggcatcccacactcttgaaagcattatctgaaagccccctgactgatggatgacgaccaacgatattgtgacacatcagagctttttgttgactgaacaagtgacctttgctccacctgctgtcctcaatctcactaccctactgcctgagacttcacctactcatcactttctggcaaaagaaactggtactcaaaatgatctgaaggatcagatcagccttggcctgagagttcgagctggtacactgatggcagtagcctcgaggttgaaggtaagcagaaggcggaggcagcagtacggtggtggacagaaaccaagtaatctaggccagcagcctccctgaagggacatcagccgaaaaagctaaacttgtgactttgatagaaagaaggctgttgacatctgcagagaaggacccaagatgctgtggctaaaagaaaatcagatggcaaatctaaccgccaaacatgtgtcccaaagaacaatgatcctggcagtcaaggagcctaaagattattatgtcagagagaccagctttagatacacccctgagcactatcaagttatggacattatttaccccacctgggggccaaaaaattaaaaggcgtggttaggtcctttgactactatgttacaggactctctgacttggcagaagaaatagtcaaaagctacaaggactgtgctatgacgaagtagaatttacagaaattaagccagctagatatagcaacaagtgcttattagtgtttatagacaccgtttcaagatagataaaagcttttcctaccaggactgagatgaccaatgtgatagccaagaagatcctaaaaagaaatcttcccgaagtaatggacctgcctttgttgcccaggtaaatcagggactggccaagatattagagattaattagaagttacattgtacatacaagctccaaagctcaggacaggtagaaaggataaataaaattctaaaagagactggtacagacttggtgctccttccccatgcccatcactgtcttaaatgatgtgtttaaacctacatgttgttgtaataataatctgtatgctaagttaaaaggcttgcaggtggtgcagaaagaaggctggtcacaattggctacagggaatgagccagttaccacaaaagacatctcaccagttgcagccagagatctgatccacgtacacctacatcatgcccagaccctcaagcctcactagaagggtccctgcctagttctgtttaca

SEQ ID NO: 34910 - DNA, 2091 bp, Mus musculus
gatgcccttgcgctggaaccccgcagggctcagggaccaggcttgagtcggcatttgaaccttaagcatagtatttatttaggttgttcctgcataaggtctggttcagggagaacagatggtgacttcggagaacttcacctcccaaatcacccgtggctctgtgaccccagccgctgagctccagcgctggatcccaaaggctggagggactgggacaagtcacgcagagttggggcgggtcctgggcgaaggggcgggtcctatctggctcccaggcggagcttctgctaaaggcgcggagcacaaggtgccgagggcgcagagtagaacatcactaccctgtagaagtctgggctgaagactgcacgttcccagcccaccctccaaccttcactcggcgccggcaccccaatccctgccagctctcgcccggcacgacccgcggccatgcagccccgggcttgaggcggccccatggcaaaacctgcgatcccagcgacgacggcgcatggagaacttccgtaaggtgcgctcggaggaggcgccggcgggggacggtgatgagggtggcagcccgaactctggcccttttgcagatctggcacccggtgctgtacacatgcgggtcaaggagggcagcaagatccgcaacctactggccttcgccaccgccagcatggcgcagccagccacgcgcgccatcgtcttcagtggctgcggccgggccaccaccaagaccgtcacgtgcgccgagattctcaagcgccgcctggcgggcttacaccaggtcacgcggctgcgctaccggagcgtgcgcgaggtgtggcagagcctcccgcctgggcccacaccgggtcagacgcccagcgatccggccgccagtctcagtgtacttaagaatgtaccgagcctcgccatcctactttcaaaggacgcactggatccacgacaacttggctaccagcctccgaacctcagtcctggtccttcgtcccctcctacggtgtcgacgtccaagaggagcctgggggaatctgctgctgaagaaggcaccgctaagcggtctcagcctgagccagaggctgagaatgaggacaggaccgcctgagaattctcgcctctgagccacccagaccgactgaatcatatatcttcaacactcctgcatacctttcaacacacgcacctttcatacctgggttttaaggggcccatgttcctggacaccggtcctcagaatgacagcgcggatcccaaggcgacaggagagagctcaggaatgagaagagaggatccttgaagtccaaggaaactttgtgggacatgttaccagaagccacagaacaccacccacacctttgctaggccgtcttttttagggaagcatggtgggtagtgggactcttgagctttcttggggacccagacgttaaaagcacccagtatgcatggatgctgacagttgaggctttaaaaatcatctttgctgttaactgagagcgggagctacggagctgattacttgaggatggccaagttgaaaatgtccggaccctattctgcacccccacacacacacacaccctagcaattcccttttagcatccctcccccacccgccttgcatgatggctgagaggggacttaggacaaaatctgccatgcttcctccccgagtcctgctggagtcttgcttccaataaaacaaacgtgaaaatggctctgtcttcagttttgttctttttttctttttccttacccactcgcctgtgcagagaccactttggcatgcttgccttcaaccctattagcctttggagtcttcaaggtcagacacagagactggggcagtgtcaaaatgttgaaagagggacttgtggtggagggggccggggtctgtgtcactgttgtatcaccacaagggaaaggaagcagttttgctacttctctgggaggggaaggaggggggagcattgatgagctggaggcggcagcctgccaaggccggcagaccatgctaaggttctaaccttgctcgctcctcgcagtagacattcttacccagaggcaggcacaaagccccaagag

SEQ ID NO: 34911 - DNA, 1162 bp, Mus musculus
gaggagctgggccttgacaaagtgtaaactcccttcggtaagtagcagttcaaagagtggtgggctgatggcagcactgtcctgtgggtttttgtgtgtgtttgtgccacagcaacggtgtgaaattcagaagacatttttttctagtcagttttttcctatcatgtcagtccgagggcttcatctcaggttgtctggctctgcagcaagtgtctttacctgctcagccatcttgatcagctctgaaattactatcctgtctatgttgttctgactgctaggattacctggctttaaacttttctgattaggaaaaaaaggctaagtaccagtggtgtaaatgatgaagaggctacaaagtcaggcccttgtaaattgacggaggctgtattaaagcaggaagtgctccagggtggaggctgtttcctggggctgtagttccaaaggtcattttaaataaaatgtcttcattttagcactttactggctaattctgtgctttttttttttctctccctctctgcagatgggcttcctaaggacttaactgctattgctacttgattgaaacagttgcctggaaatgttttatttgaacaaattttcctttgagtatcaaaccatgtaatagtaacttggactttaataaagggaaatgagtttgaactgaaattaggtcttgtgatgttgtctgcattgagaagcagaggctgagctgggtatgggggcacagtcttagtcccagctcatgggtggcagagagagacaggtggatctcttgagtttgaggtcagccaagggtacataaagtcttaaagacagtcagcaaggtgatgtggagaaaagtgctgtgcagcagccagctcttctctgcctgctctcggcagcaccttgttagcttagacatcagagtatttgtctttgctgtgattggtttgcaggcattgtggttaaagactagagaaaggggcttactccttccttgaaagtactaagggaacagccctatttaacttcaggagctccataatcccagcaagcttctcactgcttcctgcttataggtctgtgggacagcagtacggctgtgttactccaacaggaaaacagtattaagttaaatgtagatgctgcggggagttttagtaagtttgatttttgt

SEQ ID NO: 34912 - DNA, 1154 bp, Mus musculus
agggaggagaaacttcctgaggttcttatgctgattgctaagaaaaccatttacagacattctgactcctcctgaggagggagaagaaagaacgaactccttcactcaggctgtgctgggggtatggtgagaggcagagagcagcactttatggcttgcaggaggaatctcaaagaatacagctgggaagcgccaagtgggttgttccttaggttacagcaaggaatctaacttaatgatggagtgggcctgtggctttcagaacctctgaacttggaccattctgctggccctgctgtctggatgggcttagtaactctgttggcccttcccctgttacaagagaactgctctgttgtatatgtttatttatctgtagttccttggcattggagagtttctccgacttttttttttttttttgaggtaaaaattggattggcaggaatctgcagtttttgttattaccagcagagggagctgctgggaagttagtgccttcctatgtttagctgtgtaagcttttgagaagtattgatggatgagaggtgtcctggtgtagctgtgtgactctggcctacatggaaatgtttagacaggatgggaaggggagacttaagccagctcctggaccccacttgagttgatgaatctgcagtgcaaggaggccttccctctaacaaggcacatttctctccccagcacagggctcacaggctggtagagcacttgcctagcctgtgcaaggctagggctgatgcacaaaacaaaacaaaaaaaaaagcctctgggagaacacagctaagccccaagcctgagactcagtactaagcctcttcctggaatctagttttcccagtccccctctgcccgggtcctcctctttggggttttttttttttttttggtttttcgagacagggtttctctgtgtagccccctggctgtcctggaacttactctgtagaccaggctgaccttgaactcagaaatccacctgcccctgcctcccaagtgctgggattaaaggcgtgcgccaccactgcctggcctctttgctttatcttacccaggtgtgtggtgaggcttggggtagatacggttcccagcataaggggcggcaatagtcagagttaggggttgggcaccacatg

SEQ ID NO: 34913 - DNA, 1380 bp, Mus musculus
ctgtttgccccagcacagagtcaagatgacccctatctctctatctatgatcctcctgtgccagacttcactgttatgaagatggaggtaagtaggtggaccaggaaggttccctgggtagcatgtgaagcttacatggggatacctggggctggatttcctgtcaagcccacttagtcggggcagccacagagcccatctgtctctctgccagggaccagatgtgggccttcgtagtgccaagagcttgaataatgggaaaggaggcagcaaagcccccaaggtggtctagaacccaggagtagagtgcaaattatactattctatcacttctttctgacaggtccctagctctgtcactgaatacaaagtctcaacactagactctgccagcatccttctgatggtccaagggacagtgacagctatcataccttcagcccatgcagaaatccctctgtaccgtggtggagtgctcttcattgcagccaatgagagtgtcttactgaagattactgtgcccaaggatctgctgatattccgggcctgctgtctgctgtagagactagttcttagtctctctgcctaccactgtatcctggccagctccatatttcaggtgtagcccaatccctgtccctgttgtgcactctttgaatgtatactggattagaagcagtaaatttggcattagtaactccaggagcatgcccaggctggaccatcttcaggacaaggtttctgtatgcatgaagcctgaggcctgccactcttctgtaccctctcaacactgttacctctgagccagtgtgtccaccaaagaggcaaccactctgccctagctgaggtgttaggctaacaaagcatgcatcccccagcattagctcagcatgctctcagctgcagagaagggaagggaagggaagggaaggaagggaaggggtaggccagtggactaatgaagcgtattccctctagctccgtcaaagtaattaaagatcacttgtgttgaggatacagagtgaagagcagtcagcctttggtatgcctgtccctgatgtgggaggaaggagctctctgatgatgtccaggtttggtttgaattcttcatacagcttcgtgggggtgggcaggctggattccagaatgcttttacaggaaggggtgggagaggaagccagctccagcctcagttggacagcttgcagggaggccttctgctcctgtagttgactttttctgagactgtcttcatgttccaaaggttggctttggagctctgcttctgcttcctaatggcccctggtgtttgcacatggtatgtatgtgcacatggtatgtatgtgcacatggcatgtatgtgcacatggcatgtatgtg

SEQ ID NO: 34914 - DNA, 1117 bp, Mus musculus
agtcccccagtggctctactctaggtgagctgtgttctgggtgggagcacagaagtctcccaagtcctcttccggtgagctcctggtgttcttcacaaccgagtcatgaccctgtgcctgctacgactcatgtgtgatagcaccttgtgccctctgggggccctccctagcctctcttcagacttctgaatgtacagtaagtggggttggttgagacttgggggatgaggaggggacgaagacaagtaagtcaagtcctgcccagcctctaccagtcttgtgagagggtagatgtctgcttgttttggcttctctcctcccaagggactctgcccctctgccttagcttggcccctgcctatcttcagcaatactcacctcttaaaacgcttagggtcttttggaagaaatcagtcctgaactatgtcctgcaggcaggactgccgagccttctttctgagggttcttcccacaatggagtctaggtccctttctacttgtcctgggggctccacgggtgtgtcactgcagtggcacctaagaagccgctgtggaaacctggaccctgtgttttgtcagtactgcgagagctcaccaagctggccagtctcctgcccctgggaactggggccctcctgagactaccctcatgctgtcagccctagagccaccaagtggtaatgtcagccaccggggttttgtaaacttcctggtattattttcctccatgtacagatgtatatgtcatgtctcaatttttgtgcttaaataaaaagattttcggacagcactggccctgatgtcaatggtggacttgggagggctatagcctactgaagtacagactaagggcctactaagataggtgaggtgacagttaaggttgttggtggctgagctgtgctggacgacagaccactcaactctagggaaagagttgaaaggcagaatcgaggaccctggcaatggcaacttggtctcttccaaaggcatttaaattgtttttcgccaagcatagtggcacataccgttagtcccagcactccgaggccagactgctctacaaagtaagttccaggagagccagggctactcagagaaaccttgtcttccaaaa

SEQ ID NO: 34915 - DNA, 1099 bp, Mus musculus
tgttctgcaaagaggacgtcatgcctcttcaggacacttgctaccagacagctgctgtacctgggccacccctccctgggagcctttattccaaccctactttttttcttgcactggaatgggacactcggataccctcagggactacctacctgacagtatgctctcggctctcagacctctccagtcttcctgcgagctcagagctgccatccttttcagttctttaagacaatccttcatgcatgaaagtcatgccctttgtaaaggtggaatacatgtgagaaccccagaccttccctgccttggcatggaggaggggtcctcatacccccacttacagctctctttgaggggatatgccacactagtcacatggtggaccctgagctagagctgggtcttggctgggtcttcccctctgtcctattaagctatggatacatccacagcttataccctgtatgagctggagaagaacttacgtatctggagttactggaagattgctctttttttttttcttctttaaacaccccctcccccaggtcatcatcttgtttcagatttttattcaaattcttattgaaggctgatttttgaataaggagcagaggagctgttctgccacaaatgacccccaaatgacaggcactgagactttctttcttccttccttccttccttccttccttccttccttccttccttccttccttccttcctttctttctttctttctttctttctttctttctttctttctttctttctttctttctttcttctttcttcctctgtgtgtgtgtggggtgtgtgtgtgtgtgtgtgtgtgtgtgtgtgtgtgtgtgtgaagggttatttctaaagttagagaatactggtgattttcaatcattctgcccttaaccgcctccttagggcaaaatggaacaccctccttgctagaggctggatgtatgtaaagactatagttcattgtttctctattaaattattttccatacttatgcatttcttcttgccttggaaaaataggtgaagtgatcctgctcataccaggagaagctggggagcctgactagtgtggcccagaggg

SEQ ID NO: 34916 - DNA, 1643 bp, Mus musculus
tccttctctgggaaatctattccttcgggcgagtgccttacccaagaattgtgagtatgggtctggaggccagtgtgtggctgaagccgagggagggtggggcggcaagagcatcccacgggaaccgcctgtctgtctggagcctgggcctctggtctgtcctgagtagcctccaggccattccctgacttcttagagaggggcttctgggtagggctccctctgtaagacgctgagctgactcacacaccatctgctcacagcccctgaaggacgtcgtccctcgggtggaaaagggctataagatggacgctccggatggctgcccgcccgcagtctacgaggtgatgaagaactgctggcacctggatgctgccacacggcccacgtttttgcagcttcgggaacagctcgagcacatcaagacccatgagctgcacctgtgacctctgcctccgccaaggccatgggccggcagggacagggcctcggagattacagatctggtgccctgctgcttgctgggcctgaacttgaactgagccccagccggctggtaggcctcttgcctctgacctgcctgtcccttctggcccccagggaccccacctaggcctggcatcttctctcatggacccacctatagggcttggggtgcccactgaaggggctgaggagaggaggccaaggaacaggaggagtgccgtgcagctggcctcctcaaggccccaccattcgccttcttagagttttattcctttccttttttgagatttttttccgtgtgtttattttttattatttttcaacataaggagaaagaaagtacccagcaaatgggcattttacaagaagtacgaatcttatttttcctgtcctgcccctgggggtggggaggaatcagcctctctctagggacccatcaccccagcccgtcccccatcccgtgttccatgtccagtgttgcctcggtcgcctgtgtttgcgcttgaccatgttgcgctgtttgcatgtgcccaaggcaggcgtctgtcgggggcttggatttcatgtgctgtggccgctcacccacaccgccttgtgagatggaatcaataaaccactccatgaggacaccgccacccagcctcggcgcttcctccgccgagcctgcctgtctgcccagtcgtcttcccatgccatcttgtccatccccctgtctctgtgagtggggctgagagggaagcatggccaggagatgtaaccgcctctttgtgtcagctgcacgagccagtgtcctgtgtctgcccgtggggaagtgctcaccgctgtccatctctgccagctactacccgagcctgagctcctgggctgcctcgggctctgggaccggtccttggtatgctgctggggattctggctgcttctgccgtgttgtccaggcctgaagcacaaagaagtgaagtcctggcgtggccagatgggatgtggctctggggtgagagcccagataaacatgcctcaggccacactgacctcaagggtgatgggaaggggagcccctggggcttctcacgtctcatctaacatgtgacagctttgctcttccccaccctactgtgtgccaagccctgtgccctcttgggctttgcatggagcgaggc

SEQ ID NO: 34917 - DNA, 1188 bp, Mus musculus
actgtcagaacactactgggaatgagccacaagggaggtagtactacccagcaccacgagagaattggcttaggtctgcagagtcctaccttcccaccccccaactcccgtgaggagagcagagtgggaagtggctggaccccggaggaagagaagtggtatgggccggactcccgggcgtttgccctttcccgttcagggcttccctgaaggtatcctggcttgtctggttctgaactctacttcagtcgttgcacagaggttctattggctccaagcagcccagggccatgccacctccctttgtgcctgatagaaggccgggtccttgaactaagcctgtcacccttgacctgccagaggatcaggcttaaagcaagggacctctgacccttgggtggagaaactgggcagggcttccagtctgcgtagaggtgacactgggcattggtactgtaccccgttccccccacccccacccccagcatcctcatcagtctattttcccaggcttctcaggacccagaccagttatttggaaggggtgtgtccagtcactggatctttggagcttaagtaggagttttttttttttttttttgatcattttgtatagcagggaactgaggcccaaggggcaggtcatattccaggctcctgatggagggaggctagctgtctctcattcccacttctgcaatgatggatggctggaggtggaggggaaccagacccactctgtaactaccagggacactggcagtctccagcctgacccaagagggaccttgtggggtgagcgagcacgtgttcccttgcagagggctagagaagagggaaagggcttccggcctcagtgctgtcttcttacaggccgagatatcgtatgcattgcttataagacttcctctcagtgcgtgggactgggtcctaatcgtgtgggccatctgtgtggtgtggtgtggttaggtgtgcagaagcctggttctgggcagctttgaaacagcctggtagttagttctgaccctgcctttcccacatttaccagatggctcagtcagaacctgaatggggtcagcgtaggcagagtggcagacaaccttggactgaaagtgtcagtatgggggaatgttgacacttggggcttgtttctgtctccctggaccctagatgtcgtagtgtctcggt

SEQ ID NO: 34918 - DNA, 2949 bp, Mus musculus
tttgtggaccttgtagactatctcttgggtttatttcttctgtgagagaacaaaacatacttcaaacttgcctgccaccttcccttaaccagggaaggctttcccactggcatgtatgtcaggggtggaccagtggctccaggcatctttcaatcctaccctgcctccattaaactggagctttgtttacagacataggcagctctaagactgtgtcaggtttacagccactgggtgtgggctggcacattgcggggatgggccagaacctgttagggcctccagccactcttatttcagaaggctttatgtctcctatgcttcctttggccctgcaaccaggcagcccacttgtcctgtaatcattagatcaggctgcatggcagctatccagaagacaaacccgtgtgtgtctctgcttccccccaaggctaccagagtttgtttggaaactttggaccctcctcagatgttccaattttatgttgggacttttcctgaggagtgtgtcaggatgactgtggtaaagactttggactggctgctctgctgtcatcagcagttttgtgcctgtcaagctacaatgcccatctcctagttaggaaccagaccttcatgatacagcttttcagtattggggagaccttggaggagcttggtgcttctaccatcatttcctacctccttgtccataaatacgcctccgtctgcccctctgtctctggaaatggccgttttcagctatcccaggacaggttacatgtcccccatcctgccatggcttcactccagttcttatgtttaggctttaatcctttatagttgccctcctcaggtgtatagttggaactagtggcctgtctcaaacatgccaaaaatgagcccagttctagatgacagtagtgggattcagccatgcgaacatcgcactgctcaggtcctacctagggcattatcctcaggatcttcctaggcttgggtccttcaggttaggagggtaggaccatgcctggagcctcagcagagacctttgtaaaggtcttgtactttgaagctttctactgtgcccagcactggttgaggggtataggtggacaggcaggtgggcttgctaaaatgtttgggtacagagtaaaccctagtaccatgaatttttcaggctgcttccttgtaggaacagatgatgatagcctttccgtctcttctcttcagttatctccagctccaggaaagaggccagaggactgggagcctcagctgcacgacagaactttagcttttaagctggacctctttttctaaaggcggggttacaattgggacagcaggcagccactacaggctactagacacacataagatggtagaactctggtcctgaagatggttagcattcggcagttctccctgctcttggcctggacctgcctagagttgaaagtgtgttactcctacctgcagctctttttggaagtttctgctcaatggctggtttcagtcaggtggtcatatttgtcactaatgcatgcagctcttgggaaacccaaagccagcacaataaagtgacagaaacctgtgctatctaaactgcttcctagagtgaagtgctgcttctctaatccctaggagcctaccctgatcactgggtatgtacatagagacatggtggctgaggcacaactaggttctaatagtgagctattgccctttaaatgaaaatgcaagagcctttcctttctaggtctggcaagtctcctggggccaaaactctacttaaccttagagcagttgttctcaaccttccaaatgcagtgaccttaaaactgttttcattgctacttcatagcagtttactaatatacatcataatgtaaatgttttcctatggtcttaggtgacccctgtggaaggtggttcagttcccaaaggggttgtcacccatagattgagaaccactgccctaaaagggatgttccagcttctagcttatttattggcttgcctttctgtgtctggcccaaaccacacttggctttccacaagctgagctgctaagaaagactttattaataagtcagtcagcgtagggagagggcaaggagcctggagatggacacactggtaccagggggttacaaacagtaagaaacactttattataactttacaacatataaatagcttgggtccaatctgtgctttctggcagccgggcaccacattcccccttcccttgcaggctcctgccttccttcacattgcactgttcatcggtggctctggctctgaggccagtgggagaggctggagaaaaggggccagcagcccagtccagctctccaactcttcgtgtgctggcctgcacctgtcatctgctggggttacggctgctgtggaaggaccgctcctcaggggtcaggccagcaaagaaggggtgcagcaaggcttctgccaatgtgatgcgctgagcagggtcgaactctaacatcctcctcatcaggtcaaacagctgcacatgctccagggagtcctgcagcatgtaactctgctcaaggacacaaggtgcctcagttggacggcagggttgtgggaagccaccgcagtccccttgcctctgggatgccttgctgggatgggttgaggaggcaatgatgcctccttggaggactacttctgccttccaggacagaacagccactcatttcctttcatgctcagaacttaggctactgggtgggatcttgctgggttggtacctctaccccacatgcaaagttctgatgggtgggtagaaatcacctctgcaaaatgcacttgtccaggtaccaaattacagttgacaggcctccttagtcacatctaggtcttccctccccctgcctcagtcctgcctaattcttcccaaaattcagagaagagagagggacaggaaatagcagtctgacagtt

SEQ ID NO: 34919 - DNA, 1241 bp, Mus musculus
ttagggctcccagaggtttacataaattgcctcccaatcctgctcatacacaagtacctatttcatctttggactgtgctggtgagatggagcagccttgatggatttgtttaaaaggtgcttggccaggcaagcctaggactatgcactactagaggttgggtgtgagcaattgaaggcttggaaagcaaacaagctgtgctctcatgcctggccatctggtggacaaaatgtgaaggggctggatatgggtgaaaacggtgccagactcacgtagccatctctctgaactggctgctgatcccatttgggagtctccggtattggatctaagtactccgtggttaaggaatacttgtcctacttcccagtgtagacctacagccacgtcttcttggctccttcagagatagggcacaagaaagagtgccggagtaggaggagctagaagggatggctatgatgctgttaaagaggaagcacctggtatgggactctagttggtctgagggccactaaaatttgcctcaggcaagcagcttagatacctgattgtggctcctttctgggctgatactctggatgggtcagcaagagctgggcaggccttctgggcccaggcccacttggctggaacctgataggagtagggactattggtgagacattgtgtctttgctcaagggtcagagttctcatttctactgtggttcctcactgactgaagagttttgaatttctttgagttgagtccagttcattgctttagccaggcaagtttcagtttagtactttggctctgtgccaccagttcattagctccaggcttctagaacatttaggttataggatcccataggcatgaagaaattgagcaaaaaacctctccattcctcctgtccttggcatccccgtggcagtgctcagcatcccactacatctacttctgtatctgggccctggcttgcatagtttgagtgttcaggcccctgggccaggctggagaggcacctgtttgtttattcacttggcagaggagggagtcatccacccattgtctgctgttctgtcactgtgacatcagagttcttctttacttcataaacccctgggaggggctacccctaaacagaacaatgggcctcttcttcaggagcacctggctgcaccaggcagccctgtggctggaagcagtgagctgtgtgttgagcagggctttctctttcttgtggcctagatgc

SEQ ID NO: 34920 - DNA, 2560 bp, Mus musculus
cacagaatttacctcacctcatggagcccacaacagacaccatctggccagatgttaaatttggaagagtccgtctggccaagctccattcaggttctgctgtattctagggggcaggacagagtagcgttgtccaatcagggattgtcttggagaactgggtggggcatctgggcatccagctttcccagggttccccaaccacctcccaacccagagtagtatatcgacaatctgtaaggcgacttggggctggaggcttttcacttcccttcccccttaatttatttcccttctgctgccttctgccttcaccccaggatcaccagacttttagtctgcccagtcccccagtgtttaaatcccatttggggctctaggagtcaggagcttgtcttccttgctcttgttggctgagcatggggtgaggatgagtctgcccgggcctcctttagtctccaggagtggatctcccatatccaagtcttaaattcattcctcagggccctggaatacttttgttgttgttgttgttcctaagaaaaaagcatgttagggcaggctttgggttcagggtccctctgtatagagaggaagaagcactcacggtgcccaggccctgatacctacccaacaagactcccttctgatcctcaaaccttggcttcctgcctgcctatgttggccaactctcccaagataccactggtccctggtccctaacgtcgtctcgtggggccatctcagccctaccagcccaagacatggtgatgtcaggctcactgaaatacctcagatttgtaattgttgatatttgattcttcaggaagtatttgcatctctgtaatatttttttaatatgtgttttgctgactttaatttttaaatttttattgttgctgttgtagcaccaaagaaatgaaagcagatcaccccagccaggtgcagtttgcagccacctccctccaccctgcccatgccctggccagggggtgtagcaggtggggtgactcagggatcatcacagcaggaggatggggtggagggacccctgcttgctggtggctcctgaaaccacactggttctttccaccgcccctaccccagctgtcagggtagggcagaggatctttctgcctttagcaccctcaccttggggcagaggcaaatggctatgggccctgcctgaggctgagcttcaggaacaagaggatgctaagagctctgtcttctgttggcatgcagctggaacaggccactgtggtagagaaagggtagaccttatccagggctccattctcatcgcagtgtgcctcactctgttacataaagcatcatcacccagacccaccaggactactctggctgtagcagtggagaccacagcatggcccagcagtcctgtcctaggacaagaaagggaaaagcttatgcacaaacatacctcagcctggcgagcacagcactgctgacttggtcttatccctgccccaggacacacacactcagtaacacgcacacagcccttacactggggtctgaccctcttctgcctcataagccctatccacgaggcacatgcagggttgggcaaggggtctggtgctatgagaagcctgtttggccagtgtgtctcaggatttagtcataaaggatagacccttcctacccaggggtgacagggacagtgctgcaagacttttcagtcatcaaatactctttcctcaggcagcttgttcccctgtccctctcaatgcccctcactgccctcaagccagcagcaggctcctagccagaaaatgcaagagctgggtgccttgtgtgcccagcactagggctttggcccaagtggcgcttcccccgcaggtatagtcctgaaggccacgtggccatgtggttggccaggacagcctcctccccttctgtgtcttgtatgtattctaaccagaaaaaaaaaaaaaaatgtgatagcacatggtagcctaggccgtgactgaatacctcagatttcctctcacagcaagtgtctgtctgtgtcgtggttatcttctgtcttacatgttcttgaatgtttatatttcaataaagctctacctcttcacatgagccagtatgggatcctttcactgacttgaactggacaaggaccttcagaatgcaaagggacttcatggacccaggagccccaggtccccagcttctcctgaaccttctctcccttcactgtctgcttcggcagagggctggaactccgtttctcagccgtgttgtcagaatctcctgacagtactagtcaccatggcagtgctatggagtgtctgactagcaaggggggccacctctgtggcttagcacacccttgctgaactcactgggtcacattcagaagagatgtgtgtgggccctgggagggcctcgggctagtgggtttgtgtgccccctatattttagagaatggtccaaccagggcatggacttagaagggtgacctagaaccaaatgtcagtctgggtgtatgtcttctctgccaggctgctcactcttagcagcgcaggaagag

SEQ ID NO: 34921 - DNA, 1099 bp, Mus musculus
tatgtgccactacacctgggagaaagtctttttttgtatgtatgtgacgcatgtatgtgagtgtacagaagtatgcactcgtgcatgcatatgaagagaccagagcaggatgtcgggtgtttccccatctcatccaccttatttccttggcactgaatctgaatcttcttccagtttgggttagacagcatgggcttggtgtcagcttgctctctgccttcagccactggtattacaggcgtgtgcagccatgcctggctttttatgtgggagctggggacttgaacttaggtcgtaatgcttgcagagtgagtgttctttacctggtgagttgcttcctatctcctgagtgctgtctaattaaaataagattctcaggggatagaaaccaaattgctttgagaaacaaaatatgaataggcaggttttttgtttgtttgtatgatttctttgtagatttgatctactgtggccggaagctaaaagatgaccagacccttgacttctatggtattcagcctggatccacagtccatgttctccgaaaatcttggcctgagcctgatcagaaacctggtaagggagagtttgtcctcagttagatgggcagaactttctagtatctccaagggaagagcttgtgtgttcctgggatacagtcctgggtgattaccaaagtggtgataggtgctatctctatccttattggtttagatccccattggtaaattaagatgtgacgttgttattgttaacaccactaataatagatatatatatatttttttttttacttaataagttcattaaccattgttttctaaccatgtagtgtgtatggatctatttaaactctttagatcaacagttgatttttcagtaaactttacattcttttattatcgttgctctgttcattagacaaaagccaggaacttaatttgtttttgtagtgctatagttcgttcttggttaagcaactcttcccacaaattccctcaggtgatgatttgttcagtaagctaacaccgcctgctgagctcataacttacctccagaaatattccactagcattcaagtagctctcggagaaactct

SEQ ID NO: 34922 - DNA, 1165 bp, Mus musculus
gtgcacgcctttaatcccagcacttggaaggcagaggcaggtggatttctgagttctgagtccagcctggtccacaaagtgagttccaggacagccaggactacacagagaaaccctgtcttgaaaaaacaaaaccaaaacaacaacaaaaaaaacttcattggctagagagatggttaagagtaccagcttctcttcccgaggtcctgagttcaattcccagcaaccacatggtggctcacaaccatctgtaataggatccgaggccctcttctggtgtgtctgaagacagcgacagtgtactcatatacataaaaaaagcaacaacaaactcatttgttttcttcacattcaagtgtatcttcagtctttatgatgtccctatgctatggtcccaaacatcagtagctttgctgtgtgtcttctctttttcctttctatcctgaaaatacaaccttttaagtctatgactgttcatcaggagccttgctaatccttctgcctgacctgtctttccacagatccagtggcagcctcagctgcagcagttgcgtgacatgggcatccaggatgacgaactaagcctccgggccctacaggccactggaggtgatatccaagcagccctggaactcatctttgctggaggagccccatgaacttcttgtacctgaacacctagcaaattgcagaggctgttcctggcaagaagcacttgtgaagttgcttctagattccccacccaaccccaccccaatatatcatatgctccccttgcctgccgtgtccagtgcttggccttcttattgacctcaactggtgggagcagcttggcaagcaagatgcatggttgtggtgctgtggttcagggttcaggttgatccttacgtggtttagatcctgggccaatgtcatgggggatgctgtgtaatacccatattcatcttagacaagtccctagcaatagcccccatctattttggtgctttagagcctgaggctgaagtgagctacaacccagtcttcagggtagttgctgagttacagagacggccagaagagactatgacctctgatgaaagtctggggagtgaccaggtgaattctggatgtggcatgagaatatatcagctgattccatgtccctacactggctgtgtctcac

SEQ ID NO: 34923 - DNA, 2210 bp, Mus musculus
ctgtgaccaaacttactttctctaaaattcctgcagcagacaccagaggcaccccagacctagacctcccttctaaaagccagaaccaggaaggcttgcataaagaaggtgtggcctctgagctctcaagggccccagttgccaccaaccaccaccacaggtggccttatggctcttcctggatgttcgattcatgtaagtgacctacctgctgatgatccacaaataatactttagggtggcactgaccgctataccagcagccccatgagcactcaaagtgcctttcgaaccataatgccatcttgaatttgggtcctctcggccccaactgaccagaggccaactgtgttcacatttatttttcttaaagtacttttgttccaaaggggccttgtggcgccagagagctaggaactgtggctccgtccatacccgtttccacacactgacccttcagagttggttctttgtttatcaggcctcctgaccctccctgcacttagcccttccaagggacatccagtggagcactggcatctcgagcttgggaaggtctttagaattaggctctctggagcagggcctgtagtgttaacaagttctctgggtggttctattctgagcacccctgttgcctctgacgaccccccccccaccaaagggaagcagagaagcccctggccatgcacattgagtatgatgagcaaaaggccagaactccagtgtcctgtgagattggctgacccgagcgaggtattatctcggtcttcagccgctggagtttcagggctgggcagcaggttactggagaggcaggcaagaagcgtccttaccttctctcattccccagctctcattctgagcctttggtccctgaccttatggccatcttggaggtcagttgttccctgtggttgactgaactgctgttgctgtccacattccaccctgacccattccctgcttgcgcctagggtgttttccagatagcccagagttccagctttgacagcctgatgacctccattttcatatgaatgatgcctgcacccccacacctctgactcatcctatgggtgttccaaggcacccaatgctccaccctttaatacagtttcttatggttgttgtgacccccaaccataaaatcattttgttgctatttcatgtctgtaattttgctagttcatgaactgtaatgtaaacatctggtatgaagaatatctgatatgcgactcctatgaaagggtcgtttgaccccacccccaaccccaattgggtcacgaacaacaggttgagaactgctgctctaaggccttctgtagaagtccattcctatcacagtaaggctgaactctgaaaactatccattagagctctggttctgggtggggataaggatgggaggagaaaggttgagaccttggtctggctgtactggcaacgcggtgctgggcccatgtctcataccttgccctcagcctatccctgaactaaacaggacccactgagtcccagcctcagcaggctgcttgtcttcagttgatggtggattaatgacagaaggaagccccgcccctcactgctgtcaaagccttcagtaaacatgtgaatcctgaaaccctaacattctgattgcaatctctactcatccctccttccctagaggagcctttgaggagcctctttcctggggacaaaaggctctcctagacatgagtgagcaggtaatcgcccaacttggctttggggaaagtcagagtctgacagagctgagcattgtctcatccagagctaaggacatgagtcctctatttcaagtagggaaacccaggtggactttgctcaagatggttcccaaaatgagaggcaccaacttcaagaattgcctcctagggggaggcacgagccagagaccaggacctgcaggtcctttgctgctgggaactctcccattttcaggtttctagagctgtcgataaaatcctgtgaactgagagcgaggagcagtgtaggaaattgcaatgtgtggttcatgcattgtctttgatatcctagacggagctcagcttagaactttccaagcgccagtgcacagcgttctagggaatggtgctccttggctgggtgagctgccaggcaagtttaaatatgctgtgtgtgccacatttttaaattttgtcaaggtttacccacacacacaccaa

SEQ ID NO: 34924 - DNA, 1155 bp, Mus musculus
gaattgactgggccagtgaggcagctcttcagcatctggagagggtgaacccagaccagagaagggcataaccagggtggctcagctctgcctaccaatccaagtgtgaggatagacactgggagtctaaggacagaaacccggagcaagagtgcaaactctggaggccactccagaaaatgacgtaatttttccgtggggaagagaacagtctcctgctctcagctcgaaactaggaagatgcctccagaaaggccctcacagggatggcaaagcaatgtggggtgtctgggtgtaaggcgggctgggaggaagttggggtgcctgatgcaggactacaaaatataagttgaatgaaaagcaacttcctttaggagagcccagccctggttcgctttctagtgagcaccacaacttctcttggctgaaggtttgtgaaaagcaagtgttttggaagggtgggtgataaccgccacggccaaaggtacttatttcaggtcacagcttgtagtccatcatccagggaagtcatgacaggaacccaagacaggcactgactcagaatctgtggaagaatgctttttactggctgctgttcttcctggctagctcagcctgatctcttatacacccaaagaccgtgtgcccagggatggcaccgctctcagtgggctttgcccctccatatcaatcactacttacgaagggaggcattctccccacattgtagctcccccatctcagatgactctagcttgtgtcaagttaacaaaaacaacaactagggcagcaggcatgttaactctctctgcagccagaggtgttctccagaagccacagccctggctcatgtgtgcaatccttacatgagacacatccggttcacacctgcatacacatttgtgcgtccccactactccaccctctcctgcgcacagagaggctcttactgtgcaggcgggtatcatccctacagtttcctgtgcgcacacttgctccagagcgcagacttaacctcgccttggaccttcaaggcctctgaactcctgacctgttggcttctttgtgttgcagtcctcccacgagttggacgatagcagcagtgagtccagcagcctgcagctggagggccccaattccctcaaggccttggat

SEQ ID NO: 34925 - DNA, 1198 bp, Mus musculus
actccttgacaactcaaggatcttcagcctgtcagtcacttcagctggcaaccatcagcatggccacacttcgtgctttgacaccatctcaaaatggactgactgctctgactcagaccacagcctcaaatctgtcacctcctaccagctctccctttttcaatcattatctcatggagctctgctggcagaaacaaccacaggaagattccccggggccccattgactctctgctgccccctggagacatgttagagaaaagccacaaaggaaggcaaagaactaaggacttctggtcatgccctcccgttctcatttggctcctcagggacacttctctgagcttcatcctgaccctgaccctagcctgttgactataccttctgctcctggtaagaaactgaagcccttttggcggtgtgggaattgtcagcatctgctacctaattacagatttgtctgctgttggcacttcccttcatctgccacttctgcctggttggaggggaagtctgtcttcctctaagacccacacctgagtcctgctcccctgctcccctgcccccaccctgtgaggaggctcactctatctcctgctcccccgcccttgtgtcttctgattcatctacttccttcttgccagtcactgcccgctccctgcttcccccttggcctaggcttctcatcctactttctgcatctccacaccatgcctacaccctctacccatttgttggcacgagggaagctccaggcctctcagcaccgtggtcctagatagtccctagcattcctgactgggtcagcctctcccagaagtccatctctctttgcatttctgggtgcttcgttccaggtctctttgctcttgtaaaggttgtttttctggctttgattctggcttcctttcccctgtactgggtacagtctctgggttagggcagcctgctctgactagttgttgctcctgcctgctagaccagaatgccagggtgtactggcagctttgcctaaagccttgtgtgtgtactgtgcacattctctctgtccctccccctggattaccactctaccctctgcagaggtgcattgctgagggcagggcacctcttgtaactgtttctcacctgtagccaaaatttggtccttgcctttccgttgttgcctatattcttctgttagctggacattactttc

SEQ ID NO: 34926 - DNA, 1182 bp, Mus musculus
ccatttccggctggtttgctctgaaggtagggctggctggatgctgtgggggagtggggaggcacaacgaaggtgttgatgagtggattccccgtatttggcctctaactgctatcacacctctaggaaataggtaaggcaagggttgttcattttataatggctcatcctggttgtcaacttgacatgcctgtgaagagggaacttcaactaagggattgctcagtcctgtggccacgtctttgggggcattttgattgcttgattagtgtaggagggcctacccctaccccctgtggtgcagagagttgggcctgagctagctgagcaaatgcacagatggtgcaggtcaggtgggggggggggggatgggggaggtggggggtggtggcactaatcatccttcttgtggtctctgcttcacttctgcccccagtttcctgcttgagtttctgctttagtttcttccctcagtgatagtctgtaacctagatgccaaataaactcttttctccccaggtttcttttgatcatgatgtttctcccagtaacatgagaaactagggcagttcccatccttcagatggataaactgaagcccagactgaaccaacggcatctcgggagccaggaaggagcagaaattgttttctaggtcctggaatctggacatatatattcctttgcaaaatcatcctccctttggctcagatccaatcaaaagaaaagcacccagcatacccagcaagcatggaataatgaaactcaggtcttgctttgcataacggttgcttaataggtaagggtgaaagatacagatgtagttgaacaacacatctgactgcttcagggtaggtgaagcccaagcaggctttcccctttgcatagccctaggcagtgaagtccctagaaagcctctgtgtttgttgagtctagaaaggagcgctgaggtgaagccaggtcctacctctacagtgccactgaagcaaatgtcctgtaaccagggatgtgagacctggcccctcttatcaaagcgatccagggatctgatagtagtgaaacctcagggcattccttagagcagcctagccttttcctcagccaatccaagagcaaacagttctgttgaatgagtcatgtgtagcttcaggccccagaggtgaagtttccctgatcaagtca

SEQ ID NO: 34927 - DNA, 1196 bp, Mus musculus
ctttactgatcaggaaactatgatgtggaggatagtgttagcttacccaggattaagaaaataaatttcctatctggagtatgggctacagtattaagttccacacctcctgattgcccttccggctgcccctttggaaaggagtccagtggaatgaagggatagtttgacaatttccccttcaggtcctcccagctcaggctccggtcatcagcatgagaaccaggtctgagcagaagacccaccctcatctctggcccttctctatcaatccttctctgggcactcaggtttgtttatccccctagggatctgctgtggagcccagcatgatggcatttctaagggaaaggcaggaaaggcagggagcagaaagatacccgcctagtttgtgtagcaccctgtgtcaccctcagggaagaacccagaatccagaatggaccccacaagaatgttcttcacttgtctgcccaacctcttcctcttgcctagtccttttgtcatcttcaagcaggcaccccattctgttctcccaccacctccgctctccctccttatcctcaccaacaagaatccaagaacactccagtgccttagccactctgtaaagttcccaagtctagccataccgttactgacaacttcatggagcctcagctaggttaccatatgttaccaagaaaatggggtcccctctcaggattcctagtttcaattataaaagaattttggaacagactcagaaggaagctctgggacaatcctataagcacttgaaagaaaacaccaggtcaggcaggctgcctgggaaaggcaaagatgccccaatcctgagtatgacaagccttgccacacccccacacagatctcctttctccacaatctttcttcttaatgtcccattccatcagaactttcaggcctcgtacaagccagaagccctggtgtctgcttgtgtcttgtttcccatctgtcctaggactaactccacactgctgcagaagaccgagcattcctccgcactggggtgggagtgctctgtgtaacccagacagagtgctgactcagtctcgggcatggtggtggcattacacaagggccacagctgcctgggaagccacactcttgctctccctgaacccccagaggctgtatgtaggggtaggcaggccgagtgctcaagggccctgccttgc

SEQ ID NO: 34928 - DNA, 1099 bp, Mus musculus
ccacacacgcttcttaccaagaaaggatgaagccaatgttcccactctatcctaaaataggctgccaagcacacccaagaatgtgtcctgtgaccccacactagaagaccttgacactcagtatgatcgcatcacgaagcctgatctatacccaagggtgggaaccgcatcactgtggtctctacccatcatggagaccctctcactcactcactcgcccactcactcacagtgtgaccttgggaagccactgaactgatctagtctctctcccataaaatggactaatggttgcatctcccccgagagcttggcagaagggttaaaattaatatgtactgaatgctattgattatataaagttattatatgtgaaggacatgtaactgtggctgatacttgctggacacaatgtaaagatttattagataagttagtcatggcttggatgtacacaagatgaagctagaggctcagggtcctatatagcaggggctttaagtccgatgctctgactcccagtagatcctctctctgacttagggcctggctagtggaggagaggatacagtgatgtcatctcctgcccatcagtagatctgacctcagtttcttcagtggcaatggaaggtatgtaagaaaaccagccttacttgacgtgttataaaacagtaactaagttaactgagctcctaccatgtcatgtgtcaggcaggccctctgctaagtgctttactgtcacaggatcacttcatgaaacccttacaagtttagaggtgggtattctgttctatagaggatcagggaggtgaaaagaaaaacaaaaatcctgtccaacatcacaaagctaataagggatgagctagaatctgaattaaggtctgcctaaacctacaaccaaagatgatgatgtccttgaagccattgtacttaggggtgggtcaataaagagggtgctggcctgagctctacctacccactccaggtttagccaccaaacagccttccgctagatatcagcttggcccaggaactgagtgatggcaaagacagaaaagtgactgttgggatgaggggaccctggaaggaggtagcaggg

SEQ ID NO: 34929 - DNA, 2252 bp, Mus musculus
cacagccttacttttccaatggacttaattcccatcatcctgcagcctcatttctccagtgacacgatacacgaaccatcctgcggccttatttcccacggacacgacacaaagatgtccctcctcggtgttcctccagagtcgtctggtggccttgtgatacggcgtgaaccttcttccttctgccttacgtctaatggacacacacgcaccacccccacacccttgctcctccaaagccatgcagactgtgtaactgctattattctccaaggggcatcctgtgcagatgaaaccctgctttatttccctgaagacagctgcacagtgacctcttagttcttgctcccatggccctgatgtatcctagttaccagccctcaacctcagttctgagggtgggatcccatcgctcagcaaggcttcatcctgacctccctgccctgatctgatctggccctggcttttgttgtctcgctccctgactaagtgagatggggcactctcccgcccccgccccccccaggtcacagatacctacctgcagctgtgcgtgctggatcacgcacatacttgccttgcatggtctcctggctgccctgggctgtgcctgttcttccataggaagcaagttcttgtctccctggttctcagggcccctcaggggctcagccttcagccctgtgcttccccatgttgggaatctttgttacctttttcttctttgtaaattaacatctgataacaaccacagggtccaatgggactttcacagacctgccagctagataaataatgacaacagaagtttattaatattttaagacttaggccttttgctgggcagcctcccaactattctatcctgactaatcctggcactatgtcccaccacatggccaggtctacctctctgctccactctccatccacctccatgtctgccagcaaatctcccgtgattcagttcttctcccagagtccctatctctgcccagaagtaccatcttcgacttcctgcccaactattggccgtcagctcttcattaaagccgatcagatgtaattctagattgccttaggcaggtgaggaagaaacaagtatttgtaaaatatgagaccagcaatgggccatagaaataacagcaccagatcctgccagcatttagccctctgttggtacaaaattaacaattgaatatacagagacctacttccagagtgtaccccaacaacaggcgtgagcatggtgctgggtactagggtcctgctggaaaatcagagaccttacctacagctgggacatgaccttgcttccgacttacccaccacttctggatacctcaccctcagcccacactatccctggcctagggcccagggtagagccagaaacatggagaaagcatggccccttgccgtacctggagaactgggtattttccagagtctttatagatgtggactggaaggcaggtggccacagccgtgcagacctgggtcaggtcagaaacctatgccatgctgggacctactcaacagcagaagcatgaagagggcctgaggacaagaaaggccttcttaccatggtgctattctggagctgggatatatacctggcttgtctctgactgccctggcttctggcagaacttctgatgtcctcctgaaggcctctctcccaccccagtacctgagaacctgaggataatttaaacatgggactctggccagcacctgggagagacaggtagatctctgatttttgactcagcctggtctatcgagtgagttccaggacatctggggctacacagagaaaccatcttaaagactaaaaataataaacatgagactgtaaactgggtgtattttgggagaaataaatgtctttttctttcaatagcctctggcctgtgatgcctgtgaaacagtggggtggcctggtgctagaaggaaggaatctgtcctgggcacttcctcctggggaagggttacctagctctccatagcccagtgtcctccttaggttcctggctgcatttctgtcttaggaaagtaaagttggttgaccaaaatcaggttcctttgccagtgactcctctcactgatgtgcatgtcacttgatttctttttttttttttttaatttattggttattttatgtatttacatttcatatgttatctcctttcctggtttcccctctggaacctccctcttctatcatccccccccctcccccggcttca

SEQ ID NO: 34930 - DNA, 1197 bp, Mus musculus
gggggggggagccaggatgtacagctctatacatcttagatatggctatttctcttttctattcatttattgcaaaaaggattgcacatccattgtaaaacaaacaaaaacaaacaaccccctcccccaaaacccagattgtatcaagtagaagacaaatgtggacttgtcctttactcccacattctagggatgggttcacaatcaagcttctagatcctttgttcatggaaaccatctgtctgttcatgcatatgtccatccactcatccaaccacttagcaggaagcaccgaggtccctacggggcaagtcttcttcgctaggattaaggatgtaagagttaatggaagcactcgtagttgctactcagggaggctctgaggtgtcaggtaaggcacactgaacagcaagtggcagactttgttctttctgaccttactgttcaggagaaagcggttttaccatgccttctcagcatgagcgactataatggtaaaaaccatcccttctgagataggaaggaggatcttgtgctgtagaagctggaagcagctcactgcattgaggggcaagtgcaaggaaggagaggaggggaagtgggcagagtcaggtcagatcgggcttccttggagctgagctgttattcaaatggatgagcaggtctgtggtcccccctggaagggtgtgattggatgcagtgcatgctttatgagtgtgtgtctgtgtgtgtgagtgtgtatctatgtatgtgagtgtgttcatacaggggcaagcttgtctatggctctgtgtgtgtgtgtgtgtgtgtgtgtaaatagaagccagaagtcaaacaccctgcttttctgtaggacagtggttctcaaccctcccaatgctgcgagcctttaatacagtttctcatgttgtggtgaccctcgaccataaaatgattttcattgctacttcgttactgcaatgtgccactgttaggagtcataatgtagatatctgatgtgtgaccccccccatgaggtcgtgacccacgggttgagaaccgctggtgtgggtgctggggctctaagctcagatcctgtttgatatgctttgataaagtggcagtcactttatccaccaccgagccatctccccagcccctgcatcagttcctttagattgctgataactgacgacttgattgctaacagcccagacc

SEQ ID NO: 34931 - DNA, 1177 bp, Mus musculus
gagggcctcttctcgcgagccttgccgccggtgctcctggcccgcccacggccgccagcggaggtctcgcgaggcttggacgctgcggcggtaggaggaggacagggaaggacggagctcggccgcggctgcctccctcgttcactccctcgcgcgcgcgctcgcccgccccctccctccctcccctccctttccccggccccggccccggcccattcgctgcgcgctctccggctagggaggatgtcgggctcgtcgctccccggcgccctggccctctcgctcttgctggtctctggctcgctccttccagggccaggcgctgctcagaacggtaagccgaggggccgggggcgggtcgggcgggggcgcccggctctggcaaccagaggggccgggcccaggcctgagggggatgccggagccggcagcgggcgacccggctgaggcgaggaggtgcttcgcggagaggtggaggcgtcgctttggtgcgagcccggggctctgtagacaggtccgcggcgtagggctcatcgcgcaccgggagctggagtagcgggggcggctctggagaaagcggcgggagacaggcgttcgagttcgagctggcggaggggtggtgtcggcgagagaaccgggctccgcgggcgctgacacccgggattctactggggccctggaacccgggtgacattctgcaaaatgggaggaggggggaagctggggtcaaaaggatcccgtagaatacctagaggcagcagactgcttgagtctctcaaggagaggggttagtgagcgattcgggaaaccttggatttgggggtagagggaaggtgggtggaaagatggagtgggttgactgcagtagggggacctggagaagagaagcagcagtgtctccaaacgagctgggggaagaggattgggttttgccaaggagggtggagtgctgggcattctagggtagcggttgggaaagcaaaagggagtttctaaataaggagaggaaaatgagcagaggatgcggggaaagctttaaaaccgaggtagaagaaatatcagggaagtaaagggtgcctgggtatagtggtgggagtgggggaagacggaaaaataagggaagagagtaaaatgcaggaagtcgggggtgtaatgttgctttgtagcgcggcggata

SEQ ID NO: 34932 - DNA, 1199 bp, Mus musculus
acaggaatgttgccggacatggtggcgcatgcctttaatcccaccacttgggaggcagaggcaggcggatttctgaggccagcctggtctatagagtgagttccaggacagctagggctacacagagaaaccctgtctcgaaaaaacaaaaaaaaacaaaacaaaccaggaatgtttgggcattgagatttcactatattttctattttctaatgggtttttaatggtttctttttgatatttttctaacatcttttaattctcacagggtcataatgttcatatttctcagaaacagctcagctagtcttcgaggcctaggcacaaagaacattaattcctgatggaactaagaatatcaaggcagagctgggcaggggtggcgtttaatggtttctttttgatatttttctaacatgtttttataatcttttaattttcacagggtcataatgttcatatttctcagaaacagctcagctagtcttcgaggcctaggcacaaagaacaattcctgatggaactaagaatatcaaggcagagctgggcaggggtggcgcacgcctttgatcccagtacctgggaggcagaggcaggcggatttctgagtctaaagagtgagttccaagagagccagggctacacagagaaaccctgtctcaaaaaacaaaacaaaacaaaacaaaaaagaatatcaaggtagaaagaattccagataggtcgctagaagtaaatattgattatgagctatgaggtactaatatgagctttgggctggtcaattttagagttttcctgtaacgttattctatactgtgcctgtgaactgtctgccatgtagcacatagtttgttgtggcaggtagatagaaaaattcaattatgggatgggggtgatattagggagcaatccagttttacagctgtaagaagaaaagagcgaattcttaaatttgcattagagtggtgcttgtgcaaataatcagagctaagagttctttagcatttgtatttcagtagcaaatacgtgtattttagcatttttcaaagcctagtggaagagtgtatggaatgtgttttagtggtagtgaggtgtcacttacccttctgtaacataatatctgtttgtcattgaaagagctcaagaattgtatcaagtcttaaactcttgaaataataccactggaaaacttgacaggc

SEQ ID NO: 34933 - DNA, 1061 bp, Mus musculus
caaataaaaatcggttggtcagccagccatgagtgccctttgcctatcactgtctagactagaggatgtgctccaagctcagtgcagaaggcctagggcaatggtggtggtggtgctactatctgtgctgtgctagggtccttccccagagttgatggttccatatcaccaagcagtaggactacagtgtattacctctctccacaacatatcacacttctcagtggacagcactaagtgaagttttgtcctcccttggaaagagaaatcctcaaaggcatagcatggcattagactctgacaggacatatttgagagcaacacccacttttctttcttttcctttcttctcagcagctcttaaatctcttgcctggagtcagtagagtcttagagtgagtactgacacgggggaggcgggctcctgacattgatctctgcgggaagacttggtgggctcccttccgatgtacttttcatcagtgaactggatgggaagatgggggacgtgagctggaagcagagaggcctttgtccagctccttgcaacaaacgatgtccccagttttgctttctcatactacgaagtaaaagtttgttcttggggttctcatgtgttcctgatgcctttccttcacacttttcttttttcctgttaaatgttcccaaggtagaacacttagacatactcagacctgagattaaagggagaagaggagagtgttgccttcattctgtatggttacaacttggatatttgggaacagttacatttctggaccattatcccctcagaataaacctttaaacagtttaaaccttgccagttaggagcctagagacttagatttgggtcagtgttagagcacaagaccttgagtttgttcctggaaagggaaaaaaaaataccccaaagaccagagagagaaagagagagactgagaaagataaaatgctagctgtgccaaatactatgttcaacttttataagccaaggagccaaaaagtcagctaagaaaagacagatgggtttcaaagcctgatttttaagacagagatgg

SEQ ID NO: 34934 - DNA, 1835 bp, Mus musculus
acatatttactatactaggttcatttcatattaaattccttgtattgcagtctacttacatattttttagaaggagttaaaaaaaatagttaacttcttaggcagattatacccaaaagcctgttagtactttgtgtgatctctgctgaaggcaagatagaaatgtggccataagggaacagggccagaatgcttagaggcacatggagatcagagtttcataccacatccctgagcatgctgtttgaaccaaagctgtgtctgatgtggcactgacatagttgtgatggagtgacagtgtatattcttttaatttccagatatccttctctttacagctctttaggttcctgaaaaacgatggcaacatgacctgctaagttttctgcttggacctctttggtctctctccctttcaagtgagcaacaccacaatgaccgtctaaagcatgccttatttagcctctcctataagggtgacctagccaggtacattttaaacaatgcttcagtgtagaaggtgtaaactattttgggcttgatgtgctgtgaatgttgctttccctccctttgttaaaaatatttaaatagaaatgaaaaggtcctctgaggatcagatcatgcatgcgccattttttacttatgcagctgttaaattggcaaagctctaaacgcactgctgccatctagtgatcattttgtaaagtacagcaaaacctacagatatatacagtatataaatatatatatatatttatatttttgggggtgggagaaatccaaaataaagtcaacgcttgtttcattttaagctgctgatactcattccttattatttgtcgtcagatgaggaagctgcagttctggtacaaactgatgagagtgtatagacttaagtctggcattctaagggcttaccgtataactttaggaacctggaacagtccactgaacggctagaatgaattgcagtatatatgtatgattgattgctttttaagtgactatttttcctcttgtcaaatcatgtaaattctgaaatcttttgcactgatgtgtcaaaccttattcttgtatattcaatcaaggcaacttttataatttcccatttgttttcaatgaccctgaaatgttaatagcatggtgatattctatgcaactctagttacaccttttggtttgacactgtattttcacattgatttcatgactgatgatagattttataacctgactgggttctcatgcggtactaactgtagatgcatgtacttgtgttctgtgtaattattgaagtgcaatggtgtacaaaaaaagtggattcacctgtttttaacaataaaacattgataaaaggtgcttggaataatactctttattcaaataccttcagttccttagttgcatacatgtgcagggctttagtttctcaaccctgtaatctttttaagttccttttccacctcttccacaaatgctgggaagttttgatccatgagacataagcgtagaaaaggtcccaattcttctgttccccatgaagagccttcataggcgagggtcagcttctctggcgccaggatagactgcaggggtgccaaaagaccagaggggttgactgcctgatcccagataatttaacacagaaaacattgccttaaaatttagaacaacataaaatgttactgtctttagaaaaatccttttctatacttaggtttcacgtttacaattctgtgcctacaatttctttccttcctctatcccactcttgagtgctatattcttcccctccttccttctcccttcctcattctgtcactgccctgaacccc

SEQ ID NO: 34935 - DNA, 1185 bp, Mus musculus
gatctcaacttcagatacatcaatgtttccttaaagatccaagtttatctcactttctatgtatgtccagaaaatgtagagctgggcccagtgagtagtatctgtctataatccagacatttgggatgcagaaacaggaccgtggatttgagattaacctgtgtttttggtttgggtgtttttggttttttttaattggggttcagggcagtgacagaatgaggaagggagaaggaaggaggggaagaatatagcactcaagagtgggatagaggaaggaaagaaattgtaggcacagaattgtaaacgtgaaacctaagtatagaaaaggatttttctaaagacagtaacattttatgttgttctaaattttaaggcaatgttttctgtgttaaattatctgggatcaggcagtcaacccctctggtcttttggcacccctgcagtctatcctggcgccagagaagctgaccctcgcctatgaaggctcttcatggggaacagaagaattgggaccttttctacgcttatgtctcatggatcaaaacttcccagcatttgtggaagaggtggaaaaggaacttaaaaagattacagggttgagaaactaaagccctgcacatgtatgcaactaaggaactgaaggtatttgaataaagagtattattccaagcaccttttatcaatgttttattgttaaaaacaggtgaatccactttttttgtacaccattgcacttcaataattacacagaacacaagtacatgcatctacagttagtaccgcatgagaacccagtcaggttataaaatctatcatcagtcatgaaatcaatgtgaaaatacagtgtcaaaccaaaaggtgtaactagagttgcatagaatatcaccatgctattaacatttcagggtcattgaaaacaaatgggaaattataaaagttgccttgattgaatatacaagaataaggtttgacacatcagtgcaaaagatttcagaatttacatgatttgacaagaggaaaaatagtcacttaaaaagcaatcaatcatacatatatactgcaattcattctagccgttcagtggactgttccaggttcctaaagttatacggtaagcccttagaatgccagacttaagtctatacactctcatcagtttgtaccagaactgcagcttcctca

SEQ ID NO: 34936 - DNA, 1107 bp, Mus musculus
aataccacccccaacactaaacagcagctgagggtggccacacttctgagtcttgtgggctcttggacaaggtggttcagcttagcagtagagggaagctttgggtacacactaagactttattcttgctgctactgcttctggacatctgtgaccacaagagaggtcctaagaactaccacccttcttcctgtctcctcctcccactcccgagctcctgcctggccctctcctatagtggtgtggcttgtctcaagagctcttgggttgagaaacacctggtgaggccacaattaacaaaattacaaggctaggggaaagtaaaacctaaaacacaagccaagaaatgactcaggaactttaattattcctatctgcaaagaagggaacaactaggtaaatgctgcaccttagtgctgcacgatggcctgagcttggccatgcctcaacttttaaggtagactaagaaagcaggcgtcagctttatggctcagaagtcatgggttgacttgagacatgtctgctctaaggcaggcttgctatatggaaactgtgcttgtactcaatggcttgacctgctaccctgccaattcagtaagtctttagttccttctgtgctctggagggtctgatttgatcactggcagaagggcagagctgagaagatggctgtgctggctgcagtggttgtgacaacagtgtggtttctgtttgttttccaggctcagtgttcttccccagtacttctcgttcaccacttcacagtggaggctcatggcttgcacgagatcacacagctaccataaaaacaggctaggactctaacctagatctgttcaaataccagagcttgtgacctttgcataatatcaggctgctcacctatccagaacacaagttacagatgagaagagtccctgaaaacagacttagtccttttaaggtgtttctatctagacagtctggcaccagcctttagagtcagcataccagagcctttgtcttctgttgttgctccaggcccagtctgcatgtgttcccacatagtccaactgtacttgccttatctgttaataggcacataggcaggcaacagagactgaaccg

SEQ ID NO: 34937 - DNA, 2346 bp, Mus musculus
agtcatcaacagtgaggttgtttgacaccactgacaggcattggcttgttgtgggtttcatttttattcttaattctgagacattgcatcctctgccagctgttaatccatcactttgaggggaggacatgttgcattgctgtttgtaagcttttttattatttttttattataattattaaaggcctgactttctcctctcatcactgtgagattacagatctatttgaatgaaatgtaacattgaaaagacttgtttgttgctttctgtgcagattcagtattggggtgggattggggattgggaataggaaatggaggggctgctgaggccctgtgaatgtttctgtcaatgtactttgttccagaagcctgccgagaatgaaagcagcatctttagtgtcctttcctggcatttccatcttcgtgtcactgcatagcaactggagttttgtttggatctggttataaattcttgtacagtggatgactttggtgatttagctgccctggtatcttggtcatttcctctttggagtgtccacactgaggtctctatcaatgtatgtttaattgcttgagagatgccaagtagaaccagagcctgactgtgctctgagaagctacaaagcacagggtggagactccctttgtgttgctagtattggttctctctggaaggttaaaatctaaggcaggatcttggtttcctattccaaataggatgcctgcttctctgggcaccagtcctcagccaggcagctctcgtggcattgcagaggctctcctgaaaaacatcaaccagggtgagagccaagatggggtggcacccatgacgcttccccacatgtttcttcaaggagcagaggacagagatagtggaaagagggtcagcagaagcaggtgccttcatctatcccagcagctcagccaaaccccagttagaatgaggcagcaggagattccaggtgtgctgagggttcagccacacgcagaagacgttgcagagtgttaaagaggtaagctgaggtgtgtatttggttggctttgttgttgttgttaatgtataatgaaaagtataagactaaccctcaggcctcatgttctccaatagatccctggaagacagtatagaaagtcagtcgggcttgggctccttagccagtgagactactcagaccaccagtggctagcctagcctacctgtccttgaacatgggtgattttacccctttgaggtcttaaccctttttttactttcaacaagatgagctctttgtatgattgcgggcgggggatatgaaaatgcaatgatctaactcctgttgctcttctagctggtcacatgacggcaccaggcagggttctgggacacccggtgtgctttgactgttctacaaaaagctgtcagagcgttctggcctcctggaggctagattcctcagaaactgtctagcctttgcccacagagcatgctatgtaattagagcactccttcccatgaaccccagcacttgtgttacctcagggccttggtacctggatactgccacagaatttccatggggcgggaagggatgtatttttaaataaagtaacttaaaagttggggaaattttttaaattcagaaaatgcaaagctattctgtattacaccatttcacaatttaatatgtcttatattttcctgtgactctggaaactaaaccattgtgtgtcttgtcgtgtcctagttgagctggggcctagcagcttccttccagtgggtgtggagcaaacgtgtatgtcgcctcgctacctgcttgaggggtccgaagggctgctgggactgagttctgtacacacttgtttggccttttctgtagttgatgctgtaaaactctatggctttttaaaaacaatttcatgtttttattttgtattggaagtccaatacacttttttaatccaatcaaactggtctggtcaaaaagttctttcccttaaaagttcaggggctcctacttccagcttccgatgacttctctgtggctctcactgctataaagcaggatttagaatggcaatctgggcagaggtaataaaagaaatgtctgactgccagccccaaagatgtgtcttcttcctgtccatatcccactgttacctctaggggaaggaaggagggggtggggaagcccaaggagtggcaaatggcgcctagcacagaaccaccctgagttgcacagcatcgtgctgaggtggctctcctatgctggagaggctgagctccactgttaagatctttcggtttcccatgcctagaatagtgatgacctctgcagccacaggcccccttccatctct

SEQ ID NO: 34938 - DNA, 1170 bp, Mus musculus
gtaaaaccatggaggtcaaacactggcggagggacggattaagagacaacagcgtggctcgttgtcaatgggagaccgactactctaatcgcgaggtttgctgcttcttcgttatctgcatgtcttatcttactagggaagtaaaagtattctctcgcccccaccccggacacacacacactctatctcaggctatcagtgaatatcgggaagacgtgtacggattgggaaccacactactgcctttgttcatccaaggacagaatcgcacaacagcgtcgcccagcgccagcgccaagacttaaacagagcgaacccccaacgccagccctgtcgtcgtcccgcctccagcccacccatagctccacccataactggggctgcagttccgtcgtagctccgcccatcgggaggaagagcctgtggcgcgcgggtgtgacgttacgcacgtctacgtcagcacgcgcccagctgggaggaggcgcgagccgagaaaggatcctgtagccaccggtgcggcggtgtgtgcacatggcgctgtggcgcggctctgcgtgcgccggcttcctggcgctggccgtgggctgcgtgttcctgctggagccggagctgccgggcacggcgctgcgctcgctctggagctccctgaggctgggacccgcgccagtgcccgtgggacctctgtccccggagagccggctggcagccgcttgggacgccctcatcgcgcagcccgcccggcgctggcgccgcgtggctgtggggtgagtgcctgcggggcctgcctgcggctctgggcctccccgggaagtgcgcgcgctccggggtccgcccgggactcggtggtgtctgggttgccctctgggcgaaagtgtcggacgcgtgagacgagcctttttccgtcatcgctgcagggatagtcagcatatttccacccggttggccctgctccctgtaaaagcagctctcatagcttcttagaaattcaactcagcctgtcacttgtaatttttgaggttactctgttgtctgtcttccagcccttttttgccgactgttctcaggtggccacgatggttttcctatttttttagcactcttcctaacgtacttaaagctaaatgcttctgtctctagctgttgactttacgtcatccggtctgaagacca

SEQ ID NO: 34939 - DNA, 1147 bp, Mus musculus
ctctggtagagagaaatttgtaggactccggtaaaagggcgggaagaagcaaaccattggcagtggtactggagggtaggcaggcagggcagttaagggaagcaggccctccatgtgaggaggagcaactttatgaagcaggtggttccacgtattaccagcaccacagatgttaagtgtctcagaaatattggttccctgtggtcacacagccatggtgttggaagtacaacgtaagactggtctttcccacttctgcattcacgttcagcccccagaattaccatagtttagggacagagagcagatggtaaaggcagttactctagctagacttgagtggatggaactacatgttcttgtgggatttcagatgaaatggcttccgagaatgaggctggagttaggatcaggctagatgtttttgagatgtcagtgcttcagtggaccacaccttggctttctaggagtgtaactcctccctgcttctgaattggagcctggtacctattgcttcttataggataaaatgaagccctcacattcacaacgattctgtttgccctgagcattgttctcttcctccgagttctccactctagatcaccattcatgttgtgtcctaagacaaggttctttcacccacggttttgctttctgtgccccatgcccagaatttagtatcagatgaatctacctttgaattaagctgctccagtcaggcttttggaacgttagtctgtactgtagcttttctcagctggagccatgatgactagttactaattactgatctcaattagttttctgactttgtgttccttatctgaagatgtcttcccaacttcagtgcctcagaaagaggcaccatccagggcatagcttccccagcccttgagtctcttccgccggacatcttgtaattacgattagttcttgtcatatgtgaggaagagaaagtgctaatgctagaaggaaccttagggaacattttgcaggggatgcaatggggtaagtgatgagaaagtgttctcttctttgaggtgcttcaggttaggaggaagaactctgcttccatccaagtctgcagtagaccagtaagctaggggcttccagtgctttttctgaccccgcaggaagatgcttg

SEQ ID NO: 34940 - DNA, 1272 bp, Mus musculus
cacgttgtgtgaggaatgaaagtcacccatcttaagaattccagcaagaacatagcttgggaactaggcttgtgagtgtcagaacagttcctagatcaaattggaatagagccaaagaaatcacagcagattaaactgtacagatacattccagcctgttggcaacataaaaacacttcaggtataattgaaactcagctgtctactaatgagactggatttttgttttttatgttgtgctacaaaggttaaaacctctttctgaatccccagttgatgtaccatgactctggagagctcatccagccacagaaagtactcccccccccccccccaagcctggtcactcatgaaacctggccaaggcagtcatgacagcttatgctcctggcagaatcaacttgtccattcagtgttacagtgacaatatttgctgtgtgtaccttctcagcctcctgctctcagacataggtcagagccacaggagagaacaaaacagtcttgtgctttatggtctcagactggaaacccctgggagagctatgagccacctgaccattctgcacttgcttggaagcaccatgccttcctgccccggcgtcatggactggggctggctgagaaaaggccccacagcttgttctcagcctcagcgctgagctccggcagtgctttctgcagcacaagactgctactcgttccttttgagccttgaagagatgtgttttataactggaaagtgcttctatatagaacacatcatgtattttgtgtttttgttttgacacatccattaaagagtttgacctcttaaaagccccaggatcatgaataaatgcgtcatgtatatttattttttaataaatcaagatttctgtgtgcttttaaaaatattaaaataatttacatttccaggatcctaagtctaattgattttgttctcaacccctctcccacttgcatgtcacttggctgctgagacatctgttctttggtccctgccattgggctaggcattccctcgagctaggctgtcaagcttaaggtctaccttgaagttagagcacagccatttcaaagagccaaaatctttctagtccaaagtacaagatgtctgcccaggacaagggccaggcacaccagccttggcagctgctcttggaatggcagatccctgatttgggtaagaaggaaagtcttacactttcaaagaaaactgatgcctatagagttacgcgtcttgaaagtgaaagcaaaactcattattatgga

SEQ ID NO: 34941 - DNA, 1908 bp, Mus musculus
acttttccttttagaaaggttgttacatgagatgtacttgcaactgttcttttcccatcagaaatcagtgaatgtttgctgagtatattatgctgcttcctcaaaccacttgtcgctttaggatcaacttgtatctttttcttccctttccttgtcacctcaggtggcaaatctgaagtcaagtgtctgcttttccattttctctatcccctatcattctcccattatccatttgactttattttaaataattgcatcaatcttaagacctttatcaacaccaaggagatttcaaagaaagctcaagtaagttccttttcctggtgactttgaaaagcgaccagaattgtcacatagatatatgtggtcccttaaaatgctttgtgtatgtggtgtttaaaaagagttgacttcacagtatctaggtctgagtgtcataagttctcttcatgctctgccctgcaacaagcgtccaaaaaagagtgtgcatctcatagtctcagtccccaccacggagggatagtgtagttggtgacactttctagtcccacatgggacctgaggatattgcactcacaatttgtgtggatcaaggggaactggctcttctgctacatccaagtttttaacaaccgtctccatatctgacagcatttccagaatttacctgcctttgtcagtagctagcttcagtgctcccagctgggacaggcaagccatattgttaacagcttccctatttgacctacccaagtctctcagagggctctacttaaacatcagggtctccctgtgttgttgagatcagttacattgtcagtgcatgcttcatttgagcaattcattgagcaacaggtgaattttcaatgatttacaataaaattttgatccaaagctcaggagacataccatagtggtaaatggagtagcatataacattaccagactctaaattctttgtaatttgctgcaacccagattgtatatgttttatgtgtgttcaaataaatatattaaagacacacgtgtatacatacacacaaatagatccaagactgacttgatttgaaatggttgaatctgcagtgtaatgtgtggttcacctgttaagtaggacttgaaatttagaacaagaagagtaaaaggcttaaatgtaacaaattcttttagctatgtccggtatagagcacttgggggatgggatggggtgggttggtgagacaatcagatcgataaattgattaaatgctcctaaccctgtaattttgtgcatagagcaccttgtgctgtggaaataactgttcttagattttcattgtaactggactgttcaggttgcccagagggaaagaacattcctaattctaataaaataaacttttattttgttattccattagttacttatgtttatttttatagttgaaaaccgataacttaggtgggtaactgccacctgtataatgtgccttattcactgttcctatttaatataaactgtcaagatttggttcaagttctatgtaaggaactgtgaatgagaccattcccaacatttagtttggctaattgaaacttttcagaagtatttctgaaagctttctggtttctgcctcttgaacattgactttaaattgttgtttgtgttttagtagtgatacacacttagatgttctgtacatcttggaatgtcagttttttatagatgagatatttaaaacattctagcctcaaaaggaatcagctttcacataaaagctgatagtccctatttatggatagtaacgtggtactatcaaaccagacctgacttttatcacatctatactctagtttgtcactttcttttttaaaaaaaaaaaaaagtggagtaaagattgctgtttgacggaatagggaaataagatt

SEQ ID NO: 34942 - DNA, 1281 bp, Mus musculus
gtatgccactgccacaaccaccacctggccccaggtattatagtagtaaggaaactgggacgttggaaggcctagagatttaatcccagtgtcttcacttcctttggctaactgtaatttttacattgtattaaaatgcttgtacagttaaccaacactttattttatagatgggaataaatgacctataaaattaactgaataatttttacaactatgggtttgaatcattgttttaaaggcacattagaatttctaacacttgaagactctaaaatttatttctggcactgggaatctgactctaagaacaaaaatcttggaaggaaggatagatcattggtaggctgtctaccatgtacatggtcctgggtttggttttcatccagcagccaaagaatgcaaaaaaagagtccttagaacatgtagtagaggcatcttgataaacctgtgcatctacgtctgaaaatgtttatagcaattattagcaggtgctttcttcaaaccctggacaaactctaggaatggtcctttgtaaaaatcaatacctctttccctttcagagtctgacaagttttttttctctctttgattacagatactgtgagagtcgacgaagggttttgttacagcatgtgcatgaaggctatgaaaaagatctgtgggagtacattgaggactgagactggccctgcataaaatgaactctgaaaactttaccatctagagtgctcatgcaattaaaacaaacacaaacaaggaggcactaagcctgttctgacaccgctggtctgtagtaccagaattctgttttgttaacggaaagtttaagtaaattatattgtaataaaaaaggtagataaaccattgtacaacagtattctaggccgccaacaaagtgtgacagacacacaaaagccctccaactttaacttgtaacgtagcttcattctcaacgctgacttcctttttctttttcctgagtgtagtacagttaaaatttcaatagctccttgacactgcttttcatgtccaaaccagccattttgttgtactttggtaaaggacctcttccccttcctcccctgcacatacacacctccacacacagttggattcactttctctcataccctcaggtcatgagtgaataatgattattagctacttgtaaaggaaattctttggagggagaaggggataggcagcaagaggattaaaaaacaaaaaacacaaaaactttgtatatgacttttaaaacaagaggacaacacagtattt

SEQ ID NO: 34943 - DNA, 1190 bp, Mus musculus
aaaactattacattttttagtctattaatacccagtaataaccaggtggtgatagtgcacacctttaatcccagcacaagggagccagagccaggtggatctttgtaagttcaaggccagcctgtctacagattgagtagaactgttaacacagagaaatcttgtcttgaaaaacacaaacaagccgggtgtggtggcgcacgcctttaatcccagcactcgggaggcagaggcaggtggatttctgagttcgaggccagcctggtctacaaagtgagttccaggacagccagggtatacagagaaaccctgtcttgaaaaaccaaaaaataccaaaaagaaaaagaaaaaggaaaaaaagaaaaacacaaattaaaaaaaaaaaaagcaaacaagactaacgaaagagccagtaataatatactttacatttaatgatctttaatagattcctactactttttaaaataacttatgtgtataaactcaaatcaatgaagtctagaactagcttctgtcctcaatggtatagcattgacaccaactctatagtttttttccataggaatgtcccaaatgccatgtcacaattgagaaggatggcggttgtaatcacatggtctgtcgtaaccagaactgtaaagcagaattttgctgggtgtgtcttggcccttgggaaccgcatggatctgcctggtaggttggacaaatgggagagtacattcatgtaattataggatgtctaccatgtacaaatggtatttctgcctttgataattgcctgacgagctaaaaaagattaatatgtcgtttcaacattatatgcaagataaccacagagaggtattttgtagtcctatttctcacaggaattaataattgagattaaacctatgcattgagatttcattagttgaaaaatttggaaacagtaaaaggaatactgtgaacggaggtgaagtagtgttttcagctcatgatttaaatttttagttacattgtctggtaagtcgtctagtagagtttaatggcagaaatttacttgtgtgttttccttatgcttcacatcattagacgacagttttgtcgtcttaactaaaaagtggaaagctactgaacaaagatctgtatttttagcttctctttgaagtaggcttgccttcctattgggaataattacctagaactgg

SEQ ID NO: 34944 - DNA, 1099 bp, Mus musculus
taattatttaaactcttggtgttcttttcagctttaactgtggtgaaaattggcatgatccagttaaatgtaaggtgaggttggtttttgtttttaaggggatgatatatttctaagattcaattaaagataatagctgttgatttgttctgactaacaaaagattttgttcttttcaagcgtcattgcaggtagtctataagtgcagtccttaggatcaggctcccatttgttcttagaacatccatgaataggttttaggttaatttgacttttcctcaaggttcccaattccccactcaactttaaccaggcaaaattattgtttggttactcatatataaatgagattttatagctacaaattttcctacgttgagactatatctattgaaaatcagttgctttttaagtcttatatttaaagcttgcctttaagtgctgaaataaatggctatccttaagcctagttatattctaacagttgttattttcaaatagtggttgaagaagtggattaaaaagtgtgatgatgacagtgaaacttctaattggattgcagctaacacaaaggttggtccatctgtgtgtctcccctgaccccacccacaccccaactgttgataatgaacacatggatatgggtaagtgtataagcattagcgaaagcagtgtgagttcatgttggtatgggccttgtggtaatttttatccatgccctcccacccacaatggatgcctgtttattccctttcaggtgtttatttggaccagctgtaaggcagtgtggctcctttagtgtaaaaacaatgagttctcctgtacaagttaaatttctaatcttgactgctttgctgcccaagtatgaggatctgagttcagatcttcaacacccatgtaaaagaggtgtggccatgtgcacctgtaacctttagtgctgaaattcagagatgggtggattccctcaaggtcagtggttaccagcctagctgaatttgaggaaccccaggttcagtgagtgtgtcttaagaggaacaagactgagcgatgaagcagggcacccagcatcatcttctagtctcttgtacattcctgtaca

SEQ ID NO: 34945 - DNA, 1202 bp, Mus musculus
aaaaaacaaaaatatctactggaaaaagcctgttgcatatttgttcttactgatttttgtgtctcagtggcagccactacagagaaccctatatataggttataaaacaaaattattttttttctcgggttttttttgaaagtgccagtgctcactatagtaacgtcagtatagcttggtgttttcagtcttgagaatagtctttgtctgtgttcgagattaaacaataaaagtgcaagttaatgtaccttttgatcagtgtactttaattgttgtctgtacattggaatctaggactctcacatctacatgttatgcaagtgacctcctaatgagttacatgcccatccagtaatttatttttgaagcctagtacagaatgttgcttaaggcatgtcttgttcatgtaataaacatacgtcatagtttgtgttttgcctggttggggtggaatacacctggaaatcccagcactaaagtggctaggtcgaagagaatcacaagtttgagggagctctggtctacctagtgagacaccttgtcttaaaacagagagacagagacataaaacaaaattaaatactgtttaagtgtctgtggggtttgtaggtagaatgaaagatatagttcttacattttatagaattaaaagttgaaagatgggctgggcatagtggcgcacgcctttaatcccagcactcgggaggcagagacaggcagatttctgagtttgaggccagcctggtctatagagtgagtttcaggacagccaggactacacagagaaaccctgtctcgaaaaagccaaaaaaaaaaaaaaagttggaagataagtaattttgtgagggtctgggaatgcagctttgtggtagaaggcttccccatcagataagagattggatccctaaaaccaaagtaaacaaataatgaaaccacaaacttaacaacactgtagagttggggatgttactcagttggtaaagcacttgcctaaggtgtggtccttgattttgttcccagaattcaactgaataaattgtaagaattgctttacattgaataaacttcaatgtcatctaccatatttctaacaaaataaaatagaaataccatctatctccccagatgctgataaagttaacactcatttctgactaaaagatgataattatgagaaaatattgcatataatatgtattata

SEQ ID NO: 34946 - DNA, 1192 bp, Mus musculus
aaatctttttttttttaaaggaggaccaaatcacctccagcataaagtgagctgaatagcataaaatttgtatgtaactttttcctctgaagatgatggcctactaagagaggttctaataaggcttggaatgttgagtgctacttgtgcaagctcctgagtctaatcaggaagttggcaggaagaagggggggtgtctattttcattctcaattacacatgctacgtcagtccttaagctgccattaagctacaacttagtttctaactacttaataacaaaatttcacagtatctataccaacttttcacaaattcattttaaaaccaatatccttgccataacatcaggtaatatagaattcaataattaaaatcactgagaaatggttcattggctaaaagtacttgctgctcttgcagaggatctgggtttagttcccagcatctatatggtgactcacacccaagtacagctctagttccagagaatccaatgctctcttacgatctccgtgggcttctgcacacacctggcacacatacaccaacacaggcatgcacatataaaggtaaatatatgtacatatgtaggtgtacatatgtatgcatattatctcattaggactggttgagctttagcactattctttctgaggtcaggctgggttttgtccctagcactcataatccagtcagtcctagaggatttgatactcttttctggcctttgaaggttcccaagctatgcagtttgcatatactcacagtctcatgtaagtatataaactaaaaaaaaaatttcaaaaaagattcatggcaaaggaacacatagcatatagccactatatatttttagggtgttttttaaaaactcaccaaatttgattcaattcataactgtttttggattattttagttaatacatgcatggaattttataactaataatactgtaatgtctaaatcttttttaaaaatttaatacattacaaaaaattgtgtatgtgtttggcttgaacaacctgaaggagtcagctcttttttccctgtgatcctagggaccaaacttaaatttgttaggctttggcagtaggtgctgccaaactaagtagtacctgctgaactatcttgctggactaaggtttaaatctttgtcttacttcggtcaccactagagttttttatttg

SEQ ID NO: 34947 - DNA, 1234 bp, Mus musculus
aagcaagaaagtggctcaagtgagccagctcctgcttcggaagttactcctaagggtgtcttggccccagagtcttcctgcctgggctgctcctaggaaaaatttaatttatgcagagactttcactagtaaaattatgggcagatggggctggagagatacgactcaacaattaagagaactggttgctcttccagaaatcctaggttcaattcctagcaccaacctggcagataataaatatctgtaatagtagccctttgggatctgataccttttggtgtgcagatacacatacacagataaaacatccatatacataaaacagataagccttaaaattatgtatgtatgcatgtgtgtgtatgtatgtatgtgtttgtgtatataagggaagaggccatgcatattgatagacatctgtaaacccaacacttaggaaaccacaagaggatctaaaatttaatgccagcctgaggcataagtgattcaggcttctgccttctgcctcccacccccctcccctgctccccccctcccaacaaaagcaaaagtgtttcccagacattgctgtaggttttttataccttaaagtagatactgaggagtttgacccctagggtagaatttgtatgaaagaagatgggggattgggggtggcacacacctttatcccagcatcaggcaaatcactgagttcaaggccagcctggtctagagtgagttccatgatacccagggctacacagtgaaatcctctctgaaaaaaacaaaacaaacaaagcaaaataaaaaacaaagaagaagttgaagctagtctttggagatcaccattgcatgatcatttttgctgctcagtcacttgcttctgtatccaggaaccccgagtgaaccctagatgacacctttgggaagactggaataggctgcctcctggcccagacacagccctcggggaatgtggaaatgggcagcaggcgctagagtggaggggctgtcagtgggtgctgacacgctgtctccttagccctgaggggctgggtggtttatgctggaaaatgtgtgtggggtaagatcgtacacatcggcattcattgccagtagcccagcctcagtctctgatggtagatatatctgtatttacttaattgtgactaaacaggttgttactgatgcttgtgagtacccagcactgcacgtgtggatgaacagtcatctactctatctagggcct

SEQ ID NO: 34948 - DNA, 1193 bp, Mus musculus
accccagcttcccgttccgctcagcctcagagggtgtactggggcgggcgccgggagggtggagagtctccgggcggggctggaggaatgtccgtggacctataaatctgggcaccgccctggtaggccagggcagatggggagacctgggcaaaaggccaaaaagggaacattttgtagccgatctaaagcaacaggtggcggtggcgcccgggaacctaggggtggtggtggcggcggcggcgctggcccggtgggcgggccttgctccctcaccacttccccattggtcaacaggataacccttgagcaaatttggtctacgatgtccttccgccacggaaggtagtcctcctcaaaagggcaacctgcttgtcccgcctaccctgagcttctctcaggaggtgcgggcgccccgttgagaggcggggcgccgccggccgcagcccggattgggcgaggggcggggctgcggagggattgcggcggcccgcagctgtgataaccttgaggcccagtcggcgcagccccgcacagcagcgactcgtcttcacttgactgacgtccgctctaggtatcgcagcaggaaccgaagtacgcccgaggtgagcggggagaacctaagccatctgtccccagagccgatgcccactggtgtgtaacgcaggcctgcctgcccacgcgggactcaggcgccaggcatcgagcatcccactccgggttggggaggagccacacttgagtccaagtcttaatcctccaaattgagggtggccggctagctcctttcccacggtctcattctgctctctcttccatctcaatctggttccagcctcttatcttactattgctatcctcgccaccctgttctcgccctgctccgatgctcgtcctcctacatccactacgacttacgaccttcctcttagctctgtgccctcataattcggtgccctcctcttaatctctacttgaaataattcccctactcaccccacccccaccccccattcagcctccgcgttcatcctcctttcaggtcagcgttctcttcccgcgccagtgttcgcagctcttcgtcgcccctcccccctccgatccggtcacgtccgcgccgcagcatcctttcaacctccatatcctcgcccctccccctcgcagcttttcccctccccccgcattctagtcac

SEQ ID NO: 34949 - DNA, 2064 bp, Mus musculus
gagaccatgctgagtgcctaccaaagccaatactggagattggacatcatgataggcttcccaagatgtttgtgtgctgacatactagttagaacatgcgctggggggtgtttcttactgtaactttggaggtttccttgtgtggggaaagtgatgttctttctagggttgatgagaaagctcttaagacaaggtgacagcccatgtgagaagcctgcttaaactggctcccagggtgtgtgcagtgggtagggagttactcttgttcaccaaggtctttgctgtttgccaatagtcacaagagccctttgcccaatttgagtagcacccacataaccagcacgtgccaggcttttatgctgcttgtgcacaaagcaatcttattgggttaatgtgtaagcaggagacagcttcctatgccaagtgcctcattaagcagtgcctaatctaattgcactcttcaaatctccgggacccaggacttcaggaaccatgccgaagccacacagtgaagcagggactgccttcattcagacccagcagctccatgcagccatggctgacaccttcctggaacacatgtgccgcctggacattgactctgcccccatcacggcccgcaacactggcatcatttgtaccattggtgagtgtggccctccttcctctaaatggaggcttctacctgatttgaaaggcatagtaaccattgcagagctagcctaggttctgagtgaggcacggtccacatttctaggggagtagaggtcttgggaattggccatcaagaagaattagtgtgctttttctgtagttggtgaggttcaggggtggtctttttcatgtgctgtcaccaacagcattcggtagacagacatcttgaaggcagagaaaactgttgccctccacttttctggctgaatgaggccctgcagaatttgtagagaatgttagtgttcccacataattaagaaagtgactagtacaatagtcttttctgtactttggaaagacctttctcttaatttgtgaaggtaattaaaagcaaaggatgaagagttgtttaaatgttgagcaaatttcagacattttcctacctgagtcatgattttcttcctgtggatctaaatgtttcttgatagggcctgcttcccgatctgtggagatgctgaaggagatgattaagtctggaatgaatgtggctcggctgaatttctctcatggaacccatgaggtgagcgtcaacgagatccaggagactcagcgattccttaacagtcgtactgcaggcaggtgtgagtccaggggtcccagtgaacggaacattgccgtttctctcttctaacttcactggaatagaaacctggcctgctttgtcacccaccgaccagggttagccctaccgtcaacctttatgaaagaaggcacgtaagggtttagctggaaaccctaggccatcagatgtcttggcccccatgcttcagggtttttacagtggttcctgtgtgtgaaccaaaaggttctgagcagatggatagctggagtcattttaagatctaccttttaaatacttctctctccccctccctccctctcgacagggtttctctgtatagccctggctgtcctggaactcactttgtagaccaggctggcctcgaattcagaaatctacctgcctctgcctcccgagtgctgggattaaaggcttgtgccaccaccgcccagctttttaaatactttctaacttgactgtggatttcctactggtattggtgaaggagggaaggagactcctctctgcctcttggtttctgtgtcctatttagagtaaaagcattaaccctgtgctgttttgccctctgacctttggaagttgtttggactaaaaatagatggagaagaatggtccaagaagtgaaccccagaacatgagaatcttcatagattccctaacccatattccataaatagcttggaggctagtgcccaaatgtcatggaacctgagatagttcctcaggcacctaagcaatatttgacacattcttgctgggtgtggtgg

SEQ ID NO: 34950 - DNA, 1196 bp, Mus musculus
ggagatgggtgaaggtcaggagtcagacatacttttttttttttatttgctaattgatcatctttagctccagggtggggattggaaactggacagggacacctcacctgccaatctgcctttctttctccagtaccatgcagagaccatcaagaatgtccgtgaagccacagaaagctttgcatctgatcccattctctaccgtcctgttgcggtggctctggatacaaagggacctgagatccggactggactcatcaagggcgtgagtatctagaatagcctggtagggggtcacacttttgctatgtaaataacctatttagtctcactctgggaaacgggtattttgtttgttttatttcttcctcaatatacaaattcaggctttatagaaaggtgagaggtttctttggactttgagccagagttgagcgcccccatcaggggcattggcttcttcagttcacactcccatttcctgctttaatccatagagcggcaccgctgaggtggagctgaagaagggagccactctgaagatcaccctggacaacgcttacatggagaagtgtgacgagaacatcctgtggctggactacaagaacatctgcaaggtggtggaggtgggcagcaagatctacgtggacgatgggctcatctcactgcaggtgaaggagaaaggtatgtctggtacacagtccgtggccaatgccaactccaatccccagagctctggcaagcacagacctcgaatgtatgaagatctgggtttaatctccagaggatcaaaagtctaaggttattgttggtctgcgtccctgacctgtctgaaatactgtctcagaaaaaaggcagatggggctggagagatggctcagtactgactgatcttccgaagatcctgagttcaaatatcccagtaaccacatggttgctcacaaccatctataatggttgtgatgccctcttctggtgtctaaagagagctacagcgtgtataaaaggtctttgggccggagcaagtgggggatcctaaattcaattcccagtagccacatgatggctcacaaaccatctctacagatacagtgtacagataaaacacattaagtaaataaataaataaataaataaatataaaaggtctttgggccggagcaagtgggggatcctaaattcaattcccagtagcc

SEQ ID NO: 34951 - DNA, 1206 bp, Mus musculus
caaagtgagttacaggacagccagggctatacagagaaaccctgtctcgaaaaccaaaaaagaatgtacaccacctcgtgtggctatttatttgtttattcattaatttgaggcaaggtttccctttgtagccctgcctgacttggaattaactgtgtgtgtagaccaggctggtcttgaactcaaaggtctgtttgcatttgcctcttgtgctaccatacctaaaactcaaattttcttagcagtttgtaagtaagtatttataggtgagaaaactgacttggctttcctgaagtgttttgtttggtttggtttttgttttgtgtgtgttggagtcttaattatggctttagagtcctcctccctctgcttcttgtaaattgaggtggtcttctgtgatccctttcacacaggcgctgacttcctggtgacggaggtggagaatggtggctccttgggcagcaagaagggcgtgaacctgccgggcgctgctgtggatctccccgctgtgtcggaaaaggacatccaggacctgaagtttggggtggagcaggatgtggacatggtgtttgcatctttcatccgcaaggcagccgacgtgcatgaagtcaggaaggtgctgggagagaagggcaagaacatcaagatcatcagcaaaatcgagaaccatgaaggcgtccgcaggtgagtcctgagacccttccattgcccagcccttgagaggggtgtggccatggtgtgtcctggatacctgctcagcaaaatacagcctgctgggattggtccaggcggacatctgaatcagcattagggaggccaagtatttttagtcatcattttgggacccggctggatactcaagggcctcagatgtccatgctaaagcttgaagccttagaaatcttctggtctgataatggtgctgatgaggagtggcccattcagcttcccatagagaagcatgatgcctacgtaaatggaaattaattaaggtggcattcataaggatgagtggtttattgacaaatgttcatacttggctttctccctactgcttcccctagaactgcttctgtgggttacagtgggcttggctctgtgtcctttgtactgggcaactgggagtctctttctatcttgataagccataggtgctgatggccttggtatttggggctggggagtgggtcagctcaaagggcagca

SEQ ID NO: 34952 - DNA, 1027 bp, Mus musculus
ggtactttggttgtgcttcctgtcctctattatctttctcttctttaccaggtttgatgagatcttggaggccagtgatgggatcatggtggctcgtggtgacctgggcattgagattcctgcagagaaggtcttcctggctcagaagatgatgatcgggcgatgcaaccgagctgggaagcctgtcatctgtgccacacaggcatgtgctatttcattccttctgcattctccacctaggagacctggccttgtcctgtcctttgggcacacatagctgtgatctgtgcacctgcacaatcttaagggaattatcttggcaattatcactgaagatggcctaggatctcatttagtgatggtcttttaccgagagcccttgtctgtcccctcctagatgctggagagcatgatcaagaagccacgccccacccgtgctgaaggcagtgatgtggccaatgcagtcctggatggagcagactgcatcatgctgtctggagaaacagccaagggggactaccctctggaggctgttcgcatgcagcacctggtaagtcctccaagcctaccaccaaggcctctgcatcacccagtcttttacctccctccgaccacggccagaagagtgaggtgtgtggagcatgctctgcttcttgattttcacgttgtgctctcgctgcctgcgccccaccacgttgtcctgctctggcgattaccttttccattacgtaggccacatctggctaaaatattaaagtcctaggacttagtcaagggataccttcctccctcctgaacacccagacggcggggcggcctctattctaaaggagccaagagtgtgtattcttggctgttcgcctggtttggcttctaatttgatctcttgatggtcccatgagcagatgcttctctgcactgcaggctgtagccatactaagctgctttgagctggccttgcatggtgcctgtcacatgggacgtctcttgctatgccaaacccaatgtagggctagaaatagctctg

SEQ ID NO: 34953 - DNA, 1095 bp, Mus musculus
tgtgtgccttcctgatctacaccaaacccccttcttttctagtcacctgcttagttgtcttatcacctcagagtggtcaggaacaagaccaggtagtctaaaccatgcagtcacatacatggatttatctttgtatagctctgggtgacttatatgaccgcaagaccttgcccaaggtggcatttgatgagattaattataattaattagtcataacattaaacaatttactgccataatgaaatgttagataaccctctgggctcattgatgtaatctttgcattctcattttctttttaaagggaatcacatgtgatagtgtgtttgagcacagatttgctatcctcatagggccagccagctgtctgtttgcaccctgctgtagcaggtgtgggcagagtaggagttagttctcatgtcctgccctctctcatgccctgccctttcctatgaacagacaccttagaacctcgaggctgggattgcatggccctgctcagaagatgagtcacagagtccgggttagactgtggctgccccttcagggggtgcaagcttctctctcatcagttaacactcaggatagcttctccccttcatctgttcgctgcctcctcctctgtctaactgatatagttcatgacctgtaattaagagctagacatcccagctatggtcgtttcctgttcatgtcctttgggctgcatgcattccatttatttgtaactaaaagaatactttccacttgcaaatctgctaatactaccaataaatgtgagttattggttttacatcttctctatactaaaatacttgggattgcactctctaaaacttagattttcattctaatgcctggttttacttgaacagatagtctatatataacacatttgctgttttgtaacagttttaattgctaagttttaattggtgtcttaaggcatgcatgctttctcaggcatctgcctcttcacacggctgtccactgtgttcaagtgagccagagttggccactgttctgtttagaactggcgcaccatgtaactttggctcttttgacctttgaccccagctttcagagctgcccaga

SEQ ID NO: 34954 - DNA, 2263 bp, Mus musculus
aggagaacagtatagtgttatggtgaacattgttggcttccagggcctggtaactctgctgctgttctttgcagaagaagtcaggagctaggcacatggtacttggattgtaaaagttgctggcagctacaggagtgggttctgctgagattgggccaaagctgcctcactgccagatggaagggttcatttgtgggaagaattctaccagccatgctcctataggactgcccatactgagagcaggataatcatcttagaaaagacaggacaggtctgaggggcaggccagaccttgaaacagttgtcagtgggcaaagcctgtggtccagagttgaattagagggtattacttttggcttaggcttactgaaagggtcttatgacatgtttaacggtcagtctttccaacctgtttccatctcaggagtgctcaccaagtggccaggtaccgccctcgggctcctatcattgccgtgactcgaaatccccagactgctcgccaggcccatctgtaccgtggcatcttccctgtgctgtgtaaggatgccgtgctgaatgcctgggctgaggatgtcgaccttcgtgtaaacttggccatggatgttggtatgtagctggaaacaagggaatgatgaagtgctaataaatggggaccctaaaactaccacttcctgaagtcatgggctgggcctatctgttttatcacccagttgtaagattagctggagctactgtcctgagcagggtggggttagagggtggggaacacaagcttttgtggccttattcctatatagagacaaggaggcagctgaccctgactctctagagtataaactgaatggtgtccaaaggtctctgcattctgagttcagcctcagcccttgtttaggctaggaggcttgcaccatcttgtggtgagaagaagtaactgtcaacctgctcccctacccagacgaggattattagggcagttatctgcacctgccttgttggatttgtgtctgggttgggaaaagtgccactttgtgtgatcaattaggactgtggggctttgcagttttcctcaagtgtatacctctactcaccaacctccttttccccccaggcaaggcccgaggcttcttcaagaagggagatgtggtcattgtgctgaccgggtggcgccctggctctggattcaccaacaccatgcgtgtagtgcctgtaccttgatggccctctggagcccctcttctagcccctgtcccttcccctcccctatcctttccattaggccagcaacgcttgtagtgctcactctgggccatagtgtggcgctggtgggctgggacaccagggaaaattaatgcctctaaaacatgcaatagagaccagctattattcagggccctacctgagccaggggtggaggaggaatgcaggactggaaaccctgactttatcacagaagggcggcagcatctctgggctttgcttctgtagaaagttgtcagaattcccagccctagcctggagtcaggagacagcaaaagagtaggggctgagggtgtggggcccagggtcccagtgtagatgacgacttctggccctggccctgacctgctttcccaacagctttggcctccccacttcttgtgcactccacttctgtcactgcagacactccactctccaccttgtattctgcagagtctccaggcctgttgctatagtgcccacctgaatgtcaataaacagcagctgaagcacctgtgttgtgttttgttttgtttttttccgggggttggtagtggtggtcgagccctgccctttgagcaattgagaatgacaacagccaggaggcctggccttgggtgctatggatccaccagataaccttcaagcacgggaccactggagacgccggagactgaatactttgggagtatataagttgcctcctgcaccaaagtgcggctgtgtatcgggaagctgatccgttctatttcagggcaaatactagaaaagtctgggacaggttcagctagcacctagaatggtcgaatagtgggctgatccctgtggtagaggcctgttgagggcgctgtaggatgagtccctgattggatacttcacaaaaccctcagcctccataacagttaagcacaaagggtctcttgttttcctgttgccctcaggaataaggtacatagaaacaaggtgggacccttgtccctggcaactcccaacagccacctagtcagaggctaaggcctct

SEQ ID NO: 34955 - DNA, 1864 bp, Mus musculus
cagaaattgccatgttccttgaacccctggatcttccccacaaaagagtggtatttttagccatcaatgataattctaaccaggcagccggaggtacccactggagtttgttggtttatctccaagataaaaatagcttctttcattatgattcccatagcaggagcaactcaatccatgcaaagcaggtagcagagaaactgaaggctttcttaggcagcaaaggagacaaactggtctttgtggaagagaaagccccagctcaagagaacagctatgactgtgggatgtacgtgatatgtaacaccgaggccttgtgtcagagtctctttagacggcagccagagtccccgctgcagctactcaccccgacatacatcacaaagaagagaggagaatggaaagatctaattgccagacttgctaaaaaaaacgaagtagctactgaagaatgctcgtgatgtttgaagtctggtctttctgcctttctctatggtgacagcctcagtgcctgagggaaaaccactagtagatgaaagtttacaattcctgcttctttattgttctgtaagaatgtcatcctctgtgttctctgaatgggaagtttcactgtaatcctgaggaaagcggtacattctgtggaaatgtcttgaacttacgtaccaaaactttagtaacaaacctctcattacacagtttcaagtaagagccttcttttcttgttggtataaaactattatcccttttggtctcccttccttgttggcttattccaaagaagtgatgttccaaagcaaaccaataacatgaagtctaaagacatgcatgaagaaaacagcagaagaaccaacatctttgtttcacagccatagtgaggcgtccgactggaggtggatcattacctaactccacttatagccttcggtttataaaaataaggcattctcgggtgcaaaggctttcccgtctgcaaatacttaataaagatgactttagctcatctttatctatttcctggaatgctttaagaacatggaacgtcattaaaataaatggctatagactgggagcataactttgaggaagagcacctgctgtggtgtgcaggaagacttgaactcaattccaaattgcagtaaataaaaacaaaacaaaaccacctgcgggtgtgtggtgcatctctggtttccctgagtgagtgggtgactcagctctaagtgatggtgactttgtcttgtcctttacatggatttagtccctccctttacctaacgtgctgtagttctcaagctcacaggataaccagccaagattagctgttatttcagacatgttctacttttggtagatagagcttttacactaatctagcagagttgttttcaggtatgttgtggtaatctccatactattaatgatctaaaacataggagcagtttattttttaaatataaaggaaaaaaaatgtcaccttcctcaaacttaatccaaaaagtaaatggtataactttaaaatatggaaacaagactaaaatgaaatactactccccacaaagctattgataaatttttctacttgtttcaagtaattaacacaagaagttgggcacacataataattagaccccgataacaatttgcagtgtatatgggatgtaaaacacaaagatgtgattcactcactgaaactgacttcagctacttctccactctaaccctgaccccagcgttcataacccaaaataacctctccagtcagcaactacagaggtactcagttccctggagccaggaagaggaagatggtaaaagtgtaaaagcacaggctgcataagcaggcttcagtgtatgggatctgaaacaa

SEQ ID NO: 34956 - DNA, 1148 bp, Mus musculus
atgcatggactttatactgaaggtatttaccgaaagtctggttcaactaataaaatcaaggagcttcgacaaggtctagatacaggtaagatagtatgccctgaatcaagatgtaacacttattttaaaagttatttcacttttatattctgcttctctaaatgtagggccagaacattttggggtatttctttgccatttttgagtctttggctgtatttagtaaattcatcaaacatgtaccaacagtatcaattatagaaagtttgttaggtacttgaaaaagatcttaatctatttaacagactaattagatcctgttatccttaatttatggggaagaaaaatgtaggttcaaggaaattaatagaatgttgatgcaaggtaacaaagattcttagaaacagttttgagaactcagagacgtcatttatctgcatttaaaggtaaggaatcaaactgacaaaggaattcatctaactgcttatcaccaaccagtgacaacaatttaatcccgtgttctctgaatccatactttaaagtgcttcctgttaagtcttcagtgtcctgaccacagacaggattctttgtaatagatatccctagtgcccatgtatattgaggacttggttatgagtgtaccatttagtcccagggtacatacaagggcttgcctttggtttcattaaccaaatatattcttcaacattgttaaaagaaaatagttcttttaaaaccaaacttagatacacaagttgtctttgtgtgaccaagaactccagtggtttttctcaccatcagtgaaaaatgaattattgtgaaaataacaagaaattcctgataaaacttgataaattctgactgagagaactttgtatacgatagtttggggcatttttcaggtttggctcactcttgaactgtgcaacatcaaacaggatgtagatgtttccatcacattttcctgccttctcatctgtaagaatgacttaaattcagccttgcatttagtccccttagacttctgacgcattggtactcaagtgtgtggtacgtagtccaatctacaagacagggacaaaaatcaaaagcaagcaaatagacaattctgcagtagtttgatccttcatgaaacgtgatcttttaca

SEQ ID NO: 34957 - DNA, 1355 bp, Mus musculus
cagatctcatctttggggcctcttctggtcaccttgtttgtaacagtcggtcctaatggtcctgcctcgtttcagcagacagattgtatgctggatcactgggcttctggcaaaagtggccgctttgaagtttgctagggatgggccagctgtgccttggctgctgtatttgatttgagagtccactgaacaaagccacctgggacctgggggattttggccaataatagttgcttcttgcccacctacttttcccttcccacagatagttgctgaactagggagctattgtgatcctgaggtatgctctcatttctagcatttaaagaaaacatacaaacctctgttaaccatggaaacaaaagcttttgagtttgtattggaatagttaggaactgtgttagaatataaaaatttccccaaggatttataagccctctattttaaatttaattacaaaacattcaatgttatcttttggaaacctaaactgatttccattaagcccagagtgtctcagctacaggaatgtgaagagaccatgctttgtctcttgttgatatttggtattatagtcagtgctggtttaacgcttggttaattcctgccaaatatatttcatggggtaaagttctggtagccatactgtattggtatgccctgattatagatcagactcctctaggtttttgtttgaaatatgtcacaggcacatttaggtaattcctaaatgtgaacgcatcatcctgattgatccaagcttttctttttgtataaactgaagactgtatccgagcctactcatctgctggtggagtaccaccatagatgtaaccatttcatcacttatctaggagtactcacatacatacaactgtgcatgagtgttatagaaaaagccgccaaaagaagtctagaaagtttaaatatgatctatttaatttttgtcttcttatcagaccatcagtattagatgaaaaaaatcaaggactacttgaagctatttttgttaatattcttgttcctgaagtttactgtaaatacacatgtataatatgcctagttctttttaaccttgtgctttccccttattcccattgagtttctccctacagataagaggccattagacaggtggtgagagccattcacccccggggtgaggaataagtaagggcatctttttcatcactggtagtttccataagttataatgtcagaagcatcatgtactagcaattgtgggactagaactctgtttttgctatttatgttatgtgaagtgaaacatgataccatttcttaagtatatgaaatgtttatttttaaagtcactaaatacattttgtctaact

SEQ ID NO: 34958 - DNA, 1215 bp, Mus musculus
ttggttttctcctcctcctcttcttttccttctcctccttctccttttttggtttgaagttacaggaatagaagtcttttgttaaggcaaggtctctcctcctacacaacactgaacctcacgccactgcaatagtggtcattggccggctctagagatgagacttgtagcattattttgcacagcagctcatggtggctggagtcttccctctccatggtatgggttcagcattgagacacatgaaggaagttttgaaaatctccccgatgatgatggtcattcagtaaatgctaacttttatatccctccagcattaacaataagagttttggaaactgttctacaggaagccagcatggctgtgatatggtggggtgctgttttgggcctttctggctatacagtctgttatagtatttggggaaagtagctgctactgggtggtaactgttgctaactgttgctctccacttggctcagaacaatttcctttgtttcagaggaatgtcctggaactcagcacttgacacacattctccctcctaaagttttacagctcagttttttgtttttattatttctataaagtaaatttggggctgagaaaaaaaaaaaaccaacctacctacataggtcaccttgtaggaactaggtaatcaatattaaagactttataatttttctcagggacctaaaacctgaatttgaataaagttaaataaaaactttttttttcatttgctagatttgtggattttttaatcatttaacaagccgccaggatgggtgggggaaatccacacaactataagaatgtctcggcaaagtgtaggtccctgtaaggaaaagagtgctgttgttcttgggttagcaggcactattgatctgatagagacgaagccataactcagtagtgtcagatgtctggctccatcagttcttaacagagcctctgaatcctcacccatgatacagatccacatagagttcactgttatgtctgtctagctgcttttcttcagtcttaaaatgcaccaaaagaaactctctggcagcagcagagtgtctcacatgtggaacctgtgctccaaacttcagagcatcctagttatgtcacatacttctagtccacaataactcctacatttttccctactcattaatatgtgtctgtagctgtgtgtcatagaaaatgtagcagaagcaaacaat

SEQ ID NO: 34959 - DNA, 1207 bp, Mus musculus
ctactgatggtgccttctgaaaatccagcatagagctctcatcccaactccagacctgccgtcatccagggcagcagctggacccctgaccaagcacagcctccttcctggtgctactggcctatccaaaattagaacccctttggaaagtcaagagagggaaacaccccatcctgcagcatcgacaaacctgtgcacccctgatacctcagcccagctgcatctgttgccattcttaaagacaagagacagttccctgtctccggacagaggtatctcacaacagagtgcttttttgtttagcaggtacacacgttctctgacattagctccctggaggctgcagcatcgcagaatgggaggcagggggtgaatatgtgctcccactttactagcaaggagactgaggtctactcacataactgagttgctgtttgggaacaaggctaagtgcctaccccagatggttaagcacaaccttctccccacagcaccttcaacctgggctctttccagggcctatagtctgaaggatgaatggggcttcctgtctgaccaggaggctgagaagtttctcattctatgaacagcccaggcttctgagacccatcctctgtccccaagtgctgcctcaaatgagttctttcaagatatctgcacccctgtcccccttccctcagccacaactcctgctgacaggaatctggtgtttgctaagttccattcttaacagaactgtccctggagacaagagagccatggggagagctggccagttgccagggattctctgggccgttctggaactggaacaaactcccacaggctcttgttctaccatctctcctgggttcttcatggtaccacctcgtgtacagccacgccagttaaaccagcaagatgtccgtattgcaatagaaagggtcttatttgagcctgtggactgtctggagtttctatctagtggtctcgcatcgctcccctccactgtgactcatgactctttcttcccacaagccttgaccatcgagactaactttaatgctgcaggtctgagagaaggagctaggaagccctccgtagctctgctgactcactctgcccaactgtaattccaaaggcccaggcctgaagggactcagtgtttattgaaaggtgaaccatcctggggtgccagggactggggagagacaattaggagaagtct

SEQ ID NO: 34960 - DNA, 1183 bp, Mus musculus
tttgcttctcatctctgtgcttcgatccatcagcaaccctgaccccttgtcctggacgtggcctgtttctgtcctctttctccccatctaggataccatcctctccgtgttctccatgcagctcagtgggcacttggcatttccttcagccccgttctgtccttcctgatatatggccgagacaatccacaattatttgctcccatgacctctgttcagaactaaattataataaacccctccattttatatatttgagcccaaatttccagtttctcagaatataaatgtaaatgcaagtaggaccaaaagagagagatttaaatcgagtttattaaggtgggaactaattcagcctggccggtgatcttatgaagagactggtacatgcagagaggagatgagctccagggaaacgacagaggaaagacgagcctgaggtgaggtggtcaaggaaacagccttgccagtgccacgcccatgcacagctccctcctggaactataagaaaacgtgtttttgtattcggttctggagaggcctttgcaaactaacagtcttccatggaatgggttacctctaccctctccctctccctctccctctccctctccctctccctctccctctccctctccctctccctctccctctccctctccctctccctccatcccttcctccatccctctctctccatctcccctccctcttccttccccctccctctctctccctttttccctctccctccctcttcctcaccctttccctccctcctactccatccctctcccaccccctcacaaggccttcctatgcttgctgttcctgcttcttgcaataatctgatgccagctccctccttaccattcagatcccccacaaatgctctcacggccttattttatttctgagccctacagaaatcagcttagaagagaaagagtttattctaactcacaattccaggtgtatagtccatcaccatggggaagtcacagtgaggaacttgagacagatggtcttgtcatatccacagtcaagagcaaagaaaaaggatacatacttagtactcagccagctccctctactctcacacagtccagggccctaaacccaggagtggtgccacccattttcaagctgggtctttccagatctgttgagacactcaagaaga

SEQ ID NO: 34961 - DNA, 1198 bp, Mus musculus
gactcggtggttgaattgcctcctgcgtgaagactggagtgcagatctttgagcccaagtgaaatccaggtagggcagtggtcttacacgcgttctcgcgaccggccaggaagaacacaacaaaccggaatcttctgcggcaaaagctttattgcttacatcttcaggagcatgagagcaagagcaagagagcaagagagagaatggcgaaaccccgtccctttttaaggagaattatcctccgcctaggacgtgtcgctccctgattggctgcagcccatcggctgagttgccgtcacggggaaggcagagcacatggagtggagaactacccttggcacatgcgcagattatttgtttaccacttagaacacaggatgtcagcgccatcttgcaatggcgaatgtgagggcggctccccacacagtggtcacccgcagtctcagctctctggaggcaatggaggctggctagctagagcaagtagaatcagtgagcttcgggttcagtgagatactgtgcctaagtatatatggtgggaagacattcatgaaggcagcctctgccttcttcaggcatacatgagcgtgtaaacccttctcctgatctctctctctctctctctctctctctctctctctctctctctctctctctctctctcacacacacacacacacacacacacacacacacacacaccacagcaaagaaaagaataaagaaaaggaagttcactatccttgccttgatggtcactcagccatctgccaatggcaggcagattttagcgcatggagactacctctgcctattctccactatgtacccactgcctgcccctctcccacgttccatgccattaagcagggcaattaaagatttttacacacggctgcacgtgacaaatggatgttccggtctcttgatttctgctgagcagaagcttccagccaagagtcgacacgagcctgctgcttcagcgtgggtcgggacgattatttcaacaagatttttgacaaggaaataaaactcaaaagtcatttccaggagcctgtggtgaagtcggaacatatgcggttctctgggggctgtcagggaaagactctgcagggtgtttatctgtgttctgggcgggtgaccactgtatatttgggtgggcgatatctgctgagctgtctggatcagagcaagagct

SEQ ID NO: 34962 - DNA, 1147 bp, Mus musculus
ctacaccatgacatatggagtcgtgagcgtgtattgttagaactagtgttcttatgtaaggcaggcatgctgactgcagaaaggaaactgagcccagggccacagctcttttctttagaaattgccttaaaagaattcccaagatgttttaagtgtaataaggaaatcctacccagaactgtttttctaaaccaaaatcgattctttattttgctcctcccatctctcccctcttcctaatctgaaaaccttttgattactgatgatgtagatactgtgtagagccctctataaaatagaagtcaccacagtgacgttaggttctgcggttaatggtttttgtttgtttgtttgtttggcagtgtgcatcaccgggtatacctccccatatgcatagcaggtctatgctaaggcctctggagttgtctttacccagtcagacctcatactctgaaaatgagattttaaagaaagaattggaaaccttgcgaacttactatgactcggcaaaacaggaccgactgaagttccaaaacgaactggctcacaaggtggcggagtgcaaagccttagctctggagtgcgagagagtcaaggaagactcggacgaacagatcaagcagctggaagatgccctcaaagacgtgcagaagaggatgtatgagtccgaagggaaagtcaaacaaatgcagacccacttcctcgccctcaaagagcacctgaccaacgaagcggccacagggagccaccgcatcatcgaggaactgagggagcagctgaaagacctgaaaggcaaatatgaaggcgcttcggccgaggtaggcaagctgcggagccagatcaaacagagcgagatgctggtgggagagttcaagagagacgagggcaggctggtggaagagaataagcgattgcagaaggaatgcggcacatgtgaagtcgagctggagaggagggggcgacgggtcgtggaactggagggccagctgaaggagctgggggctaagctggccctttctgtccccacagagaaatttgaaagcatgaagagctcattatccaatgacatcaatgagaaagtgaaaaggctggcggaggtggggcgggactatgaaagcgctcagggggaaattcgacagctgaagag

SEQ ID NO: 34963 - DNA, 1169 bp, Mus musculus
ggcagggcagggagatggctgagtgggcaaagcaatttttctacaaggttgaggaccagagttcagatccctagcacctaggaactgctgagtgggtgtggcagcctgtctctaagctggatagggatgctcaccagccaaatggcaagctctggctaaggttatacacacacacacacacacacacacacacacacacacacacacacacgcacgcacagacacgcacatgcacacacacatgcactcccacacacactccacaacagccatgggaaatgttcatggaccttattgtttgtaatgtatactgcagaggcctttgttgcccgttggttttcaggagcccctcctgtgtacttcctccgtgtgacctgatgcctttgtttccgtggtagagttcctatggggtactcttacaatgatgaggtgtgccctaggataaaggcctcacctttggagttcaggaaagatgacacacactctcccttctctgcagggccacatggatgaagatgtgcaggcagccctactgcagatcatacagatgcgacaaggccttgtgtgctagcggcagctgacttggagcctgtcctgctggtgctatgcattctgggtgcaactctgtgctcttctgggccttactctgatagtatcagtaaaataaactatattttgttccgttgttgaattttacttttctgagatgagtgtgtcaccgagttttccagtggattaaaagttgatattctgtgttacgtttatttcacacagtggcaaacagccacttttgtgtttgtacttttaaatttttttattcctttttgttttttgttttgtcttttgagacagggtttgtctttatagccctgaccatcctggaactcactttgtagaccagactggcctcgaactcacagagaaccacctgcttctgaatgctggatgctgggattaaaggcaagcaccaccacacccttgtaattataccttttaaagctacattttaaaaatagttgagtccgtgttaaaatatgagccatctaaatgggtccatgtaaaaaggagttgaggctgaaatagcactgaaagattgattttggagaactaagtttagctgatagctgcttttaagtggatcagaagaccttccagggggtgaggagatg

SEQ ID NO: 34964 - DNA, 1119 bp, Mus musculus
ctgagccacttctgacctagcctgaactcctctttccatcctgagcttttttttttcctattttttttccccattctattccatataccttggcttcctggactggatcctgagccttatgtgctcaactctgacctttgaccctaatgagaacattccctggtttatcccctagtatataagctgtgctcctggaggcaagaacagctcctcctattgggaagatgcacgcgaatcattgctttggagggaggacatgttggtgggtgatgggcacaacgcttacactggaataaaatgttgtccttgaactctggcagctatccagaggtcagccaatcacattttacccttaattgatctatcagattagctttaacggcttgggggaggaaacggaaatgcagcaggaagcgattacaatagactactgctcttagggattccatttgatcttcaaacagcctgtcacagagcgagggggtgggtccccattatccaacttaggcagtagctcagccagcctagtcgaatctcctgatgtcactaggcagcagtggagaattctggaaaactgcaccaacatcccagggctcagttctgggcacttgatcccagaaccctgcagagctttggccagcatggctcccagcacagacttctgagccttgtgtgagcccagggaagctttgggggctctggacatcctctctccccaccctttctctttgccttgggcctagggtggcagtggagaatcagctcagttttcatcggcgctggcgtctctcagggcagcccaggaaaaagacattgatttatgatcaaaaaggaggaggatgcgggggagatgcagggcagcaggggtgggtgggcgctaagagatagtatcagaaagaataaaaaagattccctatgccttaaaaaaaagatgatgaggaggatcctgccctctgatgcctccgtaggcgtgggctggaaaatcttttcatgtaaaattgaaatggaatcacgaatgaggagagggcgtcttggggcttgggtgtgccttccaggactgaattaaattaaaaacatatcgattttccctgccaacaaacaggcctggcactggaggag

SEQ ID NO: 34965 - DNA, 1219 bp, Mus musculus
gcagctgtcaggggacagagtgaccacacagggtcatgattgactgccaagggaccagcccgagccaatccgggaaggttgcttgtaagcagcagcagtggtgtagactgggcatgcatgccctcagaaatgggcacacacccaactcattctaagtccacagcttgctccctgtgctctgcagtttgcgcatgctccctcccagctctggggtgggcacctgactcaagcctcctgtgaacctcgcccatgagccatgatatttcttgcttgttagacttgcttcatccttttaacagtcagtaccataatgtggagtatagtcgttgccagtttcttagggagtgagctgagcatagctttcagggcctgggaattgcagcccctcctgctcaacctccaaagccagcttcctcaatgggatacaaatgacatcctggggtggcgggtaggggcaacagacagctggttagcggatttgtttgtaagtggtgagggaggagggaggaggctctaaccctacccaaggggctgctccagccctgcgggtagagggacactgaactgtctgtccttgcagatcttctccctgggttactgccccactggggagtggctggccgtgggcatggagagcagcaatgtggaggtcctgcaccacactaagcccgacaaataccagctgcacctgcacgagagctgcgtgctgtccctcaagttcgcctattgtggtaagccctgaagccctagcctggcatgagagccagcatggggagcctggtccagtagacagtggggaagtaggggacccacagtcttgagtcagccaagcttatgctcctttaatgtcctggaggagaaaagtaccttccttgtcccccacccttgtcttagatatggatgtcactccaggacactaaactctcaggacagtaggctttccatgttgacctggatcttctctgaaggttacacatggtgccaactcttagcctcagagaaactgtctgggaagagtacgtggctgtgggggatgttaggagccacagctaggagcgctcttggaggaacgtcctctctgactattggtctttggctgtttctggtgctctctccaccttctggtcatagactgggaaggactagctgactttagtggctttggcagggatctttttgggaaacatgctcaacacagttaattgcattttgttctgtt

SEQ ID NO: 34966 - DNA, 2346 bp, Mus musculus
tgggcctctttctaccagcacctgctcagcctgagccggagagtaggatgcgatttcgttcagagccctgaagtgccagggagaattcctgtctgttttctccccacactaaatgtcttcctgtttctccatgtcttcctcccccagtcaaaagaatcctcatctgtcttgagctgtgacatttcagcggatgacaaatatattgtaacaggctctggtgacaagaaggccacagtttacgaggtcatctactgaacaaggactctaacaggcctgtcaaactctgggagagacacccacgtggccctgacagggagatgctggccaggccccgaggacggcagaaggagggagcagcattgtggggctgccctccagaaggtggagaggacgcacgccccttcgtggattgatgtgtctgacagacttgaaggactttctcctctccccctaaccagtgctggcagatgcttcaattagatttctctggaggcttctgcttccgtttctcccacagacatcctcataagtctctgtctcttcctcccttctctgacctgtccccgccccactctgggatggggggcggggagatgcaggagtagacattgttgtttctggggaggggcgcctcgttctgattgtgcagtgcacaaggtttgtgaacagtgtaaataagagactggttgctgactggccagtgagggaggaaccccatcccaccattgctcgccgtggattttgcctgctgtatttgtaacccactcatggtggtggcttttctttcttttcttttctttttttttcctttcttaaatttttttttaccagctgttctgtggggaaaggaaacagagataagagagttggggagccgagtgaggagcttcctggggatggacaagccatcctggcgcactgggactgaagtatatctccacacgggttttagcgccatgtttagatagaatgataggcagatggacagacaagatgatggacagtactgggatgggccagcctgggctattacccacaggaacagcgaggattttctgtgggttgctctgccccatctgtctcttgccttgcccacacacctgacctccatctctttctgtcccctgccttccccaccccaccccaccccgcccccatctttctctttggtgcacactcaatcattgtgatgaggaatggaagttctagggaaccccctctctgactctcctccagcgcagcctagaaaggattccatatgggggtgggggtaggggggagatgaagcgactcagctcagggagctaccagagaaaaacagcaactggtgtgggtgcttttttttttttaatttgaataaaaataattagaagtgatctcctttgataagataccgtctcccctttcctgctctcagccctttctgctccctgaagcggggaaatggtgacccccccccccaccagtctgagaagatgggcgggacagcgggctgggggctggggcagcagtcatctgcagatatcaccccctagagtaccaatgtttgtggtattaggtttgccttgttttgttttggtcttttgttgttttattaaagaaaagctaaagaccgtgtgagccctgctggtgggctctccatggatgtagcatatggaagagagtttttatattgcatttttatggattattttataatgtgggactccgtctgggaaggaagatgagggtgtctaaaaccttcccatctccagagctccagctgagcggctgcccggaacaggatgtatgttgggacatggaaagaccgtggcaccctgcgccttcctgagaggcatgtcgtcgtgcctgtctagagtctgtccatctgtctctgggtttcagatggtcactggccaccacttgttaaggctctagccagaagggagggttagggtggaagagagttattcctgaagaaaaaagaaaaattgaaaagtcattgtaatgaagctttttatatttttaaaagttactatttaaaaaggttggtttgattgttgtgttttaattgccttttttccctccagtgtctcagtcatgcctgggaaagtggggtccatggttggtccagttgcattctggaacctgggaagcatctcaccagaaagtcctcctcccttttccctcctccctcctccctcctccctcctccctcctccctcctcccaccccatcaaaagtctgtaagggctgttgggctttttctagtccagagcatactacaccactgcctttggtctatgcaccaggcagaagtagactgggaacccctggctaagatgggtctcatgggcagcaccatgc

SEQ ID NO: 34967 - DNA, 2231 bp, Mus musculus
aacattaaccacgatatattgcatttgatatgcaactccgggtcccgggtggtatttatcaacctcatcacagacacagttactacggcgcgcacgcccggggtgagggtgggttgggaagtccaccacgtgatccgcaaggcttgaggcggagagcgacttttcagtgtacccaagccgtgggaacgcgcctgtcagtttaagcagtacgtctcccccgatagctctctccctttagcctgttaatctctactgttgagcacttgtaatattcgcaagccccaaaggccaatcgcaccggaagtcgaacgcgcaaatccggaactgcgttctgcagacgcgcctcctctcggttttggccctgccccttccgtctcgagtcgggcatcgattggtcggcgcggtcccataagaagctgcgcgcaggcgtatatgatcttttcctcagctgccgccaaggtgctcggtccttccgaggaagctaaggccgcgttggggtgaggccctcacttcatccggcgactagcaccgtgccggcagtctacagcatggcttccgtctccgagctcgcttgcatctactccgccctcatcctgcacgacgacgaggtgacggtcacggtaagtgcgggataaccccgggccggccacgtgtttgtgcggcggacacccggctccgcccggacttcgcattctcaggcattcggtgacttggaggcctgtgaggcgtatgcgctctgtcctccccgcgcggcccaacccgagacaggtgaatggcggtcccgagcgcgcatgttaggcctactgtttagagtgggctgtttttatctaagttttaggcctcgaactcaggtcgtcaggcctgcgggacaatcccacagcccgctgagccttcaaacctggccttgtcttttttaaggttgactttagcccaagtacgaaacttaactctgtataagtgactgagttttagccgcattctgatcgttctgacgggttggcgtttgtgttccaggaggataagatcaatgccctcattaaagcagctggtgtcagcgtcgaacctttctggcctggcttgtttgccaaggtaagttttggggttacacttggtaatgtacgatttccaccaccagccttgatttttgtatcttagtttgtacttattgatgtggcttttatgtcaggccttcacggtccatggcttgagaatgagttttgttgcctcttaagtttgggcatttgaagcagtgagattcatgcaaagtggatagctacattctatttatacaaacagctttatttctggcaagtggggtcaatcaactggtggcagttgtatattgattccctgtagtcctgaacattgctttggtctcatgggtgaaaagagcttaattgaatcattaaatcttgcagcacaaaactaaaagccttttctatgtctctgttgtaggctctggccaatgtcaacattgggagcctcatctgcaatgtaggggctggtgggcccgctccagcagctggagctgcgcctgctggtggtgctgctccatccactgccgccgccccagctgaggagaagaaagtggaggcaaagaaggaagagtccgaggagtctgaagatgacatgggcttcggtctttttgactaaactgcttttgttaagttggctaataaagagctgaacctgtaggtggactggtctcacttgtaagccacaaagctcttggagtttcagagatggtagcaggtcccaaaaaaatgtcagggaaggagggtcttgaccaaagccaccatgagttatataaataagacctgggtcaaaagaactagacgatctgggtagagaatgggtgggtctgtctccaggaagccccttcaagcaactgttcagagagcctgtttagtgccagacagacaggctgagagctaactcttactgtcaagaataacaaaataacctctgggtctcccgatgttcatgtgtgaagaacttgacagttgttgaggatctcagaagcatctagaagggccagagaacctaccagtccactggtgtaaaaccagcagcctaaaggattcagtcacgcagcaaggcttggtgtgtaactacaacttcatgtagaaagtttaggacttggggctgacagtgccaggtaccccattgcctctgccttagtgaagaagctagggagtgggttcaaagccagcctgaactacaaaacataa

SEQ ID NO: 34968 - DNA, 1153 bp, Mus musculus
ccacgttgcaacagctacttgacttatcttgtgatcccagaatcccctaagaggtcacactgagcctgtgacagcactgtcagtgcttggcttgtcagacgtgagggaggatgcctctgtgtcactgggggtaacaaaatgagactctgggtgtgcaggaattctgcctgtgaagtgggatccacagcatgttcgacgggtgggagaactgggcatgtatggaggaacactgccagggacccatgcatttttgcctccagaaaactacaaagttccctaggtttttaaatcatgtaaatgtttacttatcctgagtatagagagaatggggagggtattttaattttttgttgtgattcttttttttttaaggatattggtttggttcacttctctgagttagcttccatgttgaatctgtcaccatttcagtagtaaaacagccaaaagtttctagaaaagagcaggtttgacctttaggagttactgtatataacggcttcgttcaagagcctcacgacatctgtgaggtgtgtagaaatgtcacaagcactctccagatgcagggcctctgtctttgttggtgtacagactcttaccaaaagctgctggtttgttcttgtaattgtttccttgcttctccattgtacatgtggggtatatgccatgtgtcaaatatgcaataatgtgtttactggatgccctcctggagggtggtcctctgtaaagctgtacagcctttgcagttcaagcacaatgtgcacatgttagttttatatacagcaaaacttgattttttcaaatggaaaggtattttgtttctatacaaagttaaatgggttgtttgtgcttaatgtaaagctgctttataaaattgtaaaataaagtttttatctcgaaaagaaatgtacttggatatttctcttctcttctgcttagtttgtgattatgtgaacccaataagcatttggccaatatttctttgaacctgaagacagggaaccagagtaatctcgcaggagccttagtctgtgggggccacagtacaccagacaggttcagaacagaaagggctgcactgcacttggtcaggaactgaagcccacgtcagggctctagggtgaggacaggtggaagtagggaagggacaact

SEQ ID NO: 34969 - DNA, 1133 bp, Mus musculus
cccacattaaccagctgcagctgctcagcaccatcgatgagtccccaatcttcaaagaatttgtcaagaggtggaaaagctaccttaaaggcagtagggcaaagcacaactagagctcgaaaccaaaagtgcattccagcctcttctgtgtcgctcagcagcagagctcagcagcacgtcgcacactttaaatgctgtgttctgggtttgtgggtcacagcactgtaagaagagacccttaaagttagtcttctgaaacagttgcattccacggggcaggtgcttagaaaggtatcgaggagagcgctctgtcagtgcactgaaccaagacctctgccctctcatcatgtaggcctccatgcagagtcactctcagtctgaggaagatactggtaagtcactgctgctagcctgctgcccagcacttacctaaaacttagtatggagtgcttttaaaatgtgattatttatatttatactgaaagcaggcttttagaaatcagtgtgctgtattacagtaaatgtgtgcgtatagcctggatcgtggacttttttaagtgtttctttcccataggttcatttcttgagagggagtgagcatttgttgcatttgttcaattatatatggaaaatattttgaattatggttttcttgaactctgtatatctaaacacagcccgtgttcaggtttcacggtcacatacataagcacaactgaaatgaaacttgttgactgcacaagaagtcacagacatgctgtgttttatgaaacggtctacaatcagtcaaagtttgataatcgtcttccccacgtctgctctagtgcagtgtgtctgtatcactatctagaaggctgcatttcatttcatactatcctttagtagtcctgtccaatgagaggacattacacagaatattaattataagcctaaacttgtgacagacttgatgctttgaaattgaccattggtacctcctccttaaaagagaagtgtcgtgttcaggagtcacagtaaagtctctcctgcctgggttgtcaccattgcttttcacgtcgtttctgtccttgctgtttctctgaagcttaattttgaacgattccagcattgaaacagaaaagatgctactgtgt

SEQ ID NO: 34970 - DNA, 2331 bp, Mus musculus
tcaccctgagctgcaggccttattgtgggctctgagatgggatgaaaggcctttctaggcagggacatctctaactcatgtaggtgtgcgggtatagtgtatgtgcttgcgtgtgtgcacatgtgtttgtttgtgcatgtaccatgtgtgtaggccagaagttagtgtcaattttatttctcaatttctccgccttatattttgagccagggtctcttgttgaacctggagctcactggtttggctaagccggctgccggtgagctccagggttccacctgtctgtgtctccaaggtgctggaatacaaatgtgtgctgctaggccctgcctttacctaggggctggggtggagcttggatcagtgggactgggagctgcctccccagatccagcaggggcactgctaataccctgctgtctttctttgcccctaggaggatgaggaaggttacaatgacggggaagtggatgacgaggaagacgaagaagaagctggtggtatgtcagccttctctctcccagtggcagcctgacccctttgactctagcattgccctgcttgggctttaagggccaggcgatgggagggggcacccacgcttcctggatgtgttctggttcccagtgggggtggggctgccgggaagatggctgcctgataactctccctttccctccatttttccagaagaagaagggagtcagaagcgaaaacgagaaccggacgatgagggcgaagaggatgactaaggaatgaacctgtttggggaaattcctattgtgatttgactgtttttacccatatcccctccccctcctattcctgccccccgaaacttatttttttctgattgtagcattgctgtgggaaggagaggggaaaagtgtactgggggttgatggggggtgggggtgggggggaggggaggaataaaatactatttttactgccacactttatttccccccctcctttttccttgtgtctggttttgtccccataaatgcaatagcttagtgcacaccaagcaagtgtttgttcttactctctggagaggatggcttggaggtctaacattttctggtatgtcctacatccccagagttgatcgggaggccgtggctggcctctgccaggtgactcacagcccctgtcatcttcactaactcctgttctggttccggttcgtgtggtcgctgccagaggcacccagcaccccggtttgtaaatagcaaccaaaaggcgtattttggcactggtttggggacagtccccatctcgcatcccttttccctccctccacagatggcagtgggctttgctttttgcaaagagaactcttattactctggggctatgatcccgagagccaaaaagaaaaaatcaaaataacaacaacaagaaaaaaacaaaaaacggcagggttaggagatacttgtaaaatgggaaagaagtgaaccttcatgtttcagcttcttaaaaacaaaaacaaacaaaaaaaactgttctatttggttctgtaaaatattagagcaactggttttgcagaaatgacaggaggacgcatctcaggcgctccagcttagaacccttttacaaatctacgctctggagctccctccaagagtcctctggggttttgttctgcttgttttccttctcacatacattggagcacaggaaaggaatgcaaactcgtattttcttacccggtgggactctgaaatggccgcaggtttctcctagggaatgctgtgtgccttctgcatccctcttccagatcgctttagaagtgacgtgctgtgtccctcctaccctgcgtctcattggtacagaacaactgccactcatttttctcccgcccttgagaagagccaaactttgagttttatgtctgtttgtcattgataaatttcaataaatcttttttatacaattttttgggagatggcttcctttgagtctttacaagccattgatcgtcctagggtcacctgctggccctggagggaaggcttgtaatgtcacctgctaaacagctttcttacagagtaaatagccttacaccgagatggagggagaatttttgttcgcaaagcagcaaaaacatatctgggtgggatatgttctacttaaaggctacagtctttaaagtgggggatggtggggggggggaaggtacaaaacttataaataaataaataaataaataaataaataaataaataaataaataaataaataaggcaagccacctaaaaggcacaccaacaataaatagctcctgttcttgtttttaaaatatctttggttaattttttttccata

SEQ ID NO: 34971 - DNA, 1899 bp, Mus musculus
ctggggaccagttggtagaccctacctaccacctcaagaactggaagctgacctttgacctcctgacttcatgctaacatcggtcccccagcctctcctggaaagcccacccctgactggctgcggcttctccttgcagccccaagagccaggctttcccccttggctcccggcaagtctcctcagagggacaggatgagtgggattacagcctggtttagatcttgaatgtgtcccctgcagaggggctgccaggacctatctacacaggaaccagtcgctctgaccccagcattccttctgaaacacagagagggctggattgtggggagagcgctctgcccaccttctgcctccttctgctcctgctgccgagcaagctcaagtcatctcacccaatggttgagcgcctggcagcccgcccttttctttctgaactccctcccacccctttgtcttcagggaatgaagaggatgtgctccatggccataatgaccctttgcctacctaccctgtggttctcttcaaagctcttttacaccacttttccatttaattcgtgaagcaggcagagtaaggattagtgtccctacctgtcaaatgacagaaccgaggggtcactcagagggtcagcagcagaccaagtacccttggtatccagagctttcggccagggcccttcccactgtattgagatgccaatccccttgtgggcttccccagaaagagacctggaagccacttccactgtctgcccaacaccagtagtgccaacacgcaggctgaggctctcacactcagtgccctggaccctcctggcctgcgctccttgctctcactctctgctggggggggggggggggctccatctgacagtgaggcctcttcctggaagctgaggcagagagaaagaatagagtttggcccttgggcaggcagagcaagatggcttccagggacgctctgcctgtgtctccctccaccccgctcccttcccactcccaaccctgctatctcagccactttcagccttacacacacaggatgaccacagccactccacccacatagcactttaaagtttacccaggtttttgacacatagatctcaccgactcgtgcatctgccctactttacagtgaaggtaaccaggaaatggccctctgcacgcagctctgggatgcggcatctctttggtcctctacacgcttgctttagcccctctcccctccctctctccattctccacctaacacatggagctcaaaagcactggtgtcaggacagtcaccgccctttgggtagaggagatgtggggacctcggtcaccggctgggatctgctatacataggacacttcttgcctgcccaccctgcaaaacttcccaactgcagatgccctccaggcgagctgaggtgagatttccccagccctggggcctctcctctccaaccaccgacgttccccactcccagcgtgctaaagcgagttctcctccccaccaccacagctagactgtcagctctcatctcccctccacacttctggaattttctttctctccattgacctttgtggtcttctgtgattatttatgctgcctcccaaggttagaattgaaataaaatgttttcaggttatcaagccatgtatcaagccatgttttcaggctatcgtggccatgtcatttagccgcagggagatcctacgttggtcacctcgttgtctctgtggccagcggcacattcggctcctctgtctttctgaaatgacagctacctctgtacagctatcctgccacattctgttcatctgacactgttgacaaccccggggacgacagtgctttgctgcgggggctgtcctgtacactgtacacttgtcagtgtccctgcc

SEQ ID NO: 34972 - DNA, 1624 bp, Mus musculus
tgaaatcttgtgataaacagggttcttctcaaaataacccaggcagagggcagtggtagaagacttggaactggagcaaagctgggtggcagacgctagggagctcctgggaccatttttcttatttttgtttatatttaacatttccagttttaaaaacaattttttaacaaaagaaaagaaacgaaagaaagaaagaaccctgccttttgaaggcagaaatatgggttgccgagattgcccgagtgagcaatcgtgagggctggatccctgtctcagccctgagggtgaagcaggagggccggaggggatgaagtggagtgacatccagctacccagatgcctatatggattggaaccagtgacctggggaaagcattccgagttctctgtgcaggagagacagagcccgccatcctcctgtggctaagccgtgcctctcccaccttgggaataaataactcagacgccgaggcctcagctttacccatagttacgacattctgaaagccaggaagtaactgataagcaagcaggacaagaaagggaaacggccatctacaggcaaggagacagacagctcagaagcagggcatgatggcgggcgccagaaagatcagcatcgggaagctgaggcaggaggattgccatgagtatgagatagcatgggctacatagtgagttctaggccagattaagctgtgtgtgtatgtgttgtttagtgttgtgacaggctttcctctagccctggctggcctcaaactcactatttatccaagggtgatcttgaacttcttttcttggttgctgagattacaggcgtgtgacaccacgtctattttatatagtgctgggtagcaaacccaatacttttcgcatgctagacaatatgctaccaggtgagctgcatcccagctccaggcctgggacatttgacaggtgcgtatggttggaaagccactataaccagtctccatggttacatcacctatacttggttgtttaagcatcgcctttagcaagactactctctacttaacatttttatagaaatggcaatgctctgtcctcattggtgtatgttatacttaattaaattataaaagcacatccataatcaaatgtaatcatgccaagacctcctaacacagtgactgtggatatcccagcttgctttctagtgctgtggtaagttgctatggctaaaataagttggagaggaatgagtttatctgacttacacttccacatcccagtccatcactgagggaaggcaggaacctggaggcaggaactgaagcacagaccaagcaagaatgtggcttgctcaagtgcagggcccctgctggtagcctactttcccagtcagtgttttgtgggcatctgttagtatatttcacagaagcaatcagaatctagtagacccagagagtcgactgtacgaaggtctgccagggtaccaactctttacccaaaccactgcgcacagacgcacacataaggccaagtgtcattctgtaccctcaattgcctcaagaagagaagagggactggctctgggttcgatcctctaaaacagagcaacaacaacacagataaccctagcgcctgggaggaagagaca

SEQ ID NO: 34973 - DNA, 1165 bp, Mus musculus
aaccacagagtgaatcgggtagtgttcctgggcaacatgaagcggctcctcacgacaggggtctccaggtggaacacaagacagatcgccctctgggaccaggtcagccactgggatgccagccggagggcagggaggggcagccagcctatatctgagctcctgaggtttctgctggaggggtctgcaactctggtggctgtgctggggtttgggaaggagccacactctcttcttagatgcagcctgaccaacaccaacctcctccctacaggaggatctgtccatgccaatgatcgaagaagaaattgatggactctcaggcctcctgttcccattctatgatgctgatacccacatgctctacctggctggaaaggtaggggtgtgtgtggggtagggactgttaattagcaggagattccagtccccattagaatgtctctctggccttatccctaagaaaactaacctaatcattgtggcttcccatgagccagcccagcccctagctctcaccatttctagctacacctctgtcgttcttctgaaatgtcagtgactgagaactcctttcgggacaagttggactggaaggataaagatctaagcctgacatgtgaccaatggcagaagatgaaacacctatcaagagatcttccaatgtggccttggcagaaaggctgtatggacatgacaaaaccaacccaccacacacatcacaccaaacactacattgcacatataatgtacataccacatacataccacacatactgactgcaccatacatatgcaccacagagaccatacatacatagtacactgcacacatatcacacatgacactacccatgtatgctgccacataccacaccatacatatgtgtcacacaggctatacatacacaccacattacatacacattatacagatgataatatatactacaatgcacacaaacaatgcactacacctacatataccatacatacataccatatataccatatatgcatacacacgtcacagcatagacacactatataaacatgctacagtgcacacgtgccacacacacactcacacagcacacacagcacacaaatcccatgtaccatacagacactcactgtgatcacacatacacacatatcacgtata

SEQ ID NO: 34974 - DNA, 3223 bp, Mus musculus
caggagagggcaggaaaggagacttaaagtttcctgctccaagggtgcaagatgcagttgctgtagttgtgcttcgtgtgtgtccttgtgttagttattttcctaacttgagagtttacatggaagacttttctgatggcttaaagggaggtgttggaatgccctaatttgggaacttctgacctagaccctcttggtgtgacttaaggcgatattgattcaccttgctctggcagctctcagtggcctggaagagatgacacactgcacaaggtgagtcagccctgcctcttctcaggctcaggtcaggtcttttcggacactaaggcccaatgaggacagtgaggaatagctgtgaaacttagtattcagttggttccatttttttaatgtatatgatttttaagcacccaaactgaaagtatctatcagataatactgcatgttttaaaaacatttttcctccttcactacccaggaccaacactgttctaagacattatttatatatgagaataataataatatacatattcagatgtagaattaaaggacagcttttgaaggagggaagacagtgctgaggagggtggagggaacggaacggtgctggtggtggactaactagagttgtttagttgtgtagttgcacactatgtactcttgctgaggatctaattctgtctgtaccatcactccagatttgcattgtggaacacctgtataaatccattataggagcaagtgtcctcatgcctggccttcccgttatttgtttttggtaaaattctttgaaagtatgctcagccaaatgttccatgaacttttgtttttaaagaaaaataggtgtgaaaggtggtagcattgtagctagctcactaggctgtcgtgtgttgcagccatgtctgtcatttgatgtttgttattggtagaatcatgctttgaattgtaacccttccttgatagtgttagtgatttccccagaacatgtcacttgtgtaaattgtcacataaatttgcatgagccaggagtgcaggagggtgcttttcacttttcatgcagttaggaattaaaaccttacacttcagtgactgaccccagtctgggcagcaaagctatctatccatcctcttgttgaagaagaaggggtagctgactctgacactggctttttccagtccactcttgattataatcacagcacaaccacccagaggttcttcactgtgggaactttaaacatgcaaaccaaaacaacctggcccatctgccatgctttggttttgctagtttctgaaaggagttttgatttcattacactaatagttgctaaatggtgattatgaagacttaggcatgatagcattgtttgacataaactgtggttaagggattaaaacctccctaaagccaacactgttttagacaaacatttctgaaaactcaagtcctagagaggagttactcattgtaattgaggcatcaggttaaaatgaggttgctttggataatccaagcagcagaatacccgtgttctgggaatatggaagccaaaggacgcgtgctacttgaactctgtgggctgagaagaagccagtggctgaacttgagtgggcgggttaaagtatctgtgcctcatgacaattgtaaaaatccgaagtgtactttctcagctacccagatgtcagtgcacgcagaagtgcacccttctcatgacttaactgcagcagaaatagggaagagtaaaaccctcaactctgcctttggctctgaactgatttcagtcagattctaagctgtgctcactcttactctgaaagtgcacagctccattctggatatcatctgacagcccctcaatatgtacatacactgaggggctttctttgaagtttctggcaaacctgccagagatgggccaggcatacagcagcccctttctcaagcctgggatctggaacaaattctatagtgacaatgctgattggttgactactacaaatgtaaagtaaatgtggtctctagtcctaggtttgtggagtgtacctttgtgttaatgtgtagggaagggacagcggtttgatggttatggggagcacgtcactgataaatctgcagggctgaatactgctaaattacagctttacagctttcctttaggggtgaatcatgggatgagtagcctcatcagaaaaatgaaggcatgaagatgcaggtctgccaggtgaggacacaggcaggctttgcacctatttcctatcaggtattgtaaaatgtgtgcatggctttttttgttgttgctcagtaatcggtagagaagagatgaggggacctctccctgcaagctttcctaaccagtcttttcagaagtacatagctgggaagtaaaatctggccttaacctactggcaggaccctgtcctttgtaatgttcaccgcaccctgcagtccttggtgcagaggagctacatagttgtagtctagtaattcaccgtggtttactgcgagccagtgatgtcattctatcgtgcgctcttgtcaagccatttatgtgactttaataagcttagtaactttgctgactgcaccggggcctatcagtgacttatatattgcatgatgtcttcaacttgagtttgacatgtagaatcacctttgatttcatggcaattgacagtcctaatggctcagctaatttgaaactaacaactttgctgtgtaaaaggaaaaatggtgttgtgttcagtaaatgtttgaaaaaaaagtaccttgaagtttgtgtctttattgttcggtgtgagatcttttgttgagttccttttaaaggggttgttgaagttacatgtgtgtggggtggaatcctctattaaagctcatagtaaagctaagctcttccttcccatgtccacttggactctgtagagacaaaaatcataaaatgtctttcagaagcttcccatacattttctgtgttaccttacattacatttattttcacttgaagagtgcaaatggacttcatgtttactgtttaatatgtcaagcatgttttcattcctcatatgtacatttaaaaatatacaacttcatagcatgtctatggatggtcttaaagtctgtttactcagacttttattggtgggtatttagatgttcagttttctcagtgatgtggtagtgaaccccgtttacagctgcttgctagccttgcttttaattctg

SEQ ID NO: 34975 - DNA, 1608 bp, Mus musculus
agattgagttctaggacagcctggactacacagagaaactctgtctcagaaaaaaagaaaagaaaagaaaagagagagccgggcagtggtggcgcacgcctttaatcccagcacttgggaggcagaggcaggcgaatttctgagtttgaggccagcctggtctacagagggagttccaggacagccagggccacacaaagaaaccctgcctcgaaaaaaaaaaaaaaaaaaagcttcttcttcttcttcaggaaaacaccaaatggcggatgacgccggtgcatcgggagggccgggaggacccgggggcccaggattaggaggccgcgatggcttcctcggaggattcagcagtggtcttaggggccacggtcgtggccgaggccgcggggctcgtggaggtaaagctgaagacaagagtggatccccgtcaccaagctgggccgcctggttaaggacatgaagatcaagcccttggaggagatctacctgttctccctgcccattaaggagtctgagatcattgacttcttcctgggtgcgtccctaaaggatgagggtctgaaaatcatgccagtgcagaagcagattcgggctggccagcggaccaggttcaaggcttttgtcgctactggggactacagtggtcacgttaagagctccaaggaggttgccactgccatccgaggggccatcatcttggccaagctttccatcgtccctgtgcggagaggctacttggggaacaagattgacaagccccacactgttccatgcaaggtgataggccgctgtggctctgtgctggtgcgtctcatccctgcccccagaggcactggcactgtctctgctcctgtgcctaagaagctcctgatgatggccggtatagatgactgctacacttcagccagaggctgcactgccaccctgggcaactttgctaaggccacctttgatgccatctccaagacttacagctacctgacccccacctctggaaagagactgtcttcaccaagtctccttatcaggaattcactgatcacaccagagtctctgttcagaggacccaggctccagctgtggctactacataaggattttgtacaagaaaaataaaagaattaagtctgctaaaaaaaaattagaaaagagaaagaataaaggggttttgaaagcacacacatggggaagtgggggaaatgaggccacttggtgcactggctcacactagaggctccttaacaatttctccctctatcccaggaagcacttcagtaaatgagaacccctgacattagtgcggcctagcttaggggggcaggtaggggaaagaggtagcaacaggatgaggggaagagccgagctcgggactccagactcacacacgtggatgctcagaatcctgctctgcactgcagggctttctctctcgtgctggcttttcctcagcctaatgaaagctttcctttaccagcaatacacagacaaaagacaggcaaacttctgaaccaaccgtttccttctgcggggctttgacagtgatggcagatcacacaggggaaaggtacctcccctcaacaccgcaagatgaggaacctcaagctt

SEQ ID NO: 34976 - DNA, 1714 bp, Mus musculus
tgagatgttccgattgactgggagggcagcctaggacttggtccaggaggatgccagagatggtgttgccatggcacccacttcacctccacccctgttctctttctccaggtacctggtcaccgagggccagatcttcatcctcttcatcttcaccttcttcgccatgctggctctcgtcttgcaccagaagcgcaggcgcctcttcctggacagcaacggcctcttcctcttgtattccttcgcgctcaccctctcactggtggctctgtgggtggcttggctgtggaatgaccctgtactcagaaagaagtaccctggtgtcatctatgttcctgagccctgggccttctacacactccacgttagcagtcaacagtgaggcttactgggggcaccaggccatggtgtttgtacatgtgtgcatacatgcaccgtggtaatgtgaactatgcactggtggcagggatggacagagtgtgctgttgagagactcaactgttctggtcaggttctgagtttgtttttttcttttctttttttcccccctttggacttaagatggaatttagtttggggaagtatatgaaggccaagatcccggcccctgccctcccctgtatttcattactattagaggtgcctgaataacacccctatctctcaggactgggctggccttatggagatatcttctggtgacaagcgggtgagggctgctcagggcagaagcaggagactctgctacctgtccctgggccctaggtttctgggtcacaacttcttttgtgctttaaacagagcagttccatctctgggcttcttttgctgtggtgggctccatagtttatgtggctctggggactggtggttgctgattcccttagggagcggcagcacggaagagtggttcttttactgtgcccccgcccccaccctcagcctaggggtatgtttctcccagcctcttgtccaacttcacaccccatttatatgctgttgagaacccagtctccagggagccagaggcccccactcccagtctctctcagctaagctctctaagctggcctgggttctgagctacatggaaggcagagttctcaagcccttgttttatagtttcccccgaaaccccttgtaagggtctgagacaatacaagtcagactcttgagacagcacatctcagcctgaatctctcaccacctgcctggtgcctttgttcccagcatggtggctcctccccagcccacttcctcccaggcctcagatataggtctccttggcacaaggcgccaccacctcatttggcagccagcactgactgacctgtgctgtgagtcttggagacactccatgcatggccctgcctcttttctgctgttctcagggactttgcctcagtttccccttgtgatctttctgtgggttagcccatgctggggtaggggtggtgacaggggtgagaggcttaaataaaggctgttttgaagcccagcatgggccgtggctgtttctagctttgggaatgtggtggggaggcaagtgggcgttctgcactgagggagagacttgttggtctggggtcctaggctttcttttatggcagacctgagggacttctgccccccccccccgactcaacaccactcaatactgtgctccttagaggcgtctatgccagtgaagagaaatggagaccctccaggcccg

SEQ ID NO: 34977 - DNA, 1102 bp, Mus musculus
cttaagttatgagcctcgtctatcttactgcataccctttgttttcaagacagagcttgtgtgcgtgagtgcgtgcgcgcgtgcgcgcaagagcgcctgtgtacctgtatgtgctgttctgtcgtcactcgcccctcctcctcagtttgcatttggttattatcactcttgtgtgagcatctttctcaactctccctaggtgcatgttctccatcccagatcctctgtgatctgctgtctaccctctacgagtgtgtttcccagaagtgctggagcaaacgctgcttggatgcgcagtctgtgggcaggccctcgaatgacaatacacttctgttgattctaagtctgaattgccagtattctgtatgtaatccaaggctgtgagcacttgcattttggcaacagggtaacaagttttccttgaggatcttcataccaaaatgggatgtgaaagaacccccgtagccccgtggggtgtggagctggcagaggtcgttccgttccaccgaaagaaaagaaggaaggaaggaaggaaagaaagaatcggttatcctaaagttaacagtacagcacagcccacatgtggatccataccaaatctatctgataaatagttgaaactcaaaaataaccttagttattttggttttctgtctccgagtatacttcctttcttagccgtgttcttttttccttcacctttagtgaaagcatgacataggaagcctttttttttttaaattcaagaaccaattggtctcacctactctcaatagcagaatatgtaaatatattaaaatttgtttcaggaggtgattaagggtcaaaggaaggaaaaaatacttctcatacttgagagtccgcagagaagaaagcatgctctgacagtgggagatagatggcaactgatggaggatgcaggtgtaactgcagagagccagggcacaccatcaccagctcctgcactggcttttatgtcccaccttcatgttttcagagttgtggaaggaccatctttgtgtgtggtaaacttgttttcaagccttgcatccataacagaaggaccggtaggtattaatccaggtagaagtcatgatgactg

SEQ ID NO: 34978 - DNA, 1179 bp, Mus musculus
tatgtaagaacttttgttggtgtttgagagagggtctccctgctttcccttccttggtgctaagattacatgtgggagctactgcctccagctcagacttttttttttaattcttaaaatgtaaacaaagctagtgaatatataaataacagaccatgtgtgccccagagcctaaagtatttcctgtctgcttcttatagaaatgtttcttgattcttgtcattaatattaaacatttcagtttgaggaattgctaagtattaagaaaaagttttgagtacttttagagaaagtggggtgttgtttaggttagggtctaatacatcccaggttggcctggcattccatatgaagcagagtatgaccttgaattcttttttctttttaaagatttatttgttttatttatatgagtacattttagctgtcttcacatatatcattagagctcattacagatggttgtgagccaccatgtggttgctgggaattgaactcaggacctctggaagaacaattaatgctcttaaccaccgagccttctctccagcctaaccttgagttcttgatccttctgttgctacctctccctgaattaggggcatatgccatcagtcttttggagatttttttttgttagattttttttagtttattctttgagaaattcctatgtgtatacaatatattgggtcacatttaccctcttctccttcagctctccttggaccctccttagtatgcccctcctaacttcaggttctttttgtcagtttgtttgtttataatccactaaatctaattagtatttgtgcatggtgtggggccatattttgagagcattactgaaattctatcactgatagaggaagtatttggttttagttactttcacagaatttcccagaataaatgaagatacagaaggtattttcatatatgaattttattattatatttttgtgtgtgtccacttctgcatgcatacgtgacagcttatttacgaggttagagagttggttttctctaccatgcacattctcatgatcaaattaggctagaaggcaaatgcccttacatgctgagccatctttccagcctgacaaacagcatgaatacaccattttattatttttttaaaaattggctttagagctgggtggtgatgacacacgcctt

SEQ ID NO: 34979 - DNA, 1099 bp, Mus musculus
gtcattcattccagccgcgtgtgatctgacagtgcaagctgttagagcggtgctgggcatgctgggatggagcgttaggagcagtgagtttagcctgcactgcctggtacttgagtgttgctccccattgccaggtgaggcctccctcagagccagcctcagccttgttaaacaaggtgcagctcacacagctcacacagctcgcccatggtgggatttccttctaagcacccgccttctgggagccacagagccctcacacaacgcatgcgcctctggtgtcacctgcagtgcattgctcattcacagcacactaggctagctctcacttcccctaaaagctgcaagttaaaaactcatccccaaaacctctgaacttactatctgtgggtttcatggacagactaaaggtggggggtgggggttttgttggtttgctgtttaagtggtctgcttgttgttgtctttcctttgtttggtctctgatggtttgggagttcttgcagttagtcacaactgagaaagcttggagcaggctctagaaacagagactcatttacctgggtcatcattggctatggctggagagctcagctactaaaacaaagaagtagggtttcataaaagagatagccgtgtgtaagtgcatgtttgatgctgcagtgagttggtcacttataaataagacacctgcagatcatgtgtgcactcataaatgcatgtggatgtgtgtaagaaacacccctgaggaaggcagcactgtcatgaggacaaggcgcgtgagtgggcacttaccactgtgctaccctacctttataattaacaaatatattttttaaaagatttatttatttattatttatatgagtatactgaagctgtctacagacacacactagaagagggcatcagatcccattacagatggttgtgagccaccatgtggttgctgggaattgaactcaggacctctggaagagcagtcagtgctcttaaccgctgagccatctccccagcccaacaaatatatttttaagaaataaagaaaaacatactcacaggaagcaccgtcctgtacttaattttctcttgtactcac

SEQ ID NO: 34980 - DNA, 1148 bp, Mus musculus
aatttctgtgtcttatttgaaataacatttgccacctaaaacacaggtaatggtaccacgtgtcattttcacattgcttactccactaagacctgttaccagtgatgtctgggtgatttttctggtgtagtgtgtgtgtgtgtatgtgtgtgtgtgtgtgtgtgtgtgtgtgttcccatttccctttagttttactacttcttagatgggagccataatttagctacacatacaatgtaaactaatcctcttttatttatatgctttgtaaaaggttgcatttttttttttttatctagctgctctttccagagtgtggggccagggtgatggatgtatttcctgttgttgaaagccaaggtttgagtgtacttgcatttgaataggttttggcctgctttcagagaaaaaaccaaaaactttgtaataaatttgtcattcgaatttgggtggcctaggatgccatttcttcagtcttacatggtatgcatgtgctctttttgaaaacaaaccatgtcaatatgaagtcagtcactggagcttttctgatcccttttagatgtgaagccctccaacatgcttgtaaacacaggcggacaggtcaagctgtgtgactttggcgtgagcacacaggtaggtcttttttctcttcagcctgccctgtggattgaaaatcacctagcttacaaacaaacagggactgtgagtccgctcattggccggcaggcgttattcatttttaatctctgagcagtttccttcatcagaatatgattgttcattgtttaatgacagtaaaaactgctgatattgtaattactacttacgaatagcaaacttcattgctatgcagcttggctgcaaaagcgctctggccagacaaaagggaggacatcgagggagccgtgtctggggagcccaactggcccacaataaaaattaatattgggagcaacaatggtggagggccattacaatgtgctgcaccaattttaattaatttccattttgggcctcccctgaggaccccagtgatagtgacccatgcgcgtgctgtgatgttgatttgaatctcggccacctttcctcccagccaaacacgaagaccaaagcgaaggtcatctttgcattatgagttgtcaaagtct

SEQ ID NO: 34981 - DNA, 1197 bp, Mus musculus
ccaggaaacactagtctattttctgactgtatagattcaccttttctgggcaaaaatagagtcatgtaacatgaactgttgtgccttattctctctagttcctgtatcgtttttagttgatctatgttgtaacatttgtcagccatccactcctttttattgcagaagactattgatataccatatgggcataccatcatttatctattcatttcctaatagagggagggacattcataattgtgcatggcttgagattgttaggagtaatgttgctgctatttgtacacgtcttttttccttccttttctgtttgtttatgttggtggttttcatttttaaggtaggttctcaccagcgcttgttttgtagcccaggctggctgcatacttgaggctgacctcctaccgtagccttccaagtgtcagaattgtagacatgtgccaccctgtgcaacatgcatgcctttctaaggttctgtttggttttgttgaacagtcaccagggagtggaattagtatctgtttttaaatctctgcaatcactgccgttcagacagcctcggagcttaagaacttggtgtttgccactactgtacagtgtgcagtcagtgccactacctagggtttcatgctttgttaaagatagggtagcattgtggccaagatactccatggtcactaacaaggggcagggctgagacaggatctcacagttatccaagctggatttaaactcctaggctctagccatcttcctacctcaggtttctgagtaggtaggactacctgatttaataaccatatggcttatgtttaattttgaaagatactttagtttctattcagttatagacctctgtagaccaggggactgctgtggtcatcaacatgacccaagatccgatttgtaaattcttctattcctcctgttccaggtaatttttttcagttgtctaagcacttcacattattgatcagaagtgctgacagccatccatcactcctgcagatcacattgatgacatcatcatttaaaaaaaagtccagcccgtcgggaagccccgtctcattgagggactggggaaatattttgatgacagaatattatgatgtgactagataattgttggctcctctgtgaccccagcgaacagtacctgccattcttgaagaagcttgctttgagctggagttg

SEQ ID NO: 34982 - DNA, 1134 bp, Mus musculus
actttctgctagcatacaacctcatgtctaaagtatcattactcttatatgtcctcaatttttgtggggagaatgagtaaataggatgaggtttctggaaagtaccatatgcaaatgaagtaattctctgtgttggaactatataacaattatttgctgaaaattcaagaaggatgtagaatagtgtgatgtttaaagaagatttgtttattttgtgtatacaagtgctccattttcatgcacaccagaagaggaaatcagatcccattacagatggttgtgagtcaccatgtggtagctgggaattgaactcaggtcctctggaagggcagccaatgctcttaaccactgagccatctctccagcaacatttttgtttttatagtcaccagttttgggttagtcaacattgagttcattccacaaatatgttaaatatttaggggggttttgcagtcatgcaaatagtttgaactttataagattctctattagatatcgatttttaaagaaagattaggtgaagtcatgatatatttgatatgcagaatagctaggaggactattgaagggaggtagggagctgcagcagaactgtcattttcaaagtaaagttttaaaagcaatggagccctttttcagacaaaatctgtcacagaattctaacatataaagaaaattataaacacaatgtgtttatttctaaacatttataaaattaattttttaatagtagtttcataggtaaagtggcaccacaacagaatcacagctagtttgttgccttggttttgctgttcttgagtagggaggggagcactgggctttcagcactggtttgttgctgttgttttgtattgcaaaacagtgacaattaaactgccatttcgtttcctggattttctgctttggctctatattattcagaaaaatcctgatctttccagaaaaactaactttttaaaataaaagtagaattttttttttaatgatttaccttaaaggtgagcaatgcttctgttatttatatttttaaatggcagcagaagactaattatgagaactacacaaaattaacctaacatcagattaacaagtggtcagtttgcatatatacatatatatatatataac

SEQ ID NO: 34983 - DNA, 2007 bp, Mus musculus
taatgacttagccttaatccgctcatcctcttagcgtgcagtaagtgcaaagtggttaggaatttctgcagtcatctacttcccatggaggacttacataataaaattaatataccctcattctttcttttctctttgctctttcctgggtatttatcaaggtagcttccactcccctcccacccccactactgtctaatctagagctaatgaattttgtgtagcccagtgttaacagcacttgacaagtactggaagggcctgcagaattgcaaaacagaaaaaagaaggaaagccagtgatttaaataaggtcaccattgcctttgtaataatcattagagaagaaactctcccagtaattgtggggctctttagatccattgtagacggggaagcagccgaggccctgggtcatctggccctgggtcgtctcattaaataaactggccagtgtatcgggttctgtgccttccatggagtcactgtgttgtctatttagatatccttgggacagaagatgctgttgtggaagcaacttccagcgatgctgtgaggttttacccctggaccatcgataacaagtactattccgcagagatcaacctgtgcgtggtgccaagcaagttcctggtcactgctgagattgccgagtcagtccaggcgtttgtagtttactttgacagcacacaggtaagctctgtgatgccttcagtcagacattgtcatagctttctgcttctcctctgtgttctctgagttcctcagtgtgtctctttatttttgttcatttccaccccatagaaatcaggtcttgacagcgtctcctcgtggctccctctggcagaagcatggctagctgaggtgatgatcctggtctgtgatagagtgtgtgacgatggtgagaccttcctgcagatctgttttaaggtttatttactttgtgtgtatgcggacaccgttgctgtcttcaggacacaccagaagagggcctcggatcccattacagatggttgtgagccaccatgtggtcgctgggaattgaactcaggacctctggaagaacagtctctctggcccaatcttcctgcagatttacctttccatgaagatgggtccatccatgtgctctgctcaccgttactctctgatactcccacagtggccacgttagttgttttcagcatactttgaggctgcggtcattttcgttctgtagctttattttagatgcctttacaatgccattgacattcgggggaaacgttgaggtctgagtgtgttgaaggtcagttacttaacattcttttgtgtgttgttttaggaataaaccgacaacaggctcaagagtggtgcatcaaacatggctttgagttggtggaactcaacccagaggagctgcccgaggaggacggtgagtgtactgtctggagagagcagaacattggcttgacgtctaagattgtggtctaacctagggtgatcacagcaagagcctacaaatactaattttctccggcagtttgaaaagctttgagcaggacccattgctatgctgtgaccctcccagctctgccataggttttttgtttgtttgtttgtttgtttgtttgttttgctttggtttttttttttgttttgttttttgttttttttttcgagacagggtttctctgtatagccctggctgtcctggaactgtaggctaggctggcctcgaactcagaaatctgcctgtctctgcctcccgagtgctgggattaaaggcgtgcaccaccactgcctggcagctctgccatagtttgttcgatggattccatggcccattttagaacttttgaaaatgcaggtgtgtgcttaaataaatgaaagtaagaggtcactgctgaaaaccattgtcacctccctgttttctctactgccagccaaggatgatgaggcctgtgtgtgtgtgtggagtttatgttcctctttttaaattcatagcgagctaaggctgaatttctag

SEQ ID NO: 34984 - DNA, 2279 bp, Mus musculus
agtctgggtcaaaggctgctcgggggtttaatgtgtgtggttggaggggaaaagtgtagaagtgtagaccttagtcagtttggatgtggcatatgaagtgagctgaaggttagctgttaccaactaacctgacctttgtcacatgcttccctccacaggtggccaaagccttctggatggcaataggaggggaccgagatgagatcgagggcctttcttctgatgacgagcactaagctcttcctgctaggtttgactgactccagtgccagcaccgtgctccccaagtgcttcccttctcaacggggttctcttctgccaagattgccactagcacgctggccacctgactggtttttggggtcccttacctgagcttttagaaaggcgttagggagaaatctttgttcctgccgcataagtgactgaggagtgaaatgacagtgtggaaacccttcagatctacagtcttcgttttaagaacctgggtaaaatgaggctcggaaatgtgtaatacaggagaaccaagtgtcagagagcacactgtgacctcagcactgagggtctgaggccagcctgggctccatggggagttctgctgctgtgctcgattgccccgttcattctgtctgcaggtccggagcttgtgctatcggctgtgtactgtcactggtccccgccaagagcacagctctgacctaaggtgaatgctggtgacaagaaaggcagctgtagatgtaggatgtgcctaggggatagggaacaggtggctcatgggtttgtctcttagtaagtccttagtaagttcagtgtctgagttcctgccacaaagcagcaaaagccaggtgtgtctctataagaaacagaggtgaaagtttcctcctctggggaatgtaaactcccctctccccactgctgggcaagggccctgagtgccctcctgaggacccagggagcagcagtgttggttctgagcacactgctgacactggcagctgtgctcttcgaccactgagtgttctccctggcaatgtgaggtttcagagcaggtctccccttctttctgcttggaagccagaggttgctgtcaaggcaccagttccaagcagtggggggataggtgagcctcccgacagccaggtcctgagccaccatcatggttcacttccagggctattggcttctccatactccagggcccagccccaggggagcacagagcaaagttctaaaggaaaagaggggaaaaggtctaaaagtgcgtagtctgtcatcacagacacttctgtgaggcaggcttgagtcccctgcattgtcatgggtctctaaggatatgcagccatgtacatggtactcatcgtgggctgagagctggcctgacttagtgtcaaccatgacttaggtcatgaccagaaacaagacgcgcctgcttgggtaccacttacaggacctgaaacatgcttagccaggccagaaccaacccagggaggaggcatgatcctggtgatggtggtattctagaaacagtgggtgctgctttgctccgggttcctgggttcccactccccacattctgatcttgtaagctttgagcttgggtttaccaccagcctttcagggggactaatactttaatgtgagtgcattcgctactggttaagaagggaaattagggaagtcggctgtgggttgccagaaaggtagaacttgtttttcttaaaatatggaagattttagaaaatatattaggtcacatgattagggaaaaaatagactagaaaaggctgtggacttgattttgctgactaaacaaacccaagtaattaaaagatgacttatttataaagtctgctaatgtgttttgttctgtttgggaagaggtgtgagttggtggaagcctggtgtcttttgtagtagacatacagtccgaagagtttgttgcctgtaatgtttcagaatctactttgcctatatattcctgagctggtgctgtggtgataggtgttgtctaacttatgtgcacataagttagagttccggggggactgaaggtaagaaactggttttctgccttaaatacttcttgtttctgtaacaaagtgcttggcacatagtaggtccacaatttttgttgacaagtacaatctgcttggtggaaatgatcacagagtctgaagatccatgagttctagaaatgagagagagagagagagaatatgaatatgagagtcaaatttttcttccctgaaacaatcatattatgtaatgatttcaaagtg

SEQ ID NO: 34985 - DNA, 1229 bp, Mus musculus
tccccaacttgcttctcagagctgggatgtattccagagcctgatgtttttattcaaaccacagaaaagttttctttaagtagcctgtgcagtcatgcatgtgcctgagttgtctggagcagaggcaaacatctgacttcattcttagccccaagctgccatttctgagtccttgagaggctgagaaggctctagctttgtactgtattcttactgtgtgactagatgcgtgagcgctttacattagaaggaacctggttagagctcgctcctcctgtctttgtgtggcatttgtgttccattaccggcccctttaagtaacggccttcacagcaccttcccagtgggtagaaagccacacaccaggatgtgggtcaaccatgaagatgtggcattgcagacgggggaacatgtggatgcatggctatcgccctgaacagtccctgcagctacttgtgttaacacagaactgatgtttagcattctgccgctttcgtatttatgtaacaattccttaaagccattcaaatggctaactatttaatttctttaggacagttgtaaaggtctctctcctgaggacaatgacttggaagaactggggcacagccagtcccagacactggtggaggctgcagtgactttttttggctcaagatccacaagcattagagtagactgggccaacaagtcaacaagtggtggcgtgtgcaaacgggctgccctagtcaagcccagtcccttcaacagtatgtctgatgcaccacaggccctccctactggaagtgggaacttcaaatggaaattggagccatcttttatcccagaagcctttgctgctgccagggcaagtgggctggtgtggactcttgtttaggaggctgaggttcttgtcactccttagccagccaggcctttagtgtctttgtaaaaagcatgtatttatagtgttttagatttttctaacttttgtatcttacagcattgtaccccattgttaaagagccgtgtcccctcttcttataaacgcccttctaataaacttttcaccgtaaagctcctgagacaggagcacagtctgattccctgctgctgtctctggggaaagggatttacaaggggaccccagcaggtcctgggggcttcagagctcagcaggtgctgataccacaacactgaagtaatacctgcccttaacaagggtaccctataggacgccctgggttccc

SEQ ID NO: 34986 - DNA, 1283 bp, Mus musculus
acctagctatggtaaaggattgccacagcaaactgtgacactgtgtaatgagcactgttcccagcggcaattacagagaaaacgagtgtaaattatttcaactggaaaaaagtccctttcttggctgttttagaacagggtacacaggatcgccacctgcaactggtactcgcttcttggctgctgcttctgttgtgaaaagacgagcccatgtttctgcatggatttcccatggaagtcctgtcctgctacagaggggaagaaagtgtaccctccaatgtgataaatcttctgatgcccccagactcttggagcacatcctggtgcccctcctgcaggagcctgtggcatatttccagctgggcatgctgatcctccttgagacacagatgcctgtgtgagtctccgttgatacaattctgaacccctcaggttctctgaaagggcacagaccatgggcgtgaacattgtgccgtacctgagatggtctgtggactgctgcttcagacacacgagtcctcggaactgcctggctgcctgtcacgcatgctctgagtcagaacacaccaacgctctgctgtggctcctagggaagcattcatggtcctctgttatcagcaggggtttatgtcacttgctgtccggtttcctaggggcttcctgtgccccttccccagctatcctccaggtggctagggacagtctattctgctgcaactggaaagtagagggaaccggcactgctcagagcagatggcggcttctggaggcacacagtgggagtacaccccttcatgttattggccagttgctggagaatgctgtaggagaaaattctaggcaggtctactcttggcatccctgagagtcaaaggcttggagtctaggaaaggtcacaccatgatggagaacacaggtcatttgggtacgtgtaatcaaagtgccctcccaaatcagttctccttttcgtatgaacagcatctctacttttaaagaggagttgaggatcgagaagatgacagtgcagcagtgggtgtggcctgactacatgtgctgttccagccctgggtgcccactgacaccgacccccaggcagaggcctttgtcttcagcactcctgagaagttggctctttaccccttctcctctgctgcccctccttcctgctggttcaggtagccccagccacgtgggttagagtcctgtgctggcctgccatggcagctggctaccttccagaccaactgtagagatacctggcattttgaagaaagcctagactg

SEQ ID NO: 34987 - DNA, 1211 bp, Mus musculus
actgagccagacctgctctcaatgggtcgggagggcccagactagcccggcttctgtgctttgacctcaagtcctatggttataccccctgtgcagatctttgcccatcgcctgcttcagttcaggggaaagttgatgtgcccccctctcctcccctctgcttctgccaactggaatcttttgcacatgtttttaataggcaccccttaatccgagtgtcgccttctgggttttattctgttttcctttccttaaacaaaacagagagcctgtgccagcttggagcagggcttggaactgaagccagccaatgtgttaggctggcctggggccagtggagaattgagtgccccatgccatttgagaagcctgcctgacaccatgctggtagaggtgggggccctgatggctggggctggaggcttcatgtctccagcattttggttctgggagggtattagcagggactgggcaggctagttgaaactgggctatgtggagtcaaaaatctaatcgaacactccaggtgattggaagccttggtcgacagagcaaactcgtgctcctcagagaatcagctgatgcagtgttgctctgagaggagtcttgagtagcaggtcttcagggtcggtgtaaactgcatcggcatctgttgggaaactttgaaacctggggcgtgctcactccagggaatggcaaggtggccggagcagctaagcccatgttggctggatctcgaagcacactttgttcaaaccttggtagatccgaaagcagagagtggaaccagaactcagggaaggctgtaacccccaaggcctgcttccaaagggacctacatctgccagcttggccctgtgtcacaaaggtttcataacctccttagacagtaccaccagctggggaccaagtattcgaacgtatgagcttatagggtgcattacaggaccaaaccacaactatggcccctttctgttcggtcttttaggaagctcagagtcgagctgtcagtatctgataccacatacttataccagtggtagttctcctctcgccagagtcgtgacttttgcaagaaaagaattgcatatggggcaggggcagggctaccactataggaagatagagtaattatacttttttgctttgtacctgctatggctggaatgcctgaaggaccatctagggctgatagtggaaatggagggaga

SEQ ID NO: 34988 - DNA, 1212 bp, Mus musculus
tctctccagccccagaaactgtttaaaaaagaaggtgggtcgcttctgagtaacaacacttggagttgacctctggcctcccaccatactcatgtgtacatgtgcatacacgtactcatgtatacatgtactcatgtatacacacatgcaccagtaggaaccacatgtgtggtatatacatgtgtgtgtatgcacacacacaatgactagggggcgagaggaagagaggggagagaggagagacggggacagagagaggagagagagaggaaagggagagagaatctaagaatctagtaccttcagagaaaatgaaatctttgagaagagattagatggtacattttgggaatatttccagaaaagaaagggacttctctgtccttgggagtgtaagatacctttatacccagtcacaccccctggataggctatgccggtcagcaagcaggtcccatagattgagagccttgcctgtgtctgctgaaatagaaagtgtgaagttctgcatatgatttcagctttcatgtggccttgaacccctcactactgtatgcccaagtgaaggcatctgaagagctgggcagacgtccaagggcagccgggaaggctggtagccagatgaccctgactttgacaaaggtgggaacccaagcctggccttaaagagccagaaacttcatcttggaagtctggaaattgagatggctggctcccactgactagcaagaagctgagggacaagtcaaaccaggagtcgaccactgcaaagcacaggtactgtgaatttaccctcgtgtgctacatcatgatgtttggctaaggagaagctgtatgcataacagctgtcctcaaagattataatggagctgaaaagaagtcccatcattggttatgttatggctgtcatagcacactctcgagcacacacacacatgtcaggtgatatagatgtggaaacacctgagtctcatgcctgtagaataaaaacagagcacatacaatcctacccagagaataatagtgttctaccggtttacatatttattatatttttattattttagaacatacttcctaatgatttggagcctcatttgtgaggtttgggaacagggatgctggcttccacagaccagcaagtatctgaaacaccaatcaagccatgattacaaatcagaccacaagctttttcactgaggtgcactggag

SEQ ID NO: 34989 - DNA, 1794 bp, Mus musculus
aatccactatcctatgctcaggctggcctggctctttctagtgattctcctgcttcagcctctgagtgctgagatgggaggcaggtgccaccatgtccagctcatggactctatgctatgcacacactatgatgccagtgtgcctgttgtcctgggctggaggtcccaggccttgtgcacacgggttcttgctagatcctggatctaatcacaggctagttgactgaagagaactcacagacaaatgagtatttgcttgatctaaagaactgctggcggtggcaacggcaccattacagttaagggcattacaggctacccttaacttgcccttgggggagcattttggggggagtacattgcattcactcttaggagcttttgcacagcctaggatagaagcctgggcagctctgatttgagtatcagccaggtctgttgtccttgtggctgttaggagtgtgggctatgtggaggctgaaatcctggatcggtcgggtccttctgtttactctttgcttattctagagcaggtcgtcaaagtctttggaagccccagtttccctatataaaatgaagataatggtaactaccaccgagggtggtcacgaggatgaaccaggtcaccaggtctgtcccttcctccgtaaaacctcagtttccttatctgtgagatggggtgaggatgggtaggcccaccttacagggtgagactgagccgacattatgtaagtagttgctgcagtcgtggggaagaaggctgaggaaaaagatggcgttgtgctggtgtgcactcagagccccagctccaagttttaacttctgagcctctgaatgtgtctgaggggctgctatcccagccccctaagcagctctccaagctgttctttagaaactgctagaatgaagacaaatagcagcggttgaaacatgacgctctagagtcatctgagatctcagcctctgtccctgtcagtgccttgaactgtccctccctcaggaaagcctcagtttctttatctgtggaatggagtgaggatgggtaagccttcctcatggggtgagatttagctgactatgtggagagaaagccttcaggggagctgggatacgagagggatgaatgcgcatcaggtacatgggcaggagagattgcttagttggtaaagtacgtgtcacacaaggtcgaggaccggagtttgatccctagagctctcctaagaagacaggtgtggggctgtgcacttgaaatcccagcactggagaagtggaaacagccagccagcctcgccccaggccagtgccattgagagagcctgtcttagaagacacagtagataagctcctgggagaccacacctggtattgacctctgatatctatatctgcatatatgtgtacacacacacacacacacacacacacacacaccatgaaccatacaacatacaaaagtagttaaaaaaataaagtatatatgaaaataccataataaagcttattgatttaaaaaagcatatctgaataccgatactgggaactctgtgataaaccttcagtatctcaaattagttgcagcacccgggaggtgaggcagtgctaggactgcctggcttcccctgatcaggtcaggaaggaaggaagaaggaggagggagagagaaagctgatgggtttggccttgtcccctggcccgagccacaatggcaggttttggggcctcaggaagggaacagccctgtggttgcagggccagcgtcagctgtggggagggagcggccagagtgagtagcgg

SEQ ID NO: 34990 - DNA, 1206 bp, Mus musculus
aactgggcagatgctctgctgacggtggtaatatgttgggactatgagttggcagggctaattggagctggttccccataggacacaagggagatacttgtgactatttccttgccttccatagcctctgggaccaatggaaggcttgactggcatactttagtgaggctggttagtgccatcctattggaggtcttcctcagtggccgaggataccacggctcagagatggcaagcatttcacctggggtgagtcaggcgaagaatctgacccccgatcacgttatttctggtcctcagctattcaggcacctccccttcagtgttccaagctctggcccatccatcctttggcaaggctttggacaccaaaaccttttgaggcagcctacacactggcttatggggatgggcctagaaaagccatcctgagccctggacaggttagggcatgcaacttcagaccttggcactatctgaattgtagtcagaggtgacattaagatgtgaggtgaagatgacattcattgtgactcccgctcagcctgcacctggagtcaatcaggcactgtcccctcagctgctgtccttggacaaggttgcaggtatttacctggctgccttctaaggccgactcagcatagaagcctcatgcttggctcaaaattgctgcccttcggagagggccgtggcagggtggggcgatgtgatagcggggaggccagggcctgctctagcaggtcctaatgactctaaataaccatgttacaggcagggccttgaacttaataaacacacgttacttctcatgcagccacaaccatcagagctcgtaattacctgcgatctgccgcagcacaggctgcactagagcaggcagggatgtgaccacatgtctctattgcagccctcaggacccatgcttcaaccttttttaaaaatcttagcaggttgtggctgccttggttggccacagcaatgtggactcagagttgctgtcattttctctgcagttaagtatctgtgtgttttgaccatacctggtagctccaacttctgagacggcagaggtacttcgtgtaggagatacttggtgtgtggtggcaggtccagaggaatcaccctgaacctggctggctgagtagaccaaaggcaggtcatgtgacttctttgagccttgattccctccattaggaaagtatttta

SEQ ID NO: 34991 - DNA, 1221 bp, Mus musculus
gtaccttcagcctgtgcgtagacctcgggctttggaagcagggtgtgtgtttgccggttctttggcagcactgcggactgaacccagggcttcctgcatgttgggccaacgctctgctactgagctaccctcccagtcctgggattgttttctttcatcttttctcaactagagagacccggttgcttgggtggatccagacaaaggtggatttccatccctggattttgtgcccacgcctctgggtcaccctgtctcccttggcaacagctgctgctgttttggccatgggcagaaagctaaaggccacgtcttggggaggcgactagttggctatgtgctcgtgctagccctgtgtctgctaagcccctatgtgctcgtgctagccctgtgtctgctaagccccgggcttgtgtgttgcttgtcacattgctgcctttgagaactagggctttggaaagcagacaaaggaaagtgtgtgacttagtcacccgcttcgagtggggcgggacactgggtgcctcagtacattctgtcagatctggagccgggctgtgaggactctccgtctgagatgtggaaccttttggctgtggtagctattggccacatgctggcttcttctttcccccgggctctaggcacattcagtgaccgggagagctggagtgccccaggcttgcttgccttcacagagatgaggtgtaggagtttcattttaagccacagagtggagagcagggcatctctgatctggcaggggtggggcagagctcaggcaagttccatgccagcagcccactcccacctgcttgagcggctgagaggagacacaggtgtctccctctctagttcctaaagggaagttgaagcacctgcctttgagagagacaggcctgccgcgggggagagccagtattggaccaagctgaaggcatctctggtttagaagggatcttgggcattgttgcatagcaccaaatccagagagggggaaaaaaaaatcaagaagtgaagtaggtcttacaggaagcaccccaccaccacctttgtccactccctttgtagtatgacctcctcctggggccaccagggactttgctaggctaccctcaactggtagggagaggaagagtatcttcattgtaacagctttctccagcttctggggacagaaacaccaaggcttttgacaatgccaggtaggtctctggccaacct

SEQ ID NO: 34992 - DNA, 1196 bp, Mus musculus
ttggggtaaagtcctggactgaggggtctgaatcacattccagtttggcctctgtgaaccttgggcaggtcatgatgaccttgcagatggggtcttctaagattgctacacttgcttggtagattgtgcttgttggtgtttatctctcctagttgttgtaaaattatagtggacaggagctggatgtggttcatatctttgtgtcccaggggctagcacacagtaggcactctggtttgcatactgtagattcatcatcctatgtggggcggaatgagatggtaaagatgcttgttgccaaacttgaagaggtttgattctcagtgcgctctcaccgcgccccccccccccattaaaacgtattttttgagagagagaaattcccactgtgtgctaaattatttggcagcctggcacacagtggttgctcacatactggttgatcttggaaaactttgcccagcctccccccctctcccccagcaataaccttgccatatcctatgcttgcgttgcagatgccagcatgtctccggatgccaccaagccgagccactggtgcagcgtggcgtactgggagcaccggacacgcgtgggccgcctctatgcggtgtacgaccaggctgtcagcattttctacgacctacctcagggcagcggcttctgcctgggccagctcaacctggagcagcgcagtgagtcggtgcggcgcacgcgcagcaagatcggttttggcatactgctcagcaaggagccagacggcgtgtgggcctacaaccggggcgagcaccccatcttcgtcaactccccgacgctggatgcgcccggaggccgcgccctggtcgtgcgcaaggtgccaccgggttactccatcaaggtgttcgactttgagcgctcagggctgctgcagcacgcagacgccgctcacggcccctacgacccgcacagtgtgcgcatcagcttcgccaagggctggggaccctgctactcgcgacagttcatcacctcctgcccctgttggctggagatcctactcaacaaccacagatagcaatgcggctgccactgtgccgcagcgtcccccaacctctggggggccagcgcccagagacaccaccccagggacaacctcgccctccccccagatatcatctacctagatttaatataaagttttatatattatatggaaatat

SEQ ID NO: 34993 - DNA, 1614 bp, Mus musculus
aaaaaaactttgtttggtttgccaccatagcgtggtattgcagagtccctttgctagccacaatgcagtacctgtcactcatagtctccctcaggaggcacatgtcctgcccacttgctgctcacctgcttagctaatagtctgaagcctgaaaggggtttagactgatagtgtccataagatatggcagtgctcagtgacagtcatttgtacattaaagtaatttttccagaaaatgaaaaatcatcaagttataaatctatacacatgttcctaattttgaaaaatgaggtgtgtgaatgataggtagcaaatattaactctgacttcaggagagttgagactacaggtttctttcattttatttatgcttatttttattttcttaaatcacagcacaaaacaaaaagggggaaaagagtgagttaattttcagagcctgaaaaatagacatcacgtgaacttctgcagcagaaaagaagagtgatcctgaagagatgctttgacagatgaaggtggagaggagatcccgtctcagccacgtctcctgaggagaagtgtcagcatcagggcagcagtgaggatggagagggcgcagactgtggggaccacaatctctgaagccacgtgcatgtgcctaagcaagggctctgaaagggacagatacatccaccagaagtgagctgtgttttgaaacaaaagctaaaggagatgggccactgcgtttctaatttttcttatttgttgtaaaagtgaaccagtaaatcaaacattattttgaaatggagttttggagccatgggacaaaggcatcatgttcacttggtatgcacacagcttttgggaatccttaccatcacacaaaacttacatcagtgctggaaatgtaacagaaaatctggggatgcctgactttggttatttccctggtattttattaagcttgagtatggttaatatttatgctggcgttgcattaatctcaaaagattagcacctatattccatggattctctcggctttagtccaaatatttttaactgggcatggcagtacacacctttaatcccagcactgaggaggcagaggcggcctggtctacagagcaagttccagaaaaaccacagctacacagagaaaccctgtctcaaaaggaaagacaaaaagaatccctgggaaacattttcagctttttcagtttgttattctcaatatacttatatcctcatatattacaatttctaatggtaattctaatacttatttctttgtaaacacaaaaattcactaaaatgttaaattatttgataattgttgcctggtttaatctttgagagcaaagtgttatatccaccaatccaatggaagaccttcatgggactgatttgtctgctgagccctctggtaacaggtaaacaggcatggatatgttctcatgcagctcacaggctggtcagcaaatgctcattacaaccatgttgcagttacttacatttggtgagttatggtttataatctgtagactatggcctacttatttatgcatgtggggacactggtgcatggacatacaaagtacaaaaggtagctcaggtgagggggtttctgcacca

SEQ ID NO: 34994 - DNA, 1101 bp, Mus musculus
ttactgagtaccaccacacttggtttgcacagtgtttctctattactgcttatttatatatatgatttatttttcgtttatgttcattagtgttttgcctgcatgtatggctgtgtgagggtgtcaaaagccctggaattggattagagatatgtgagctgaatgtgggtgctgggaattaaacccttctcttctggaaagagcatccagtattcttaactcctgagccatctctccagccctagactattactgcttttaaaaaaaattgtttttctttgacatgtgtgtatgtttttctctccccctttcttgactgtacttctccagctcagggattgtggcctatttatatccgtactcagtgcttgtcacacgtggatttcactggatgacaggaaggaaggaaggaaggaaggaaggaaggaaggaaggaaggaaggaaggaaggaaggaaggaaggaaggaagagctactgtttggttattagtagtttacttattcattttaattttcttttggtatttttttcttcagtgagaagccgcagaaatggagagtggagctcagcaatagtcagaagagggtgaaaacagtgtggcaactgagtgacagctcccctgtagaccattccagtttccacaggcctggtaaagatgctatgtagtcattaaatctttatgggaggaatcattgttgcaggtctttccctgaactgtaggtataaaacagactttaaaagaaaatctgacttttgtgccattgtgagttttagaaaaattcaaagtataataatcacttgtgagtgctttttcttattatcctggataaaaagaacctttgctggggctggctcagtggttaagagcactgactgcttttccagaggtcctgagttcaattcccagcaaccacatggtggctcacaaccatctgtaatgggatctgattctgtcttcaaggcatcaggagcttaaaacaagcagccaattgtacttgctcacagtcaggaagcagagtgcatgggttgctgagttcccttcctccactcacaccatccaatacggtgggtcggcccacgtcacttaacataagaacatc

SEQ ID NO: 34995 - DNA, 1167 bp, Mus musculus
cttccttccttcctttctttgttatctcatgtcctgtagctgataaaaattactctgaagatctggaaaatttaaaaacttcacacaagaaaagacatcacgtgtctgctgtgagtatttgtcttactagctacttacacggtgtttagttgatctgaagtccacgcttaacagctctcttctttctctcactatgactagatgtttctctgtcgtgtcagagtatttgtctttattcttatatcagccagggcagagttatcccctgctctctggggggttggttgtaggaccatgctcagtcctcagatatgggactcacatgctttatatgtgctccctcttttggctaatgtttgtggcttaaaagaattgtcttttttttttttttttctcattttgatgatagggtttttttttcccctttggggacagaagtcaaggtgattttgataatggtttggtttgaagctgatgctgtgctctcctgtgccctgtcttcaggtgacagccagaggctttgcccagtatgagctctttaagtctgacgacttggatgacactgttgccccatcacaaactacagtcacgctggacctttcctggagccctgtggatgagatgctccaaacccctcccctgtcttcaactgcagctctggtaggaatggaccctgtcttctcttaggttgctcaggctcctgagtggcacattacgtgtttcttgctagtgctgtatgtacactttcagccttgacattcactgggtgttaggctgtaccacacagaaaatcttggctgacttccgaggtctcaccagacaactaatggagattgccaagtaagctgagctgtcagtcgcttacagtcctgttactatggagctttacttttaagagatgattgcagtctcttttcctggtgacttaagagaagtcaagccaggcgtggtggcacacgcctttaatcccattactcaggaggcagagccaagaggatctcttgagaatttgaggccagcctagtctacatagttccaagacagccagagctacatcccgagaccctgtcttaaaacaaaacaaacaaacaaaaacctctttaagctctttcctttcttactctctagcccgccttctctcttttccttccccctctctccacgtgg

SEQ ID NO: 34996 - DNA, 1185 bp, Mus musculus
aaggaccttgttcctgaataaacaaggtaaaattgaggactgagtactcgacgctcatatcacagaaacaggttgttccatttgggaaatgaaagatacttacatatctgggcatctcccaagggtctcctgtgatgtttacctttagctcatcaatactgagcttgttacagcacttttcttccatcatcagattctccctttacaggaagcaactacagtctttgagggctgaaagatggctcggtggttcggtggtgaagagcacctgcttctcttgcaaaggactcggtttggtttgcagcatccacatagcagctcactattgcctgtaactctagtgccagtgatcgtaactgctgagccatctctccaaccttctgtgtagttattttctaacacaaaagataattgactcttacatcttattaagtaatctaaaacattttttaaaggttttggagaaggaagaaacaagtcaagttgaagaactgcagtctgaagaaactgctatttctgatctctctgctggtgaaaatattaggccactggccttacctgttgggagagcaaggtaagttaagttggtttttttgtttgttttgttttttgttttttcgagagagtttctctatgtaaccatggctgtcctggaactcactctgtagaccaggctggcctacctctgcctcccaagtgctggaattaaaggtgtgtgccaccacttctcggtagttaagttggttttttgtttgttttgtttttgtaagtgtagagttagggatagagaatgggatttgataggatttgagttggaaacattgttggggctgaggatgtaagttgtgtgtgtgtgtgtgtgtgtgtgtgtgtgtgtgtgtgtgtgtgtgtgtgtgtgtttaaacaagatttctctgtgtaaccctggctctcctagatctcactttgtagataatgctggcctcaaactcacagagatccacctgtctgcttcctgagtgctgggatcaaggtgtaggccaactttccccagcatgcttgtctcacatgagttctggagatggaactcaggttcttaagcttgcaaggcagacactatcaactgagctgtctccctagcccctagcatttcttgtttttttttttttcttcatgcctttcatatcaccctaagattttaagatt

SEQ ID NO: 34997 - DNA, 3262 bp, Mus musculus
acctggcgtcgttggcaccgcagagtgaatacaacccaaaaacgatatgccatctgttctgccctggctgcctcggccttaccagctttggtgatgtctaaaggtctgatgctttgatatgtgacatttagttttaacttgtacctaagtaaattgctttcatgaattctgtttctctctgcctgctaaagtcacttatgcttacatcaacatagtaggctcttatcacattcttataatgttcttgactgtcaaaatgatgaaattccacttaatggtccgtgtttctgaaacgcatgatattagtggaaattctgatttggcgcaaattgcatgatggtttattttgaggtgtggtgcaaagtgagacatctgccactgaaagcagagacagtatcttttgagttctggaacagtgtttctggggggaaagatgagactttgctgttaagtattaaattggttttgttaggtcatcgtattgaggaggttcctgagctgccgctggtggttgaagataaggttgaaggttacaagaagaccaaggaggctgttcagctgctcaagaaactcaaagcttggaatgacatcaaaaaggtaagctcaccatatacactgatcttccatactggcagatttggattcaaaggataagttgaggtttaatgggtgggtggcttcagtttttattggatatagaaacttcctttcaaagagccaaagtagcaaagataggggtggttgcgttaacccaagttccctataggtaacctatccagtgtagatggcgttttgtagtatttaaaggaagatggacatgtaaatacttttttggtgtttcgagacagggtttctctgtgtagccttggctgtcctggaactcactctgtagaccaggctggcctcaaactcaagaaatctgcctgcctctgcctcctgagttctgggattaaaggtgtgtgccaccactgcctggctgtaaatacattggagagaagtcttgctgtcttttggggggggtacagaaagggcttttgggcttgcaatgatgttgtaatttgcgtcttactctgttttcagtgacagttgcctgctgtcagtaagctgaatcagaaggttgacgaaaattattgctgagcagctcaaaactttaactgagatttgagacttgaaatggtaacagaaagttgtgaatttcatggataaaagtgtcaggtgtggctgctgaaagttgctttgcctgctgagacagtttttcgttttgctaagattgaggatgtgggaagtcttgatcagaatactaaagctacttactttataggtctatgcctctcagagaatgagagctggcaagggcaaaatgagaaaccgacggcggatccagcgcagggggccctgcatcatctataatgaagataatggtatcatcaaggccttccgcaacatccctggtaaatccttgcacgtggtttaactgcctattctgtgcaggctcacttagcttggttatgatgaaattccacttcatggtccgtgtttctgaaataacatgatattgtggaagttctgagtcctacgtgagtgagctacgccagccatgatggcttgagcttctaagtgccctaggtagcttgaggagccatagaagttgtatttctcctgttgggcatgcaggcttcctgattctgcttcctcttaaaggtattactctgcttaatgtaagcaagctgaacattttgaaactggctcctggtgggcatgtgggccgtttctgcatctggacggagagtgctttccggaagttggatgagctgtatggcacttggcggaaggctgcttccctcaagagtaactataagtgagttttcccttatttattacacgtcaatgactaatgtgtgcactaacatcctccataagttctgcattcacattttgtttgcgttttccattgtttggatgtgcctcacctgtgattattaaatgaagatgtaaaggtttattctgtatctggagagttgaaacatttaaattaaaatttgtactgctttgtgttcagttagagaatgagactttggacttctctcttccttccccccagcctgcccatgcacaagatgatgaacaccgaccttagcagaatcttgaaaagcccagaaatccaaagagccctccgagcaccacggtagagttttaaaacttaaggtctaacacttgatacgaccccttgactattaaagggatacatgttgattaatgaatgctacctcttgatagcaagaagattcatcgcagagtcttgaagaagaatccactgaagaacctgagaatcatgttgaagctgaacccttacgccaagactatgcgcaggaataccattcttcgccaggccagaaatgtaagtcagtttggcgtgtcaattttttttttttattagattgcccccttccaagacaggaacttactatgaagacgctggcgccccccccccccccaaccacacacacttgtttctacctccccaggtactggggttaaagatgtgaaccacgatgcgctcattgaagataagattcttaattttctatttgtttttgttgcagcacaaacttcgtgtgaaaaagctggaagcagcagctactgcactggcaaccaaatccgagaaggttgttccagagaaggggactgcagacaagaagccagcggtaggcaagaaaggaaagaaggtggatgccaagaagcagaagcctgcagggaaaaaggtggttgccaagaaaccagcagagaagaagcctactacagaagaaaagaagccagctgcataaactattaaaaattgttaaattccagagagcaagtagagaccgcatatttcaataaatcaaacatgtggtgacaaacccttgtgtgactcttaaattgtggatgtttccaagccccttgaaattaaccttttgaagaacaagtggcaagatgtgagacttcatggtcaaacttaggtcatcagaattatagaacaaaattttttaaataaaatttcattctctaggctgctttgttccacatggtagtctactttataaactgaacttgggataaatagctaggggccaagtcctatgaatagtgtgtagttatggtagccactagagggcctatgatggtaaaagggaatggcgggaccaccacagctatggccactgtgtctgtagaggtgcagtgttctttgtatgaatcagtctgatcatcctagaattatcat

SEQ ID NO: 34998 - DNA, 1441 bp, Mus musculus
cggtccccaggccacctcgcttttccttcttggccatttttaacagaatcccctttccttgtttcctgcacaggtacatgctttcatcaaaagatctgacgccgaggaggtagacttcgcaggctggctctgctccaccattgggcttaaccagcccagcacaccaacccacgctgccagcatctgagcctttaggaagcagcaaagaggaattctctgcccagtggcatgccatgttgctttcaggcctctcccatgcttgtctatgttcagacgtgcatctcatctgtgacaaaggatgaagaacacagcatgtgccaaattgtacttgtgtcatttttaatatcattgtctttatcactatggttactcccctaagtggattggctttgtgcttggggctatttgtctgttcatcaaacacatgccaggctgaactacagtgaaaccctagtgacctgggtggtcgttcttactgatgtttgcactgctgttcatcgtgactcactagctggctgcctgtattgtcaggattctcggaccttggtacttcactcttgctggtgacctctcagtctgagagggagccttgtgagacccttcacaggcagtgcatgcatggaaagcatgctttgctgctactgaaatgagcatcagaacgtgtacgtcatggtatttttattttttgcttttggtatagaactcagcaattcccatcaaaaaaacctaagcagagcccatcactgccatgatagctgggcttcagtctgtctactgtggtgatttttagacttctggttgtatttctatatttatttttaaatatacagtgtgggatacttagtggtgtgtgtctctaagtttggattagtgtttctaaattggtggttattttgaatgtcacaaatggattaaagcatcaatgtatcaagagttctatctttcttccagtctaagtaccaatgctattgtaaacaacgtgtatagtgcctacaaattgtatgaaaccccttttaaccactttaatcaagatgtttatcaaatctaatctcttattctaataaaaatactatcaagttaaaataaaagggacaagagatttctgcttttgtggcacacctttcaatttctctagactacaagaaatgaaatgattgtagtggtttaactagatatgacccccatagactcatgtgtttgaatgcttggcccatagggagtggtacttgttggaggaaatttgccacggtggggtgggggtgagttttgaggtctctcatatgcctaggctatgcccagtgaagaacacaacctctgggtcaagatgtagaagtcctggctccttcagtactgtgtctgcctgcatgatgccatgcttcccacgataatggactagacctcttaaactaagccagccccaattaaatgttttctcttataa

SEQ ID NO: 34999 - DNA, 1112 bp, Mus musculus
tcttacactacacttcctgtacacctgagtacctacactcagagggtccagagctaaaacacagccttctataggagagtgaacaggctgaggggaataggtttgttctgtcagagtggtagaatacttgaagtactcccaataaggtgagccaggaggagttagaggtcccaagccactttcctggaactgatgagggcagcagaggccagaggcaaggtgggtgtgatggagaggtgatggagcaggaatcaagagtttctcacatgttgacatgtttgcagcctcctccaaaactgcccagtggagtattcagtctggagtttcaggattttgtgaataaatggtaagtttgtaccatgttctaagactccacccccctccccctgcccttaccctatcccctattaaccttggctgctgccatacctcatatcccttgtgatgctgggactcgtgactatctgattctgggtgccactctcccctgaatttcagggaccatcctgttgctttctgaccttgatttagctcagcaagacttttgtgtgtttggcgtaatgatggtgtgcctataatggggggtgattgcaggcactggccctcagccttcataagaggcaggcagacaaacataagcagggactgggaagtagcactcctaacattatttatcttcttttcagcttaataaagaaccctgcagagagagcagatctgaagcagctcatggtgagtcttacagagcctgtttgttcatctgagccatttttctgctcattcccactccttatacttcagtcaggtttagggtttcacagtgccagggatcaaactcctctgtcctgtgggtttcaggggcacctgcgatgcagtcagggagggacttccccgcagccttagttctgactagttcacctcacatatccagtatcctgagttactctccaactggttctagtttgatggcagtgacacacacgtggtactgtaatgtccagacaaggccatgccctgtgtagccttgagtgtagtgtactttctaacaagttgcccagggcctcacagcttctctgtttggcagagggggtctctgggctgcagctggccta

SEQ ID NO: 35000 - DNA, 1189 bp, Mus musculus
atatgtgaaggtcaggggccagactgggcagagcaggaaccacaagcggccaggacctgactctgcggatgctgccggctgagacagggtccagggaaaatggagcagtgaggagaggtcagagctgtaatgcatggaggccagaggaactcttttaactttgaggtgtcagagtaggggacaccagaaggtaaaagcaccgaagccgccctgggggcctgtctagagcaagaactaaccatccatctcccccgtagcctgagagactccaggggactcactactctgtgcagtcggacatctggagcatggggctctctctggtggagatggcagttgggagataccccattcctcctcctgatgccaaggagctggagctactgtttggatgccatgtggaaggagacgcagccgaaacaccacccaggccaaggacccctgggaggcctctcagctgtgagtgaggactgggaggcaggggtggtggtgggtgagtctaccctttgactcatagtgacaagtagcctcttatctgtatctataaagtattttctttttcttctttataaatctgcagcatatggaatggacagccgacctcccatggcaatttttgagttgttggattacattgtcaatgaggtaagtgctgccaggtttccttgaccttctgcataagacagtaagtagagggctggagagtttactgctgctagattgctcagcagttaagagcactgactgccctaccagaggtcttgtgttcaattcccagcaaccacatggtggctcataaccatatatgctgagatctgatacccttttctggtgtgtctaaagaaagctacagtgggctggtgagatggctcagcggttaagagcactgactgctcttccaaaggtcttgagttcaaatcccagcaaccacatggtggctcacaaccatccgtaatgagatctgactccctcttctggagtgtctgaagacagctacagtgtacttacatatgataaataaataaatcttttaaaaaaatttaaaaacagaaagctacagtattcatataaataatttttaaaacaagtaaaagaaagcaagaagaaggtggtggtggcatgcacttttaatcccagcacttgggaggcagaggcagatggatctctgagttcaaggccagcttgatct

SEQ ID NO: 35001 - DNA, 1134 bp, Mus musculus
ttgtttttctctgtccactgtgggttctgggcactggacttaggttgtcaggcttttttacctactgggccatggtgctggtccctcatagctaactaatgtatcaagtttttactgtgcttcatgtatattagtttgtttaatccatgtaacagcccatgattataatagtgaccttataattaattattcacagcattttgcaagttgcagaacctgtttagaagtacactagatagtaagggacagagttagtgtttaaacttttggcaggttgactatagagcctgcacagctgacgctatcttatgctgtcagtgtaaagcaagacttttttcatgaccactgtatataagtcatttgtttaaagaagctcacaggattttgtttgattgtttgaagcctgcctgagttctttgatagctggatgaaactgaaggataataattcgttaaacagatgtgttgcatgtgaaacttactttcttttggattttaatagttgaggtgatagaaatgttgttactaactggtatgatattcttgttcttaggatggtgggtccttggatcaagttctgaagaaagctggaagaattcctgagcaaattttaggaaaagttagcattgctgtgagtatgtagtagagtttttttccagagtaacaaattttagaaaaagttagcattgctctgagtatgtagtagagtttctcttctagagtgacgaattgagagaaaataggtgagagaggaaggtgagtcagtgaaggagttgatttcagaaataagcttgctagagcatttcccataggatgaccttaaacatctgtacttctgtccctgctgcttccctactgctgggatggcagatgtgcaccccacacccagttttattctgtgctggggatccatgtggctcttactcctgcaaggcaagcactttacccattgagctaaatcctcagcctcaactttaggttaaaacctgtgtctgaaaaacagggcaaggtatctttgttagagacaagaaaaggtctttaaagttgggggtttagaaaacaatctttcacagagtgttttgaaaacttacattggccacccttaccttaggctaacagtagtgctttatagaac

SEQ ID NO: 35002 - DNA, 1206 bp, Mus musculus
tctagtgagggtttaaaaagtgacatgtatttctgtgtgtctgagtttgagtgtgtgtacatgaggacggctccagaggcgttgggtcctttggagctggagtcacgggtggttgtaaactgcctgacatgggtgtggggagcacccatgttctctagaagagcagcagcaagtgcttttaatgtcagagccatctcttaggtgcttgttttcactcttactagattccttggttcctcttgtagacctttaatatgttgagagaaatccaggaccctcattgttcaatgctgcgttgtgagataaagcagggttgaaggtgaggccctagggatgactgaaatgagcagagccctggcgagttgaactctttctttcgggcgttaccttccttgagtcccctgtgggcttggcccaggagtgcacggctgcagggcaggcggggcagagcgagcgtctctgtgctgcgccagtgctgacctgggcctcctcggggcaggaccaacctggaggccttgcagaagaagctggaggagctggagcttgacgagcagcagcggaagcggctcgaggcctttctgacgcagaagcagaaggtgggggaactgaaggatgatgactttgagaagatcagcgaactgggagctggcaacggtggagtggtcttcaaggtctcccacaagccatctggcctggttatggctagaaaggtgagcttatctgggtaaacagctaattatcaattaggagcctgaatgggtaaaagaaagggtttgtttgtttgtttgtttgtttgttttcgagacagggtttctctgtatagccctggctgtcctggaactcactctgtagaccaggctggcctcgaactcagaaatccacctgcctctgcctcctgagtgctgggattaagggcgtgcgccacgaccgcctggcaaaaggaggtttttacttaggactttttttgtgcagttagattgaaaaccatacatttgtcaagtgcagaaaggagctgcttttttacacccagttctagtgactgatgctcaggccaaagctgagtttcatggcttcagtcttgacccaatccctttcctgttcaccacgtcataacacgtgccctgtatagagagactatgttctaccatgtttttcagctcacccggctctttcttctctccatgtttgtattgtgccgttccttct

SEQ ID NO: 35003 - DNA, 1188 bp, Mus musculus
tatattataaccccatgtatataaaatacactacagtcaggtatggtgcacatctctaattccaatacttggtaggtgaatgccagatgatcgaagagttcaagatcctttctgtgttgataggatcctgtaactttaattttttcaaacgcctatttttgattatggttcttaaatgctttaacctccttgtaacccaccagaagtagtggaaaagaagggatacggggaagtggacctgtttagaaaggttcttttggagcaactcttatctgtgttgtcctgaaatcagcagttcagttcacaggttagcaggcagtggcagctcaatccacttgcaaacacttcacatcagcagtccagctgggtagagtcaggatagcaaacacgaatcagcagcagtgccatgacctaacaaagacaaccaggcctcagcccacgctccagtcagcaggagggaccaacaggaacatcaggagatcagtgaagatcagcgaagacgaagatgggagacctacaagcactgaatggctagctttataagcaggccttagctcagcctccatcactgtcctttttatactctctccaaacatcatgtgtcctccacgggtcttgccttagcaagacaaaactctgccaatcagcccaagtcctcagaagctgcaaaaaagccatggcacagcaccagaagttttttggtgcatttctctctatagagtcccaactaatgcagttcaactatgcagtgtaaagcaggccagtacatggtgtcattagcagagactcttccgtcatgtgtcctttctcgtccttgctttatcagaacatcctctctcctgtgtttgcttcagagaaaccttccttctcgagtttattgtagtctttcacctgtgtccacttcagctaaatgttctttcacatgtttgccccagcaaagcaccatcgagctgactttccaaagaacctttaagttttctttcacctctgagctataccggagctcagctaaaatgaggcttgtttgtttttggttttctttgctagtttgatttctttttttttttttttttttttttttttttggtttttcaagacagggtttctctgtgtagctctggctgtcctggaactcactttgtagaccaggctggcctcgaactcagaaatccgcctgcctctgcctcc

SEQ ID NO: 35004 - DNA, 1218 bp, Mus musculus
tatgtaagtacattgtagctgtcttcagacactccagaagagggagccagatcttgttagggatggttgtgagccaccatgtggttgctgggagttgaactctggaccttcggaagagcagtcgggtgctcttacccactgagccatctcaccagccccctaagtttgttcttaatctgtctggttgggctcatatgccctttaacatcctccttcacttttctgcaaggttttctgcaaggtagtcttttcttagtttgtggtgctgaggttcaaacctagggtcttactcagttccacttctaagctgtaccccccagctcaatgacacacaaatgcacacttatttttttttccccagttctagagatcaagtccagagccttacacatgctacatatttgctgtaccatcaacctatatctctgtctacctgcatgatttgattttgttttaaaattgctatcatatttacctgctgtaagggccaggtcagactcttgtattgatgtttccctagcatcttgttcaggacctgtgctaaataaatgaatgctacccatttttaaggttcatctgtggctgtagtctctctctctctctctctctctctctctctctctctctctctctctaccaagttttgctgtcctctaactttggtgctcacttgccttaacctcccaagggatgcaagggacgcatccaagttcacagttgtgctctgtaatgtccgcctcgattcctctcccactttgtcttgtttgcaaaaattcccaataagattacgatacccagagaacaaaatttattctgagccatccattgggtctggggtccataactgcattttgattggttctgggtttctgtaatgttctttgttagaaagagaggcttccttgatgaggatggagtgctacacttttctgtggttataaagacaagtgtttagattgtggttagggattatgctaatttagtaaagagattgtgggttctttaagattcataacttcactaggtagtttgctagatttttaataccaggttaagctgtatgtatgtgtgtgtatgtatatattttgatcttttgttctatcccctggttttgttgtcccagatctcaggagagctgtgtgctgagttcattcatgcctggatgaatggagttctgttttaaaagagcaggtgttctgagatctggtaaagggccaa

SEQ ID NO: 35005 - DNA, 1383 bp, Mus musculus
tcccagcaaccacatggtggctcacaaccatctgtaatgggatctgatgccctcttctggtgtgtctgaagacagcggcagtgtattcatatacattaaataaataaatcaaaaacaaacaaacaaaaaatcccagcactcaagaagcagagactggcagagagttctgaatttgaggccaacttggtctgtataaggagctccaaggacagccagggctatatactgagactctatctcatgcatacaatttaaaaaaaaccatgattgcagtatcattagacaagttatagaaagtatctataaaaaaagggaaagtggtggcacacacctttaatcccagcacttgggaggcaggcagatttctgagtttgaggccagcctggtctacaaagtgagttctaggacagccagggctatacagagaaactctgtcttgaaaaaccaaaaagaaaaagaaaaaaaatcctaaaaccagatccatggctagactttagtgagaccttcgtgactgtacttggtattgattgcattgttagttgtacagtgcaaccgtagacagtcacatacatcaaaacagatggttcctgccgacagagtctgtatagttgtcagattttctgtgcgatggctccatacataagattttaaaaactttttaaacatgtatgtttatttatgtgtgcatctgtatgttgatatgtgcatgtgtgagtgcagttacccaaacacgagctgggtttataagaaattgtgagctgcctaacatggattctgggaaacaaactgtggtcctctgcaagagcagcaagtgctcttaaccactgagctgtctttccagtcccttagtctttcttttttttttttttttttttttggtttttcgagacagggtttctctgtgtagccctggctgtcctggaactcactctgtagaccaggctggcctccaactcagaaattcgcctgcctctgcctcccaggttttgggattaaaggcatgcgccactactgcctggccagtcccttattcttatttttatctagtaatgtatatggtgagtcataataataattgccgaatcttatataataatagcacagaatcttcttattgtttaaatcagtgattctcaaccttgccagtgttgcaatcctttgacacagctcatcgtgatgttgtagtgggccccaaccatacagttatttttgttactagttcataactgtatctttgctactgttgtgaatcataatgtaaatatctgtattttcttatgaatttaggcaacctctgtgaaagaattgttggacactcccctttgatccatcggttgagaatcactggtttaaatagtctgggattttgaattcttttaaaag

SEQ ID NO: 35006 - DNA, 1149 bp, Mus musculus
ctagatttatttatttattatacacaaatgttttgcctggataaaagcacttgctgatcctacagaggacctgagttttgttctttgcacctacattgtgtggttcacaatagcttataattgtggttttaggagatcctgtgccttttctggcctccttgggcacctgcacatgtgtgcatatagataaataaaaacctaaaaaaagaactatagtaagtaaatactatgttgtaaaatgtctcatccagctgggcagtggtgtgggaagcctttaatcccagcactcgggaggcaggggcaggtgaagcttttgtgaatttgaggccaacttggtctacaaagtgagttccaggacagacagggctgttacatggagaaaccttgtcttgaaaaacaacagaacaacaacaacaacaacaaaaaatacctaaaaaaaagaactatagtaagtaaataccatgttatgtctcatccaaccggacagtggtggtgcatgcctttattaatcccaatacttgggagttagaggtaggtagaactctgtttgaggccagactggtctacagagcgttctgacctcaaggagctcatgtgcatatacctacacaggagctgaaggggtttgcatggctctaactgcatatgtagcagaggatggctttatctggcatcagtgggagaagaggcccttccttagtcctgtgaaggctctgtcccactgtaggggaatgccagaatggtgaggtgggagtgggtgggtgggtaagcactctcatagaagcagggggaggggaataagagagggggtttgtggaagggacacccactgggaaagggataacatttgaaatgtaaataagatgggcgtggtggtgcacacctttaatcccagcacttgggaggcagaggcaggcggatttctgagttcgaggccagcctggtctacagagtgagttccaggacagccagggctatacagagaaaccctgtctcgaaccccccccccccaaaaaaaaaaagaaatgtaaataaataaaatatccaataaaaaaaaatcatatgactatgtaatgatggatggatgacagtggcttcttgccatctcaaagtttcttaacaatagggatttaaggctcattttctgtt

SEQ ID NO: 35007 - DNA, 1126 bp, Mus musculus
cacctcccggacccttggcattttaagtgtgcttttatgcatgtgtgaaaaagtggtttatatttagacttacttatcataattaggtgattatcgatttgatagctttgggagagatctgtttatcaagattggatcagttgcttgtaatgagtaataatgatttgatttttctctcagatgtgacagttgaagagaacagtactggtgaggatcaagaagagtcaaatggattaaacatagacactgctgatggtccacatgatgttcctttcgccagtacacatgaagaggaacagtgcaaagcagaggagacacaactggaccatactaacttagactaatctagaaatgctataagtagccaactctacaacagaatcctgcaagcttggggttacttgtagtgttttctaccttgtataaatccttaagtcttaagacttatgtggattcctgcttaaaatacagtgactatttaaattgtttcctacttattttagtaagtctgtttattatttttggtgtcctgtataagtctgcctttataagctattttgtagtttgcattgaattgtttctcgctaaattgggtaatgatttaaaatgtaaatatgcactcactattaggtcagtttttataaagaaataaattattttgtaagcaactctcaggatttgagtttctcaccatgatttagttatacaatttaaactttttgctgaagcagttaagaattttgactttttaaaatctcactcattacagcatcctggctggtctgaaattagaggtcaatgtcctgctttttctgccttcaaatgctctgtgtgacagctgtgtacatcatctggtcttttctttcatatcattattggaacagtctgtctcactgcaatctcagctggtttgaaggctgctttgtgttggggttaaaggtctgtgccacaacactcatcttgctacagagtcactttaatgtttaaaagatcacataaaaggttgatactgggactggcaagatggctcagtggataagagcactgatggctcttccaaaggtcctgagttccacagggtggctcacaaccacccgtaatgagatctgacgctttttctggtgcg

SEQ ID NO: 35008 - DNA, 1150 bp, Mus musculus
ctcccctttggaggctcctccttttccttgtccgtgaatattaaataagcagtcttacttcttatggctcctttatgggttcaagttcctatgccatattggtcaagcaggtattttagtcacttggatctttctttccagacagacctgctgtctgccctgtgtctgtgtatgtgggtctttgtgggtgttgatgcctcttggtgtgttgtgtgttctacgaatatgtacctcttatctgtttccgagcagtgtcataaaaaggggtgtgtcttcgtggtgtgacttttggtctgttttttgtctgcgcctctgagtgtcagcaccctcgtgtctgcatacatttctgcacacactgaaggcccagtatggacagatcttgccagggctgggtagcctagtgcacagagcaccctggggcctacaacttctctaaggtcttcaggatgtcccctgctcttcctcccatctctagacaagcctcagagtccccaggacacttgttaattgccctctgtctcttctctctgcctccctctagaggcgtcctgggcttgggagagctgctactgtggcagctaggatagccctaagtcatttgcatttgtgtttgcatctcatttgcatggtccatacagactcactttcagctctgcagttctcaaggtaaaaatgtagtgcttttcctgaaggtcattataataagcctttttagcctttttttcctttttttttttttttttttttttctggttcagactttcttcacggaattcagggaaagaaggcagcagaaaacacccagaaaccattgctttactctcagctcttccagctgtcaggtaaaatccctgggtctgtaggtggaggtcctgggctttgggagaacagatagtctctgaaggcaggtctgggcaggggccccctgctcctctagttcctgggcttagatctgcagaagggaacagcaggggatctttcccgctgccataggcctgagctagcctggaacacagagaggatgaagtgtgtcttttcctttcctttaaaatccctaacacataattggccatcttaggtcacaagcggcatcccaaaggcttcctcaggaaggcaacacctgaccagcatattctccacagcccagcgc

SEQ ID NO: 35009 - DNA, 1195 bp, Mus musculus
cagcctggtttacagaatgagttccaggacagccagggctacagagagaaaccatgtcttaactgcttccccttcaaccaaacaaaataaaaaccctaaaaacccaaacacaaaaccaaccaaccaaccaaccaaccaaccaaccaaccaaccaaccaaaacagtataggaatataacccactataacccacagtggcagaataacttgactaaaataatttgccacagataggtccagaagctcatttccaggtaatagattctgtccagttgatgacagtaacctacacatttttgaatattcacaatatttatgaatatttaggcctccacttgtagaagatgggctgaggcctggggtgtataacatttgtaaccaagccctgctgcttgctaatggagataatacagaaagtctaagaacagcctgcctattctcaaaggaacaaggcaatgtctgtcgggaaccttctcacctggagaggccatgggctctcttcttagccacctttcctgagcacttttctgaagatggtcctgctgtgtttggattcttgaagtttcctcaccccaggttaccttcccatttggctgctctggatatcagcattcctttttcttccaccacagagaatgtccctgctctaaggtccttacaaaccttcctcttgccagagagtgcattgagacccagagataggaagttaggtccaagcccaaggtcatatggtgacctggtatagcttctgggccctaccccaattagacaagaatgctgggatttcagcagtgggtggttgggcctgaggtataataaaagacatgattagaaatgtaaagggattgggttcctatatagagtagggttggcccattcctagggtccttacacaggaagtgggttgcagggtaagcactttacagatggggccatttccccagatcattgctctctctctctctctctctctctctctctctctctctctctctctctctctctctctgtgtgtgtgtagtgtgtgtgtgtgtgtctatgtgtgagtatgtgtggagtgtgaatgtacgtgtatggtgtgtgtgtggtgtatgtgtagggtacatgtgaatatgagtatgtatgtgtggttgtgtatgtatgtgtgttatatgtgtggggattgtgtgagtatatgtatgagtgtgtgtggtgta

SEQ ID NO: 35010 - DNA, 1154 bp, Mus musculus
tcgatagcatagcttctctttctatgtgtccttagatttctctcttcttctttatccataaattgaaggattggcctcctctctgggatacctttcagctttaatgagccacaatcttaagtatctagctggctgcttccatgtatttaattttaaaattacattaaatctatgtgtatgtgtgtgcacatgcacgtgccatggtgtggaggtcagaggaaccatggaagttggttctctccttccaccacgtgggcctagggattgagttcaggtcgtcaggcttggaggcaggtgcctttacctcaagagccatctcactggcctggggttttagagagctttattttatttagtccacatggaggaatcagaagagcagggtaaggtggagttttaattttgcatctgatctggtagcagctcataaggctgtccacatgggtttgcaggcttgcctgacacaacccttcttcattttcacaatttctccatggtaccaagcttctctagcaggtctgcaagaacaggagagtgggccacagccagaggctcactgccggagcaagtgcgtccctccacagctgcccggagcctatagctcctcttctctttgggtccctctgtgttctcagacctgactctgctgtgactggagggaagtccctggcagtgaggactctgctggctactcccttggtacatctagggacagagcctgcctcttaggatctcaagcttgcagcaaatgccaggcaggagctggtggtggtggggggggggggatgggagtaagtaagtttgttcctgtctggctgggggatggactagccttctagtgcagggttcctggcagaaggaagggctcccagcctggcccagggttctgcaggctgaaggcttggcagtgcgtgaaggggggcacttcttcatctccctgctttttcaactgacttccctttggcagtgggtcttttggcgggggacataccacacctgtgttggtaggctagtaccatgcagtgcatagtggtgaactgtatgcagataccgcatcttgctttgggtggtgggtccatggtggctgtgtgattaggtgtccttggtcctttgagtacctcttgctgccctccacccatcctttctttaccctt

SEQ ID NO: 35011 - DNA, 1158 bp, Mus musculus
attatgtcccttccttttctctttctttctttctttctttctttctttctttctttctttctttctttctttctttctttctttctttctttcttccttccttccttccttccttccttccttccttcctccctccctccctccctccctcccccctctctctctttctctttctttctttctttctttctctctctctctctctctctctctctctttctttctttctttctttcttttaatagggtctcactatgtagctctggctatcccggaactctatgtagaccaggctagcctcaaactcacagagatgtaccttcctctgtctcttgagtgctgggattaaaggcatggactaccactcctggctctgtttcttaaaacaaacaaacaaacaaacaaacaaacaaacaggagttgattctcagtaataaagtacttgtctagtgggcacaggtacttggctttagtccttagttctgaaaggcgaaataaaataagagccaaccaatctaccaaccaaccaactcaactaactaaccaaccaaccaaaccaccaccaccgccaaaacctcacaacaaaagccaacaacactagactggcaagttggttccgtgggtaaaggcactcaccactgctgagcctgacaacccaaatttgatcctggtacccacatgatagaaagatagaactggctcctgcaggtcgtcctccgacttttatgcgcatgagcacatacatatgtacacaaatgactacatgcaactaaaacatctttggaaattcactgtcctagagaggtgtgttatgaattgcttcttgagacgactgtctctgatcctggttcagccatgcctgtttcttactttatttagcacttgccacaacttcaagttcttcacattataaatgtcctacgtgcatcagggtatccattcattgggtttcaacctattttagaatagctaaaggcaggaggagaaggcctgggggataaatgagcggatgagagagcttgctgcacaaccattaggatgtgagttcaaatccccagctcccacatgaacactggagtatgcctgccacctcagaactgcaggaggggcagaaataggaagatcactggagcttgctgccttcccacctagctccag

SEQ ID NO: 35012 - DNA, 1154 bp, Mus musculus
gcactggcttggtaatcagacggggcgagatagcaggtacagtgtcaggtcgatggatggaccgaccctctttcctcctgtctgttcccactgctgccgtgcaccaagaattttggagagctggaagggccatcagacagcttctttaaaaacattttaagatgtttatttattgggcgagggcttatgggatgagatgtgtaccacacagaagtcaacttgtaggagtggattctcttctttgactccgtgagtcctggggattgaactcaggtcatcaggcttggaggcaagcacctttacctgctgagccagctcgccagcccacaattaatttccttttataaatggggaaactgaggcccagaggagcattagaagtcttctggtggccctgtggctggtggaaatcttctatgcaggctttacgcctatgtgtccttttggattgaccaggcacttgtgaagggattataccttctgctgtttaagaagcagcccagaggggtgcagttactcacacagctgactggacttggagggggagattggattctggctgctctgcctctggcctgattcttctgatccctggctgggtgctcagctctggtcctccttggaggccatgaaacaaccttgtcagcagattctgtccccgtacagttcctcccccagcagctgcaccaaggttggcagtcacacgagctaactcctcttctcgcattgacacgccacaacacataagcacacaactctaccatttggctttagcgattgctccacagtgggtgaaattggcttgaaataaatgtctcctctgccttcccctggggcgattttatcctcatctccactttgtggaatgatccggaggctgccaggagcctgtgctgtctagatacgtcctttctgatgtagagatgttactacagccacgtctgagtgagatgtttctggagagccactggaagacacctgcggcatcccacaccccagcatcttgggggcaccatatagaagagctgaaagtaaagaagggggctaaggagatggttcagattggtaaagtgcagccactaagcaaatgtgcagacctgaattccattcccaggacctatggtaaaatgtgctggtatatgcttgtgtttcta

SEQ ID NO: 35013 - DNA, 1224 bp, Mus musculus
ggagatactgggttacaaggtgaggcaaaggcccctgcttgatttcctaaaggaactgttggggaaggactacaaagaaacatcaccaggctcgatgtctcaggaatgtggctggcagcccatgctgtgaccagtgaagactggttccagctgccgggccttggcaaggtcttggggttcagccccacaggtgtcttggaaagaaaagatgatcctgattccagagtgtggaatgggggagcctagctatgtggggaagttctgctgactccctgaggaggagtctgtgagtcttgggcgcagctggtcttgtctacaacctttaatcaattaatcagttaatcaactcaaaggatgtaaaggtgggtgtaaggtttccttgtctccatgtgggaagaaagacgcctgccatagatggcaagtgaccctaaaggaattctggggtgtgtctgggggttctgagtgactctgtcttggctccccgtgacagtggaagaaaagctgagcagacactgtgcagacatcgatagagctctaaaaagtggcccctggtgtgcggacagccactcggggtgcagcgactcagccggaggtcttaattacctgctcagaacaagagacagatctgagatgtgcagagtttcgtgtacaaagtgttttatttcccggggcgggtgcagagcaaggagagccatatggcccagtggttgaacagctgtctctggagaaggagcaatcgggagctcccaccatctgggcaaattacaagactctcgactcttccctgtgtgttgcagcagtcaagtgggtctgtgatggagagagaaggaagtaccctgtgtgcactcacctgggcagctccgccaccgtccttccctggatgccctgggctgccctcctgagcccctcagagcttctcaccgaggtcacctgcagcaaatgccctcccagcttcaccccacagcctctgcccagcggggaagccttctgctttctctagaaaacataaatgtcattcctttaacccagccccctcttgcctctttggcaggctgcagagtctacttgaagagtgcttagtggtttgaggctgttatattttctctgctctatgatccgtgttaggttaaaagggccagggcggcttttccttcccatggaagataactcaacccggacaggctccctgtgggagaattaaaggtgacgagggacttctgcttg

SEQ ID NO: 35014 - DNA, 1502 bp, Mus musculus
tttctgttctgtgtgtcttctgtctcttttacacaaagtcttcatggtttatacacactgagtgtttctgtttcttctgtcattcagagatataccgcattgtttctcagaagcaaatgtcagacagacgtgaaaatgacatgtctccaagcaacaatgtggttcctattcatgttccgcccaccactgagaacaagccaaaggtgcagtgctgtcagaacatctaaggcgtctcttcccctagaaggctgtgtatagtccatttcccaggtctgagatttaaatatatttgtaattcttgtggtcactttctgtgttttattacttccttacacttaagaatcttcccatgtcttaagtcttttgatttggctttataaaatcctcaactttgtcctgaatgactgcagttctttttcatgctatggcttctctagccttagtttaataaactgaatgtttgaagttctcagttattgtttactcttcatcatggaagcctgtcactgtaggacagaatagaactctatcacttgaagtttagacctattggtcctgatcagatctaagacaaccttagaaataagctattgttttgccacagagcagcttgtaagacactcttctcaatacagtacatattttgacagatctaaggattgccctgtaaacataacagcattttgagagcttgaagattttccattgtggaagtcagtttctaaaatgccttaataggtctatgttgtaaattttttctttaatttttgtaagcatcaaacatgatggggattcttttttgttgtttttctggaaaagaattaataaacacaaaggactgttatggtttgcatagggtgtggttatgtggtcaaagttaccctgctgtctggtaggctagtggacttctgtctgaggtgtctctgttgcagtgatcggcagccagagtagcttaaccaatctcatttcctagattgtgatatttttattgctcatgtaataactagcttaatgctggtaatatcacattttgaagtgttaattttgcttttaaacctgtctagtaagtgaaatgcagcctaattttatcaccatattcagcaaccagcatgggtaattattttaacaatgcttatatttgagttctgcagtgtataatggaatatagctcaattaatcctttggttttagtatgtctaaagaatacagtgagaagttaatttatactcaagtggtaccacttaaaggcatgtgttcttttagtatgtaaagtgaaatagtaccttgaatttaagtagaatgtacttagccattgtagggccctgaaatagatttttccactacataattgaaatcaatggaacaactagtttctcattcagaaatgtacacactaatacttagttttacttccttgtggataatattaagcacttaccctgacgttttctgaaagttaactgcaaagacgttattaaggatggtgggatacctgcaaaaac

SEQ ID NO: 35015 - DNA, 1166 bp, Mus musculus
aaatagtgggacgtttgataagttaactaaattctgaatagtctcactcattgttattggtggtatttatatgcagaagtaattacaagggagcgaaaatttcttactgttacttttaacttactgaagtaaaagtaaaatattgtctatatattacgccagaagttggtaccatttagaggtttttgtttggtagtttgaaatactttctcatgtatctttcagatagtctcatgactatctgaagaatagtctcaggctggtcttgaattcttggccatgctgaactaagtcttagtcttttatcttcccttttgtgattgtaagcttatcacatcttctgttttaaaacttggagaaagccgggcagtggtggtgcatgcctttaataccagccctctggaggcagaggcaggcagatttctgtaaattccaggccagtctaatatacaaaggagttttaggacagccaaggctacacaaagaaatcctgtcttgaaaagccaaaaaaccaacaactaccaccaaaaaacaccttatggaaagttggggaggtaggtctgtggtagagggcttggctggcattggggaggccctggattagatcaccaatcaccaacactattaaacagcaatcaaaatttaccagactgaaaattttgtttctttttacagagaagaatggtttgtcattcattgagacatctgctctagattctacaaatgttgaagctgcttttcagacaattctaacaggtgagacctgtgttttcggttacaccaatgggaactggagttttaggaagtgagttaaactaattaggaaattgttatgccacctgaaaatgactatcattagagagcaactgtagtataaattccttgatgtgtagagttacagtttttgcaggttgcacttcagtcatgtgaattcatctggggaaaaattctttgaaagtaatttgttcatttccttgtgttcaggcaatgtagtctatacctcatagtcaaagggacagttacatgttcttatgtatgttcttctctttttaaaatgcactttcattacgtaaatactgagatcctgactatagaaagatataaatgccttttgaagttagaaattggctggagaggtggcttggcatttaagggtaccttccgtt

SEQ ID NO: 35016 - DNA, 1199 bp, Mus musculus
ttctctctcttaaaattcatcttatttttattcatgttttgcctgtatatgtgtatgtgtaccatgttcatgcttagtacacatggaggtaagaagatggtatccgatccattgaaagtatagttacaaatggttgtgaaccactgtgtagatgctagaaaacaaacctgggtcctctacagcagcagcaagtactctcaactgctgagccatctttccagcatcttgtatcttttctcttaatagacccttttttctttgtcatgtcataattgctttggggggctattattaaataaactaagggttacttgaacacagaaaagaccataaataatggcagagctacaaagtgactttaacaggcaggtagtttatatagtgtgtgggtacattggacaaaagaatgaatcatgtgctggcctggatgaaggggaaaactgaggagtttgtcatgatacttaaaatggtggcaatttaaagcttatgaattatttattattatttcccatttaatatttttggcctgtggatgactaggtataaaacctcatataagggatgactactatctgccatatctggtgtgtgtgtgtgtgtgtgtgtgtgtgtgtgtgtgtgtgtacgtacctggtctcactttgtagcatggtactcattatgtagcccaggcaggcctcagacctccagcacccaggacagttatgtggcaccacccctcatgtgataactaggaattttcagaaatttatttacaagtttgtattattgtttttaaaaatctctttgtgtgtgtgtttgtgtgtgtccctgaggatgagcatatgagagaatgtagagggtgtttgtgttagtgtgtatgtctgtgtattcttgctgtgtagatagaggtcagaggacagacaaccttggatgttggtcctcacacttgtgaggtcctaccttgtttgagataggcagtatttgttgttcagtgctgtttatgccaggatacctggcctgagaacgtctgggattctcctgtttcagcccccaactcccttatatcacagtaggaggaccaggattgctgagtgctaccatgtcagctttttcatggattctggggatttttaacacccaagcagatcttcatgctggatggcaagtgtttccgccacagagccatctctctagccctataccatcaccttttgtgt

SEQ ID NO: 35017 - DNA, 1203 bp, Mus musculus
aatgttggaatgtttatagcaacaatagcagtaaactgcctaaaacgggccctgccgagttccaggcagccagtgagcacctgctgttttcattcctgttactagtatttaaaatatttaaggtaacatatttgcagagtacattttcatagctgaaagcacatttcttgttttccagaaagcacacctgagctgctcttaatgccatctcttgaggacacaaatgaagcacaaaccacgccaagcaggtgctttaggaaaaggcataaaagtgatgatggatctcacttgcagcagcaaatgccttggggaagcaggaaccgtaatctcagtggtggggtactgatgggattcatgctgaacagaactaaccaggaaacaagccctggagagatggttgaaaaattaggagctgatgcaaaaattctttcaaatgttatctcaaaaagcacaaggccaaatagtcttgatattggaaaaccacccgcaagatcaaagagagacagcctagagaaggagtctagcgacgatgacacacctttccatggttctaactgcctggataaagtcgagtctcctgttatctttgacttagaagatttagacactgaaacagatggatcaaaagtgggcggtgtcgctgcacaaaatcccaagaggcttcaacgtaggaacagcagcttttcagtaaaaccctctgaaaaaacagatgttgtaacaggctttgatcctctctcgcttttggttgctgagactgagcagcagcagaaagtggaagaggaagaggatgaagatgataacaagagcgtctcaacaccatctgccaggcgcaatttagctgaagaaatcgagatgtacatgaataacatgagcagtcctttgacaagccgcacacccagcattgatttacaacgagcatgtgatgacaagttaaccaataagaaaagcccaacattggtcaaggcctgcagaagatcaagcctgcctcctaattctcctaggccagtgagacttacgaaatccaaaagttacaccaaaagtgaggagagacccagggacagactgtggtcctccccagccttctcgcccacgtgtccatttcgggaaggatctcaagaaacactagcccattcatcaccttcatttaacttagacacactgctggtgcctaaacttgatgtcttaaggcacagtgtgttcact

SEQ ID NO: 35018 - DNA, 1199 bp, Mus musculus
atccatgtgcccgaagtattcagatccctgctcacagatcaaaaactgttgtgtcaaaatgcccgctattcccaatggccagaagcatcagcacatgtggccccttggataaggacgatcccggaggacagaagctcattcctacaggcagcctgccagcgactttacaaggacatacagtatgtatttcagtgtttctcttgtttgtaaagtgattgtttacacaatcctgttgccttggtcctgaataacattattagctttatatagaacaatcagtattatggttttatataatatagaacaattatatcattgtcacagagtcctgctccatgatacagtcatggaaatcacagacattttcacatcctcattcttacatgtgtcgtgtatgttttcttcaacaggattctttagggttagaatggcacctgccgagtccagaccctgtcactgtcccataccttagtcccttagtggtgtggaaggaacttgagagcttattggagaatgaaggtgaccatgcaataacagtggcagactttgtggaccatcacccaattgtcttttggaacctggtgtggtattttagacgcctcgacttgcccagtaacctgcctggactgattctttcttctgagcattgtaacaagtattcaaaggtaggagggtaaagtcagaaggggaagtaatctggctattatcattgtattctttgcatatgcctcatgacacaaagtgaggtttgtttttatgtttgacattttcactaccctcggaatcggcatctaaacagaagtgccctcagttgaatttgcagactagcagtaagacagtcatggtttcagacttctcaaaataacacaaaacatggttgaatattttgttatcacttgaggaataatgtggaagttactcttatgtaaaggtttataagttagttccccccacacacatacttctttcagaaataagaaacatcagtctattttagtggtgtctaattcattttgtaagtgtagactccccttttcttccttcccttactctgagtttattatgttcatttatttatttaattcagttttaaaaactggtgctgaggatcaaagccaggacttcatatgtgctaggcaaggactgtaactgagatccatcctcagccgttttatatttccatttctgtatgtgtgcac

SEQ ID NO: 35019 - DNA, 2190 bp, Mus musculus
tgctctttgaagtaattagcacagctgcagatctctatgtatatctacctatattttttttattacttgagaggaagaactttaactcgtcagtgctagtgtctgtgcccttggattgcacgctagctcccctgaatctgactggtgagagggactgagggaggcatggtgtgagccctgtgcagggagtgccaggcagggcacctgcgccatgctcaccagtctcttctactacgaagatgcgaaagtacccaggggaaatatctcacaacccaaatatcagcgtgagtctcattgtgctatatgaacacttacagagggggtatgactgacaacggactctctaaatcttacccaaaatactgggtatgaaacaaattgcactataaaatatgtatctgaaatatggtttaatggggtagtctgttaataatatatatagagagaatcaaagtatttttgaaagaagaataaatagtaacggtctaaaagtgcatccagagagaatttcccatattgaggaacttagttttttcactaagcttcaggctctgaagttcaggaatcgaaaatgtaaactctacttaatcagacaagaaactcaatgtttaagaaccagtagtagtaaattgacttcaaatccatttttagttatattatttctaaaatcactttctttgaataatttctcataaggaaaaagcatcctttggcctctagaattaattattcatgtattttcagtgtatgtatatacatttgcaaaggttgtcatttgtaaaggaaggctagccattttaacaagaagaggaaaggggaggcggtcccaaatttgatgtttaaagcaagtggagtccatgacgcttgacctgggatatcttaagagcccggagactcacccgttcagccgcaggagagctgcctttcggtccctgcccccattgagtagccaggctgcagagcttttgcctctggcaagttgtggagagcataaaatgtgaatcttgagttcagttggctgaggctgaactaacttacttgaaaacactggtgctgtgcgcgcgcatacctaccctatgcgcgcgcatacctaccctttgcgcgcgcatacctaccgctcctgtcgatccacatggcctccccggcctcactgcttcacgttcctcaagtcactgagaagtgtattcagtctcccgagactggggatgttcaagcggaggtccttggcactggtagtaaacatgccctctaacaggatttggggtctcatctgtgctttcttcttccttcccttatgagagcagtttgcactgctgcctccagtttccgtgatgcacactgtgtggtttgttggtttctactgtctgacaagcgcagagaggcagagctagttcttcgtactcactcggaaacagcatgacttctgtctcccaccctgccctcagttttgttctctgtctctaaataaagttgtatttttcctgcttttaatccccaggaaatatcattgtatgaagataatttttaaaaataatacctgaacatgggctagaactcagtaagtcctgctccaaagaaaactaaaataaggttcgtctttttgaaacaacttaatacaagctggttttcagttttttttttatttaccgtacattttgaaaaattatgaccaacagtgttggatgtccttgccctctactcttaggtcttttccattcttagttttgcttatgtctaaattgttggaaataaaccatgctcttgctaatatagtttaagactcttactaggtttgaatgttactctgtgtatgtacatactactttaaataatcaacatttccctcctgttgccagatgtcacagtatgtagctattcatcttctgattttgttttcctttctattttttctaacctttaaacccctgaaactatcagttattttactataaggttgtctagtatgtcttcccatttttgtacatagagaaatgaccctgaaaatgttggttcagcattttaggcaataaatacttatttttacttcatgctgataattattatttattggtgcaactaacaagcactatctattcctatatataacttgcattgtattttaattaacttacaaaaggaaaataattcttttaaagtgggtattagttcaaccttattttttctcttcca

SEQ ID NO: 35020 - DNA, 1378 bp, Mus musculus
ctgcgcaacagagattagaagtccaaatgtgaatggctgcaggggtcagaagggaacagagatgcaggagacaggcaggatcagttgtggtaatgatgcctgtggcaaacacaaacacctacttgggctgcacacagtcacacaatcaatctataattcttggggttagctcagtccatttacttgtgtatttctgagtggttggtgagattactttattgaactgtttttttccttgttagatttttttttctctttttttgttttttaagatagggttgttctgtgtagctttggctctcctagaacttgctctgtagaccaggctggccttgaacacagaaagagattcatctgcctctgcctcctgagtgctgggattaaaggcaaaagccaccacagcctgttttgttttgttttcggtttaaaaacaacaacaaactgtgtgcatgcagaatacagaccttgaggttggctactgttcaagacagcttcagtctctctaccacattccatgtaaacctatggtgaagtaacaccagaaaaaagagcctgagagtggtcgcttccatcttccactccccttgttcttggggggaaaggaaggagacttctgctgttgcagtgagcccagagtggattggcattaaactggctgctttgacacacctcatctcacccaagagtatttcccaagtctgcagcttccgtcagcgattgttgtgttaccttctggtgttccctcactgattgtggacaaacctggcagttgagctttgcagtcaattatgccgtatccctgtgcaaactcccatgttctagttgctgttagcatcccctttgttgctgtctgagaaagtgaaagattgtgtatttctattaaaacatttacagtcaaaatcctaataacttgtgcttaaacatcatttaatctcatgagttttaaatgggtaaagtgctttgttcaggcacagtgactctggcaggagcctaagggagtactgaaggcagtcacgaagcactgggtgagcactgtgcaggcacagcctgggaggcctgactctcccatcagtgctctcagaaccactggccagaaccttgctgaggtacaaagcttgatcactgtcagaaactaggaagttacacaggacccgagagacattgcttcttaggagtctgacattttggaagctgtattatattcaagggataagatagatcaaaacaccatttgtttctaagtgcaatcactatagaaaatcaaatatttaattttcatttaaaaacatgaacaggagtgattttacacatattgtggttacagtctaaaaatgtgtaccttgggatacaccagaagcacctgagcattgccacttgt

SEQ ID NO: 35021 - DNA, 1153 bp, Mus musculus
ttggggaggtgtcttgactcttagcctattgctgctaacatttttaccctcctcttgccacatagcttcttcatctctatgtggcatacagagcttggagtctaaactgataacatattatttactgttgcaaaaataacacacatttttccccctaagctagactatcaactggcttcgtgattattttttagaaaagctacctatctcacttattctcaatattatggcaagaaaaagaaggcaaaatggagtactcttaaagaataggacagctttgtcagaaattgtagctgggtatagtgctgcatacctgtaaccccagcatttgcgaggccgaggcaagaggatcttgagttcaagattaaccttggctacaaacagagaagtgaacaaaatttagttgttaaattcaagttccctttctgcaaacaatgacctataatacacattttttattgtactgaatttattctttcatcagctcgttatgacatcatgtaaaaggaacataggcacatagaaataaattctgtctttgtgtgtgtgtgtgcttgtgtgtgctcgcggctctacacgcacatgtcttcgggatcgtgtggaagtcggaggataacttttgggagtcctccctttacacttcgttgaggcagagtcgcaattgctgtgtatcccaggctagctgatcaacttcagcggttctcctatgtatgcctcccttgctgcattcgggctgctggattgacagccgctccaatgctcccctggcttccctgggatctttgggtttctgccacagtgcttttgccttttgaactaattccctgaccctagaaatacattacatccgccaaagtcaaggctttacagttgacacctcacatctatatgcctttttaaaaaggtttgtgtgtatgcgtgagggtatgtgcatgtgagtgcagttcccatagaaaccagaggtattggatccccctgagaactggtcttatgggtggttgtgagcagccagaaatggctactgagaaccaaacttggggcctctgcaatatcattattaactcttaactgctgagccatctctggtccgcttttgcagtttttaaaacctatcattttcccttgaatgtgtctggacatcaagatttacacc

SEQ ID NO: 35022 - DNA, 1164 bp, Mus musculus
cgtttagcagtaatccctgacttggactgacttgagagtatttataaagtttgctagctgtgcctttcctccagctgctgctggatattagattacagtttatccggttgtgctgctggttatgttacgtacgacatcatagatgtgaactgtatgaagagactctgaattccaaatacatgactcaatttttggataagggagtattagttcttattttacattaatttcatacaatatagaatacagatgatcaaaagtgataaattaaagctgggtgtactggcacatgactttaatcccagcatttgggaggcagaggcaggcagatctttgagttcaaggccagtctggtctaaaaagtgggttctaggacaaccaggactacccagagggggaaaaatataacaacaaaccctaaacaaactcagatcttacctgtttgctgggcatagtagtatgtgcctatagtccagccactcaggaggctgaagcaggaggattacttggaatttaagactagcctgggcagcatagtaagaccctgtttttaaaaaagaaaagaaaatcatgacatatcactgcacaccaaagcaaaagtgagaggactgagtacaccagatgctgaaactgtcagacacggttagtgaacatgtaaaataataaagatgtgtcgggggggggggtatgggggacttttgggatagcattggaaatgtaaatgaagaaaatacctaattaaaaaaaaaaaaaaaagatgcgtcctcacagagttgaacactcactgagcagccactctgcttctggatatttgctcaaaagaaatgaaaacacatgtccatggaagttactgtacaagaactttattcacagtaaccaatagcagcccaccacatgtctgcagaagaatggatgaaaaagatccacagcatcacccaacatggtggtctccactgttaatcccagtattcaggaggcgaggcaggccagtctctgagatgagcctatcacatacaagaccccatctgttaattactgttatatagatgtgatgaagtaccatgaccaagtcaagtcaacttaggaagcatttaattaggagtttgcttacagtttcagagggttagtcaatggtcactatggcagagagtgtgagggcaggca

SEQ ID NO: 35023 - DNA, 1111 bp, Mus musculus
ctgtctccccagctatgtccgacttccacgtacacccccaggccgtcacgggtgaggagggtggtgtggcccgcttccagtgccaaatccatgggcttcccaagcccctgatcacatgggagaagaacagagttcccattgacacggacgatgagaggtgagcctcttgtgggaaggacaggggataactgggaagctgacttgggatagactacaggctgggacagtgctattatgtaagctgcagtcagaatcatgggtccgagtggcttactaggcccagattctaggctcatgagattgtgtaagagtattgtgtgtgttgttatcaagactaggagggtatgttctcctgggagggtctcagtaatcatctgtgatcacagcaataaggttgggttagtgcccatgtctccatttatatccccatggcttgaggttgcaacagctgtgctgatagtcaacaatgccctcccctcacaggtacacactactgcccaagggagtcctgcagataacaggacttcgggctgaggacagcggcatcttccactgtgtggcctcaaacattgctagtgtgcgggtcagccacggggccaggctcactgtgtcaggtgagctcctttggcctgccaggttctctcagccaccccagttggtctactcccagacacacctagttccccagtgagaccacgtgtatacagaggtcctttgagcataagcccacaagccaaaggcgcctgagactggttgccagtccgctctttctgggaagcatgtcttccctgagctctcccaagtctagaggtctggctgggagaggaaggacgattgtcaggacccgcaggttccccaacatctctctccttgtttttcaggacttggttgggggttggtgcgtaccctgggtcatgatggggcgggctggcgagagtgagggagtgaaaaagcttccaactgaaataaggaaatgtgggtttctcctcccaggctcgggctcagggacctacaaggagcccaccattcttgtggggcctgagaacctcaccctgacagtgcaccagactgcggtgctggagtgtgtcgccacgggcaacccgcgccccat

SEQ ID NO: 35024 - DNA, 1127 bp, Mus musculus
tggattttgagctgttgtgactctcagcacctacctcagccggaatgaatgtccttgggggtagtggggcagtagcctccgcctctaccccacagagcccgaaagcactcctacctcaagccccttaatgggggcccctcccacctatattgctgcccagagtaacagaaaaaggagaaaaaaagaaaaaaaagaaaaaaaaccagaaaattaaaaaaaaaaaacctaacccccaaaagaaccactgtcccaactccaagtgtgaaagaaactgtctacctcagggctcacggccctcagtgtgggcctgtgctgtcactggaccctcccccagcctccttcatccctggcctagcctacctctcccccacagaggaggctgtagctaggtgaccatgggggcttacagaaatagagatgaaactggtcagaaagaaaatgtgaaacaagccaaaaacaagaggaaagctgttccttaaagtataaatcatcccaaactagtcgcatccctgcctgccacctgaactccggctcctgtgtctgtccgcccttgttctgaccttctcagacaacccactggccacctgcatccctatcgtcctccctgcctgggtttagggaaggtgggacataacctgtctcctgttctcccagacacagggcccagtctctggaatgtattgcattgtgtggaggtgggtgctctcccatagaggcacaccagctttctgggacccaggtaacctgacctgcccagtcagcaggggtggccaagagttatttttttatgaggtgtgtttacgttttatttctcttttctgttgtattgttctttgaactacttaggttaaaaagtaagaaacagaaaggaaaaaaaaaaccacaaatacctatttttggttacactcagaaacatttttttaaatagcagaagaaaaactttttttaaagaaaaaaaaaaaaggttaagtgtattctttaaaaaatgaggttagaacataaagtccctgaccccaaatcctctagggattcccaccctgaactctagagaattagctaaaaggtagaatttgtggcgtttcattagaaacccagactcttgtccaagtggacttgggaagggcagt

SEQ ID NO: 35025 - DNA, 1174 bp, Mus musculus
acctcacagttgaatggtatgctcttgttcaaatttattgcagtaattagggttgggaatatagctcgttgtagagtgcttgtctaatacgtgtgaggctctacttccaatccccagcatcacaagagtaaaaataaaacaaatgtagattttaagttaataaaacatagatgtacagaaacacagactataaaaatctgattctcagacttgaactaccagccagttctgggcgtcgccctctggtggcccagccggacactgcgtggaggcaccgcccccgcccgtgtccgcagggcggggccgccatattatttgcatacccacagaacactgcgcacaatacaaaaacatatcgaaaaattaatgtgttgctctgagaatatctccgtgaaagttagattaaatttataaaacaaaaagagtggttctgtttagctagaatagttgcgagtcaagtggacaccatcactgtgctaggagttgttcttacccgagctgtgagttacagtactggtaagcatactctggtttctcttcagatcgtataaatctttcgccttttactaaagatttccgtggagaggaacaactctgagtcttaaaccaattttttgaggccttgtttcggcaaggctatatttagaatgtctaacaacagaactactactgtgcattactgatagtttgtatatctactcactgctttaagtgacctacacagccaagcgttgaaatagagctctggtagacagcttgtgtgtgtgcttgtgtgtgttttaaggggaaaaaactgtgaggagaaggcatgtagattttaagcccatcctggtctatatagcaagcttcagggcatacatggactttgatcaaaaacaagcttaccattagccacagttaaaattctgctcagcaccagaccaacattctcttgaagagaggggctaagtcagacccaatgaaagactccgtgatgatggagaggggtatagccggatcatattgcagtgtttcctctggtggacccccttttccagcctgagggctagggctgaaggtcccagggaagccaatgtttcggacttgactttgaggctgacaaaagactccaggttgttgtggcagggagagaaaagatttggggagatgctgttctcagctagctgggagctaa

SEQ ID NO: 35026 - DNA, 1308 bp, Mus musculus
gacagataggctaactggaagaaagggtattcagttgacatttgtggaaatttgatgtgtcagcaatttcctttaacccctacctataggaaaaactggtttttctagctttcttaaggcctactggtgcacttgaggcaaatactcatttgaatcacagttttaaattgaatagctgggcagaggtgattttaatattaattgacataaaagtgaggactatgactctactgtcttggccatagaaaagaccaggcacactttggaggtagcatcagagtgtgaaactacagcttgtacttctgttgcctagaatgacagaacaataggcaattgacttatttataaaatgacctgaatgtaatgagaagccgttttaatatatggaatatgaaagcttttacactgattaaaattgaagcattgggggctggtgagatggctcagtgggtaagagcacccgactgctcttccgaaggtccggagttcaaatcccagcaaccacatggtggctcacaaccatctgtaacaagatctgatgccctctgaagacagctacagtgtacttacatataataaataaataaatctttaaaaaaaaaaaattgaagcatttttatggactcaattttcctcctaatttattaccttttctctttttttctttaggaaaagctgttactagaaccaatgttcgaagttcctaattctgacattgtatgtgtggaagttgacaaagaagtagtagaaggcaaaaaggaaccaggatacattcggtaaagcgtgttctcaggccagaatagcgccagagttagggtccctactgcttgagtttattgggctgtcattgaaaatcggttttgtaaggaaagcaataacctcctgagttttctacaagataaaagtaatatggttttatagaataattttgtgactcattttgaaaactgatctttaaaacagcctctatttttttctccaactatcagtatacaaaagagacacacatacacctgttgtgtgtaacgccttgcccagaaatttccacgtgctggcccctctcggctccctttgtcccaccctgcttagcttctggctgggttgcaaccagacaactctgagcttccttttctacctgccagtgctcctggagaagtcgaattaccagaccacacctgagacccttgaatccacagatagaaaacacacagacagcttcatttagaatgatggtgtctgagtggtagacaagaatccactattattttaggaattcttggattgatcacgcactcacagtgatatagt

SEQ ID NO: 35027 - DNA, 1117 bp, Mus musculus
gcttctttttgcacaggggtctgtcctcctgcttcagcggatgagactttcgagcaccatcttcagcggctgagaaagctcattaaaaagcgctctgaactgtatgaagctgaagagagagccctccgagttatgctagaaggagagcaggaggaggagaggagacgagaactggaaaagaaacagagaaaagagaaagagaaacttctactacagaaacgggaaattgagtccaagttattcggggatccaggtaagtttatctttgccagtggagatgaggaaagatctaagttgatagttctttattgtcagtaacccaacttaagccaaaaggaagctctgattacaagttgagattcttaactgcatggtgacagtcagggctgcagaggagatgaggtttatcttactgtcataatcagcgccttgcgagtgcactcctaacagcaagcagacatggtgacgtgctgtgcctttctcttccagatgagttcccacttgctcacctcctgcagccattccggcagtattacctccaggctgagcactccttgcccgcgctcattcagataaggtcagaagggcaccctctgctgtccctttttcttgggtacgggaagctcttgaggtctattgctgtatcttttttaaaagttccttttgggtgtgcagtgttgcctagtttcaagggtgtcacctgtatctctaaagtcctcattaattcttggaagtcagtgtctccatttgaacaggtaaagaaactgaaacttgcctgtgactgctcgctctgtagattgtgttgtccttgaattcagagatctacttgcctcccttcattgctgggattaaaggcatgcactaccatagctggtcttggtttcttaattttagtgctgagtcaacccaggaacagaaacctttttcctgaatggttgccatggaggcgaaggccatgctgaccctgcataatactctcaactgagctagctacttagaggagctgggtgattcttagctgtggaggctgtgacaacatcttttctgcattgagtcttttgagaagtcagtgattggatgccccaggcagtgtaaacttgctgcctagaagcatctc

SEQ ID NO: 35028 - DNA, 1362 bp, Mus musculus
aagcactgcagctctagatattagagatgcggttgtctcacgctctagtcttctacacaacttaactctgtgtggcattgtcctagctggaaagcctttttcttttgttctctgccctaggcaggggtacctctggagccagaggttcataaggttcttctggaaaggatctagatgaactgaggttattagcatgggctgtagccttggctctctaaatctgcctctgttttgagaggcttggttcaatgtggcctgctcatttgttccaggtttgttatatattggtgggtaagaacaggcagcacacttggctactgcttgaaggtgttcactgagtagagttagcagctactgctccttatcttcccataccacctgccctccagctcccaggagcacctacagtttccagtttcagtgcagtgtgggaggctgctactgaagatgatggggcagtggctgccaggatcactgatggcttagaactgttgtcctgtggagagcttagaaaacttgaagagttagcagagccagggtggcttgtgctctgacagacagtgcctgttttcctcatgaaagtgccagtgcaagagttgtgagggaactagttgtgtggggcctccaagaatagaaacttatttccctgtgggactgtaatctcagtcacatggtaggggctggatagctcaagcttctaaaaacatccatgtcataaaagccgggaaaagagcaaatatgaaagataaattttatttttatattcattaataagtgctgttgtatttggacatgatcagtcatatgacatgttatggtttttgttttgccttattctgggttttgttatttaatttcctaaaagctgaataaataccatttttgcttttttgtttgagcctttgcccctgatttattccctctcaaatcatttgacacatttcatcttcacattgctaaagcatttcactccaaagttcaattttaatatgcaggtgtttgctgcaggaaaaatgagtcttcaacacaaaattttgtctgcagaatctgactctggatagcaagacaggtccccatcagctttggaaatgatgtggacttgggagcccttaggtgtaatatgctaacacctttgtccctttctgtagtcgaccgtacactgtcccatttgtacattatagtgctgcactgtacagctagggagtggggctatttttcccagcatgccttaagtctgctatgattagcttcactaccccacaggcctgtgctcctttgttgaactctgcacttcctgctatgagatgaggtgcaggaggagactaaagatggagggtgagtgttggtgtcagccttgtcact

SEQ ID NO: 35029 - DNA, 1149 bp, Mus musculus
ctattacacacttgtaatttattaaaagcttgatttacaagcaagaagatgacagcgtgggagaaagagaagtggttgtcaggaggcggaagtctttcgctctccattgtgtgtagcagtcaagggcggacttttctacttgaatcacacaagaagtttaaataaaatttgtatttataatgttcagcttaaaggagcttgtatcctttgaagagtaagacaactaaatggtgtgcatatattctaaaaggttgttttaaatggtgcatctatggacttcgggcctagctcagtaggtagagtgcctgcttagccatggtgaagttctgagttcgatccccagcacctcataatccagatagtggtgcacacctgtagtcccagcactcagcagaagcaggaacgtcagaagttgaagggcatcctcagctgtccgcgagttctgtaggacattccaatttggatttttattattgctggaaaaaagtttgctttaccccagacttgaaactggactccggcttggggtggggctcagttggtagaatacttgcctagtgtgtacacagtgctgtagtcccagtacttggaagatgaaggcgggaggatcagttcaaggcatcactaccaagcatgtttaaggcctgcccagggctggagagagggctcagcggttaagaacactgactgctcttccagaggtcctgagttcaattcccagcaaccacatggtggctcacaaccatctggaatgagatctgatgccttcttctggtgtgtctgaagacagctacagtgtactcacatataataataaatctttaaaaaacaaaaaaaggcctgcccagggtatatgaaaccttgtttaagaacaaaagcaaatgaaaaatgaactctgttgctagcttctagttaagtgacttgagacaacctacttaaatctttaaaactctggtttcttagtttaattatacgggtaataactgccttgcagaatgctatattacacaggaaatgcccaacatggacacttaataattggtagtgtttgctgtcacttctcaagtttactaaaccacagagtggccgtatcttagtcaagtactctggttatgtctgaaggtatctctggatgagattaacaacgtt

SEQ ID NO: 35030 - DNA, 1142 bp, Mus musculus
gggttttaaaaattatttactattatacagctgaacaggagggaggtagaggggagcagtcatcccggaggaagctgtggttgatagtgtctgtacacactgacagataaaacactggttttagctgaaggtcggtttctcatcaacacttatatttggtccagagagaggctctgactccttggcatggccgtgctcacagcagtggtgcccattcagtcacctctgctccccatagccatacccagatgttttcttccagggggctttgtttgttggctttagacttacttgtgtacatgcagatgcatatacttcagaggtcagcagaggatgttacctgtctctgtcacctccacccattcctctgaggcagggtctgggactacaggtatgtgcaggacgccagcctctcacatagccgttgggatccaaaccctggtcctcatgactgcagcaagcactcttaacttctgagtgctttttaactctctagtgtattgttttcttgatggggtaaatacatttatttaaataaaatatttgttaaatttataactgctgtagataattgagcctgctaggtactgatggcatactctgctattaacaacaaacttaagcaactcagtgtttaggatgtgccttatgtttatttataactaggttcatctgtttggggcatctttgggaggctttttggctcaaaaatttgctgaatacactcacaagtctcccagggtacactccctcatcctgtgcaatgccttcagtgacacgtctatcttcaaccaaacatggactgcaaataggtaaggatgtgtatctttaaatgttggctttgggggaatttgatgcagtgggaataggaagtggacaagaaaagaatgctgtgaactccaacttaactctactcagtgtgggctgggcatgtagtcatgctacagtaacaaatgttgctatagtaacagatgttgttgctacagtaacagatattgtcctgtcctgcttaccttgtaagatcagctctctcaatcaacacagtttcatgtgggtttccccaacattctgtcatgctctgagataaatctccatacagtttgctttccttcctttctgatttaggccctgaggcgtgatca

SEQ ID NO: 35031 - DNA, 2044 bp, Mus musculus
tacttaccaagcttgctgccactgagggactatctcagaagacaggtggacggccaatggtggttcagtgagtaaaaactgtcaccaagcccgactacccagttcagtgccagaaaaatacagaggaagagacagtcatctcccacagtttctctgacttccacacatatacaaagtaaattgtaatttcttaaaggagccctcaggggctagaaagatgactcagcagctcagaatactggttgttcttaagaggtcctgagttcaattcccagcaaccacatggtgccctgttctggtgaacaagaaaacagcactcatacataaagtacctaaataagtaaatttttaaaaagggggacaggggccccctaaagagtgacactgatgttgctctctgccctccacataatctcagaaagattcaggactagagataggggtcgcccattggtggagcctttgtatagcactgcgaagccctcgcttcaatcccagcagcataaaacaaaaccctcacaacagctaaagtaatctgcactcttccagatacatctgctgcagttccatggaaccaagtacgctgccatcgatccgtcagtggtcagtgcggaggagctagaggtgcagaaaggccgcctcggcctcagccaggaagagccatagatggggcttgagatgccgaaccaccctgctcttgcacaatcagttcgggttcgttggtcgggcacactggtcctcacccttctggaagtcggactgattgtcaatctcatgacaggcgtcagctcttctaaaccagtgtgactggcccctctccacatttgtttttgttttaaacttttaaatttgaagaacttttaaagactcccattttaagaattgtgaaaattttgctaccaaaagtcttctccactctgttcatctcaaaagcttgggatcatgtggcgttctctcttttcctgctttctataactgctgcacccacctccaggttagaagaggagcaccggtcatttttatgctttcttgggcataaccagagggtcgaggctggcagcctgctggccactccctacacatcagcttttttgctttccagttgagcacatcattttgagtattagctgttgtatttctagacattacatttggaataaaaattgaatttcagccagtggcttctgtgatgagtgaggctgcccctctgggctactggccagtgctgtgtgatgtcgggtgaacaagtccatcactctgactgcagcacggctggctgttacctgctgactgccgctgtagcctacgtgctcttttaatctttttcactaatgggattgttaaaaaagagatagagtctcatttaggctaggctggccttgaactcattatgtgtcagggctagcttagagctcctgatccccctgcctccacctcccaagtgctaggattacagatgttatcctgaaagatcaccagatgcccgatagaagtggttttaatacatatggagaacatagtaaactgtctccagctcttgatccaatgtagaaaacgtccagcctgtggatagccttgtctccctcccgcacttttctacatcccttcctatcctggatggctataaagcatttccatgtgtcctttcaagagatatgataggatacttgagacgctggggagatgagtctgtgagtaaaagtgcgtgctggacgagcatgagcacttgagaccgcccagtgcccgtgcacagtgtcaagagtgtccaggcagcctgtaacctcagatagcccagtgcccgtgcacagagtcaagagtgtctaggcagcctgtaacctcagatagcccagtgctcgtgcacagtgtcaagagtgtccaggcagcctgtaacctcagatagcccagtgcccgtgcacagtgtcaagagtgtccaggcagcctgtaacctcagatagcccagtgcccgtgcacagtgtcaagagtgtccacatagcctgtaacctcagatagcccagtgcccgtgcacagtgtcaagagtatccac

SEQ ID NO: 35032 - DNA, 1180 bp, Mus musculus
atggcatggatgatggtcctgagtcggccttacaggccatgggcatccctggacctgccccagaggatgcggcagcatccccagcactgcccttctcggacttgccatcccagtttcatcctcgctcctcttcccttggggacctactcagagaaagccctcagcatccacgactgcccaaggagaagttgtatcgggcccagctggaagtcaaggtggcttcgaaacagacagagaaattgttgaaccaggtgctgggcagcgaaccaccgcctgtgtgtgccgagtcattgctcagccaggctgtagagcaactgaggcaggccacacaagtcctgcaggaaatgagggatttgggagaactgaaccaagaaacccctgggctagtgcaaaaacggaaggagctggtgaccctctacaggagaagtgcaccctaggcctgctaagccctaggcacctaccccccaagtacccccatctgtcactacccaaccttgctaagaaatgagctacagctcagactgtagacgcaccactgggtacatcaagtttggccaggacttgaggctcctgatggcctttctactctaccctagcctggggctacctgtctggcctcttctctaggctctgggcttgggatggagcatagtcctgtggtctgtgtggttgatgcagactgcccccagggctttggcaccatggttggagtttccaggatggcaccgtctgttctcactgccaacggtttacattcctgacttccgggtagagcccagctgacctgcctgaggctcccatcttctggtcttcaggcagattcccaccagccacacccacttaagagtatctagaggggccttgggtctggctgtagtgaaatatgtggcctttagctggagcctaaagatggctaagggtctgggtgaaggggctctttactctggtttgttgccctctctgcaaatcgagggtcttctctgcagcatccctacccctgttggagagctgtaattagatgctcagatctcaaggcttccgaggggggaagagaaactcaggcttcctggtacagtctctgcttctgggccagcttctgtccagccttgcacattcctgaagatgaaaaccctagagtgggcctgtgttaacagttgaaaagcctgtatgaaattatcat

SEQ ID NO: 35033 - DNA, 1203 bp, Mus musculus
acaagggggcagagaagggcaaagaattagggaacagggaagcggacttggctggcccagggaatgacctgaacaggagccagtggttcgttctgtgggtgggaacagggtctccccaaagccaagcacagtcatgtggtggtggtagaatgagaaaagcagacagcgtaaattgaagggttctcaaatctttagagccgccttgggtaacaatacgccacgcgccacggagccgcagccccatccctaccccaccacgcccactcgtggaactctaaaacgcacccaagaccaaacacaaaaagcctgcttctggttaactgtcctcagagagttggaaagacgaagaaacgccggcccgtagacacgcccccgcccctgtccctgattggctagagaatttaaagaccaggccggtgatagggtggtttttctattcctagtatttgaatgttcttcctgctgaagctttctgccggccggttcagatcagctttttcatctgaaagcaacgagtctatcggatccttgaggtgggaggcaaagaacgcgattattttagtgatcctcgctgggagaggtacagattcgtgggtcagacggagggacaatggattcctgggcctggaggttccagacattccctaatcatttaccctttccaaagcactggaaccacactgaccctgatacctactaattggttattgaagggggtgtgcaagtctcagcctgttttcacttccagccagtctctttcccatcgcccaacgtgtgattattgttctgcttcctgggtagaagtccctaacgagtcccctgttggcctgggtgagtctcctcaacaagcttcttttctgagcaggaacacctttctaatgtggacattgcaggacaatcgctcgcgaatcctaagtgcatgtgaccccaccttccagcagcagaggacgtttctcctcgctccagagtgcttggaatatcttggtggcaccttctgttaccagtgacaacctgttgacactaagaggtctggacaggatttcccgtcaccgcagccataccacctattacatctcgattttctgtgacttatgcgctccggtctctgcacgcctgcagaggcattggagatgccttctagcacagaggcggcgaccgatgaatgtgacgatgcggagctccggtgccgggtagccgtggagg

SEQ ID NO: 35034 - DNA, 1361 bp, Mus musculus
cgtccattcaaggtgagtcaggatcgaggagcccccagagcccaggatcagggctgagcagcaagagttcatctctagtgtggattgaactgtagaaaggtgtttcagaaactggggtcacagatctggctctgtctgatggttctgctgactctcctcttatgccagttttttggtcctgccgaacctctgtttactcatctgtaaagtagagatggtaaagaatcttaacagactttgccatgtgaagaattcttgagatttgatgtagcctttttttttttttttttttttttctgaggaaactggataagggacttgctctcaaatggcaagttagtagagccctgggaatgccctgggcactgctgtaccatgtgattcagaacacttaaggcctcaggaactcagcctcaatgtgagggttgcctttggaggattacagaatgcttcaggggatcactgaggaaagatgaggctgatgggggagacagtgctgggttagcacagcaacagcttctgaccccctgaaatggccacctctctccacagggctatgaagggtccctgatcaagctcacctcaagacaggtaatttctcttctaggtttttcctctcagctcaggttaactgctggcatggaactgaaacgtttgtcctactgcttgaaggcatctgaaggtggagacccactccttgctgtcttgcttctgccctgacagaaggacagcctccacagctctctccttttctagccagctgggccttgtcagcctctctcctttctgtctggctctggcattctggaaacagactgcctggccccagtggctaaagtctgtagagatgagatgatagctgggctctggcctcctggaggaaaccaggagtgtgaagtcagaagctttcaaccttatctgcatgtatttacaatggttcctcctcctcctcttcctcctcctcctcttcctctcctcttcctgctgctgttgttgtttttactgttattatgttcttatgtttgtggtatttcgggggagggtgtcaagcccaaggtcttagacatgctagacaagtgctggacctggggtgcagatgcaaggcagggagagatgcaaggccgtcctctctttttcttcctactagcctgttggttttgtgatctttgacagccgggcaggagcggaagcagccaaaaacgcattgaatgtgagtagacagagggcctgcctgcctttctctgacggggtgattgaccccgttctgtccattgcaggtctccccttactgcccactaataaacatgtgggtttttatttcccacccatccctgggcggagtctctggctgcctggtgtat

SEQ ID NO: 35035 - DNA, 1831 bp, Mus musculus
tgctcacatgcatggatcctctccctgttcctgggcgcttgctggggctgtaggctgagggggagggaggcacctggctgcttcatccttctgtcctacacttactaccctgcaccccctccccctttgcagcctccacagccagttcccattccactctgctgatggcgctctctctttcccttcccttcaggtcttgtcaccctggagttggtcctgggttgtgtggggccaaaacagggctctgccctcactgccacccgaggcctgtgcggaactgctgcttccctctagacactgtgaatctgaagcctgactcagtggatggctcttgttttcttcctcagttctccaaggccttcagaaggatctgaggccttggatacctaggtccagtttgcaggcctcactgggacccagcgcagcctgtcctcctgctcagacttgtatctgtagctccccatctaggaaaagggacatttaattttgcatgtttatgaattgtgacacttgtgcaaatgtgtgtatggtttgttcccaaactgtcgccgtagcaacaggtcttggcactggaggctggtccagcctactgcttctttccactcctgcacccaccctgcttcaggggtccctgagcctgtggtcatttctgccttgggggtcccagctcctaacttgggagcacacgcgcacgcacatacacacacgtacacagactctgttctcatccaacagcagatccacagcctctgaattccacttcagatcagagccctgcatcgtctccttctccaggctgacaggtctgagaagcctgccttgcgcttgccttccccagtgcaccccaccctgccactgcacctcattcttcctgaacttcgaaaccaaccaaaacgtgaaaagtatttttgtaccctgtgtaacaaaatatttatggatcataaagggtttttcatgtgtttaccattaattattaaagagaccttgttcagcctgtcagataagtttaatgtttagtttgaagcatgaagaagaaaaggggtttccgttctttagcagttggcctttgtgtcgggctttggtttaagaagaatgagatgaaggataaattgtgcaattttgttttattttacgagcatgtctgtgctttacctttaaacctcagctcggatatctggctacttcggacaatgatgtctggaggtggctgttgtaattggtgaccctgtgagaatgtgaaactggatcataaatgaaatgcaaaataaaaacctgaagtgactctgctctgatttttgcttctacgatccatgggatgcaggctgctgggctgagggtgacaacagggaggccagaaacagtcctggcctggtggcaatctgggtggggacacctcagagctgctattgttgccttctgtaataagctgaggagcctgtcccaaagtggagagtgactgcaccagggtcttcaggtgcccaccctccatcatcccatcctctatgatgacttttctccttgctccgggaattctgaaggcagagatccttagtccctgcacccagtcaggagcctgagtgtgcctttatctgctcaccttcacccttccaaccctgtggtctctcaagcccccttgtactgaaaaagtgaagttggtgtgctagggtctctctccagagtctgaccttggtgtacatctactggcctgtagggacagaggatccacaaaaccttgcccctgatgcattaaactaaccagtgctgttagctgtggactgcaactgattcctgggaagaaagcagaaggtctttaaggttaggttgcactggg

SEQ ID NO: 35036 - DNA, 3732 bp, Mus musculus
tgtgataccagcagaccacaattagctgttttatctgtgtgtttccttcgcagaacaccaagtgcccagatgaagtcagcttcatgggccagactggctcattcgaggtgatgctggaggtgccatcttaccatcagttacggtgttgatcatcctgtttgccattccgaccgtgactgaaggcagacccttggctgcctcacctccactagaccctccgacccccgaccctccctcttcctcaggagctggagaactggtactttgcaaaaatatttattctctcagccacagttttgttgtggtcatctatggagatgaaggcataggagcaactgagagaacacagcctcatcccagagaaatgactgctctgttaccttagcccctggtctgctgccagagcagcaacacacacctgggagggaccccaagcacgggataaagtctgaagacagcacagcagccatacccctcactgtcattaccaccataaacaagattccacatctcctcagtggtttgggccctgggaactggcagcacgtggagaaattagaatctcaggaaagaagtagggagctgtttcctctgtaattgcgaagacaaggtcttcaagtgtggagacatccccctctgatgtgagcacagataaatgctcagagcctaacctgtaaaggggagagtaaggcacttgccccaccagagtcttgtgctcctgtcaggtggaagacaggggttctagcaccagcacaggctccctggggatgctgggaggaactggaacataagtggagtctgtgaaactgaacctgcttcctcaccaaaattcctgctgctttccagatcccccaactccttgtcctttctctttcttttttaaccccttggtgcctttcccaggggggattccccatactgacctcacttctactgcttggcttctacaactcaggcagtattaatagacttcctcccagcatgggtaaccttggagcctgccacatcactttagagcagcaaccagaaggcaggctgttcttggagacattcagttatctgagtatcctcatttagggtcacaaatatatccatcccagttcctctgtctacaggtacatgattttatacagttcactctgtaactccgtacgtgccaatatgaggagtgtctttataacacacgtttatgttttaggggccactggccaaggggagatgatttgctccttagaccctaaaacagcatatccaagcattatatgcccaagtcagagtggacacagtggataaggctttgaggtggcaggcatttctctgttctcctgagctacaaagtcatgttaggaaaaagtgatgacctagctttgttggagtcacgtcttcccagcatgtgggatgttttttaggtctttgctattgcagggtaccatccctttgaagccctttcctcctgtttttgccctttggactgcaagagagagagaaagatgcacagataccagcttaggctaatcgggagcttgaaacaagaatgtcaaaagtgacagtttgagagcaggaaggtaggtggctctaacttctttgggaaagtggggtggtgggagacattaagcacaaagcccaagagaagctagctcccgagaactcatgaaccctccatgtatataatcaggctttggtagttagcatctctgacctccaaacctttcctgtttccaagtccttgttttttttttttgagttgggttctgggcacttgggaaaatccttttgtctaaacagcctcctcgccaccattgtcccctctgccacatgctgccccagcaggagtctgggtagtgaccccctttcattcgtggaggtagatgttggagataacatcttatctaacccattacccttactaagaaagtgactgtcgcctaattatgcttctccccacaagactagtgagtagagccatgctcccatctgttcctgttttttttaaatattgtgttttgtatgtatctgtggcactggtttgcagtgtgctttgtacatattgtaaaaaaaaaaacattggagcaattttgtttttcactgggtaggcatggcccacattcctgccctttccacttttttcattttataacagaggtgtgtctgtatttgcaagacagccttagattctgcagaaggaacagctttctctctctcccctctccccttcccttccctccctctgtctgtctctctcccctcttcccgttagaaacaagtcagctttttgttccctctacccaagtgccccttgaaaaacaggtgctgctctgaaacgagattagcagtagaaaaatgaccctgtgttctcagctcctccctcctggtccctagtctgagtccggtcttcccgctctgaagtagtattacatacactacagctccagctgtggaaactcctgactagtgcttcaaaactgtccacctccacacctagtcagaaagacaggatctggtgcagaccaccaaaccaagcctctcactaagccaccctgcccatgctcttgctcttaatgatctccagggactcatgtggaagagaagctataggaagtaggggcctcaccctgaggaagggcagctaccgcttgccagctgctgcttaggactcacatctacttcctcatttccccatcttatacttgtacatgtagtctccactaagcctactctctccacacatctcaaggtcaaagaaacatagaagggtaagagggtaccctgtgaaatgatcctttcatgcaccttctctccaggctccagggtggggtgggggggacttagtttaagggagttagttctgcagaagggctagagaattggatatagatttgaggcctcatcacttaccccatataccttatctgtgtactctgatggcccccaagattcagctgggcagctagctggcccattattctgggcctttgtcatttattactagtttccaaggaaactttccagtgattccctgccatgggcccctcccaggccttatccctagcccctcctgccccagcccacccgcttgccttggtgctcagccctcccactgggagcaggttggggcaagctggaggctcgggctggagggacagtgttgctgttcatagcttttgttccattggcgttgctctgttgaatttaatttcagtcttcctgattcttcccttctgtaaagtgtacattaccaagttccttgtttttttatatatatatatataaatatatatatatacaaactgtactctttttgcctttgtacattcaggcaagaagagaaaataaatctttttaagagacaatcacaaatctgtgagggctgctggttatttctcctggagtttgctgctgagctgctgcctcctcccctagctgttctgttcccccctcagcttccctgtcttttctctagccctgctccatacccaccctcagcttcccctttcctggctgacagcaagctgttgaacccagtgtgcccacctgccctgtagcttcttcctgtccagcattgttttccagcttggccactggctgatcctgtatcctgacctttttttaaacccttagatctcattcaccaaagtggctttggacccctgggtgctctgggacctgcctcccagaggcccttggcttgggacatccattcatctatgaaactatgcacctgggagctctctg

SEQ ID NO: 35037 - DNA, 1211 bp, Mus musculus
gaaacaagcaatgatgcctttgactctttggaaaggaagtgtatggaaaaggaaaagtgtaaaaagccctccagtctgaaatctgaaaagattccatccaagagcttaaaatcagcccgccccattgcccctgccatccccccacaacagatctacactttccagacagccaccttcacagcagcaagcccaggttcctcctcaggcttgaccaccaccgtggtccaagcaatgcccaacagtccccaactcaagcccattcagcccaagcccactgttatgggagagcctttcacagtcaaccctgccctgacccctgccaaggacaagaaaaagaaagacaaaaaaaagaaggactcatcaaaggaacttgaaagtcctctgacccctgggaaggtatgccgagcagaagaaggtaagagcccgttcagagacgcagcaggagatggaatcaaagtggagagccttctgaacggctcctcagagtcccaccaaagccggttagctagtatcaaggctgaggctgataagatttacagtttcactgacaatgcccccagcccttcaattggaggcagcagccgcctagatagtactaccccgacccaacccctaactcccctccacgtagtgacccagaatggagccgaagccagctcagtcaaaaccaatagccctgcctactctgacatctctgatgctggggaggatggggagggcaaggtggacagtgccaagtcgaaggaccccgagcagctggttaaagaaggggctaagaaaacactgttcccccctcagccacagagcaaagactccccatattatcaaggctttgaaagttactactctccaggttatgcacagtccagcccagggactctcacctcaagcagccaggcaggaatggagggccagcccctaaagacaaaaaaggatgaggagcctgagagcgtagaagggaaagtaaagaatgatgtctgtgaggaaaagaagccggagctgagcaattccagtcagcagccctccgtcatccagcagcggcccaacatgtacatgcagtccctgtactacaaccagtatgcctacgtgcctccttatggctacagtgaccagagttaccacagccacctcctgagtaccaacaccgcttatcggcagcagtatgaagaacagcagaagcggcagagcctggagcagcagcagcagcagca

SEQ ID NO: 35038 - DNA, 1879 bp, Mus musculus
tcccttaaccacagtaaggctttttttcttcagtactagaatgacaaggaatctgtacactatttttagtaggggttggccctgttattagagagctgttaaggcttttgctagatcatgttctgagtcactgataattcaagcagctaacagtaaagggggtgtgagcagagttgcaccttccatctgtaatgtgctgcggcctgtactgattcagacaggagtaccagctggcagtggtaggagaagttaagcctttcaggaaggggcaactaattgtagaagactactagttaacactcaccacagactcttgggcaactagaaattctgtattcttccctgaggaggtggaatgggaattaccttctcgaggtccagtgtgacatggttggagatatcattgaacttgtcttgcccactgaggcatgatagccacacaggaagggtccagcttgtattaggagtttatttcaggctatctccttgcctgtattgttttctttaacagctttttaacattttctttttccagcaatgatgttgtccactggacatgttctgaccaaggaggcaggtctgagaacgtagctgaagctgaaaataggaaagctgggggcaaggaagagccttgaaccttgaggtgggacgttgactctaagatgtccttgagcagtggagcctgcggagggaaaggagtggatgcaaacccggttgagacatacgacagtggggatgaatgggacattggagtagggaacctcatcatcgacctggacgccgatctggaaaaggaccagcagaaactggaaatgtcaggctccaaggaggtggggataccagcccccaatgctgtggccacactaccagacaacatcaagtttgtcaccccagtgccaggtcctcaagggaaggaaggcaaatcaaaatccaaaaggagtaagagtggcaaagacgctagcaagcccactccagggacttccttgttctctccaagtgagggagcagccagcaagaaagaggtgcagggtcgcgcaggagatggtgccagtgcgggaggcctggttgctgctgttgctcccaagggctcagagaaggctgctaaggcgtcacgcagtgtagctggctccaaaaaggaaaaggagaacagctcatctaagggcaagaaggagagaagtgaaggcgtggggacttgttcggaaaaggatcctggggtcctccagccagttcccttgggaggacggggtagtcagtatgatggaagtgcagggatggacacaggaaccgtggagccgcttgggagtatagctattgaacctggggcagcgctcaatcctttgggaactaagccggagccagaggaaggggagaatgagtgccggccactaaagaaagtcaagtctgaaaaggtaagcggtggccagatctggctgcccactgcccatcagaactgccccggactaaccgccaaatgctgtgtgcactctgtgggaggctcgttagtttgtgggtaatgaccaattacaaggtcagagcagctggtaatgataatgtgattttgttccaaattagagaattccctacagactcatttgcagcaggcacagacctcttggaatacaatttctgtttggggatcagctacttggtagagtgaattttctcacaccttattattgtcacatgtcaagacacttgttgctagatgctgacattaaatcttcatgtgatttcctgcttggctgaaatctcctcatcaggatcatgatggttgataaatgtaaaaggctttggttacatgttcaacctgaatgatgttcttagtggggtaaatggtactgctgagtctatggcaggacaaagagttcattgtcatggt

SEQ ID NO: 35039 - DNA, 1152 bp, Mus musculus
cctggcagtaagtgccttcacctgctgagccatctgctggcccattattttgtttaagacaattgcatttcatgtggtacaagtggactcaggttcagtctgtagcctagagtagtcttgaactctgcctacctttacctcctgaatactagcattacagtgactaccaccatgcctgattgactggttttatgccattttgtcatgtggagagtaatggtatactcagtgccccagcaatagggaccctcatgatgtccttttatagccatatcttctataatgctgccccatttcacatcttccatagagggagggagggagggagggagggagggagggagggagggagagagagagagagagagtatgtgtgtgtgtgtgtgtgtgtgtgtgttcgtttctcctatttgttttgttccccttccaaacatagagtaagcagacttcctaagggaaaagcaggggtgcgttatctgctatgtaggaattaaaattcaaaggggaaagtgggatctccagagactgttggtgacagcaggttgccaacatcctgagctcacaagtgttgcagctctgtgctctctggcaggcttcggacgctagccaagagtgtctgcacgttacagcataaaactcccttgggtttcagaatgccagtcaagactagctagccccttgcatgccactgacaagaacaacaggccttttgttttgtgttttgttgtgttgttttgagacagggtctctctgtgttgctctggctgttctggaacttgctttgtagaccaagcttgcctcaaactcacagagatcttctgcctccccagtgctgggattaaaagcttttgccaccatattcaatttaaagatttattttttaattatgtagctgtgtgtgggtatgtgcatataagtacaggtgcctgcagatgccaaatgggggcatctatctgatatctaggagctagagtgataggtggttgtaagatgcctgatgtggatgctgggaaccaaacttgggttctctgaaagagcagtatgtgctcttaaccattgagccatttcttcagtccccaaataaatttcagcttcgtcttttagagtatcctggaatgtttaggagactgttcattttattaaagttgttag

SEQ ID NO: 35040 - DNA, 1148 bp, Mus musculus
taatagtttaccaagtagtagcaccttgaattccatgctgaaattgtctggctttcttaatatcacaataaaattgaaaggtaggatgggaagagaaaagaaggggttggaagttctctgttcttttatttgaagacagcctttacacagaagagtatggattgttttttctatgtgggtaatttgaatgcacaccttaaaagaaaaaagtcaggaatgtcaacagatgagctcatctgcccgagctttgcaagtttctaagaacccacctcagcttctcaaacacacagccagaaccacataaataaatggcagagctactcggaaacttctccttttcatggttaggctgggaaagtctgtctttggtttacatggcagtggtagtataaggtctctcttctgtttgctgagacacaagggaggaagtgtgggagaagtttgcgggtagatggccctcagttgctcactgatgaatagtatactttaaagtcagatggaaattcttagtagcctgagttcaagcttgtccaagaatagcttgttagtgtattatgacacttcactctgaccctgttactctggggcagtttcgcctaagaaagttctgaatttccgagatgcctttttgttgtagcttctgtgttcccttttgaatgactgaattaagatgccattaattcatacagtaaaggaattggctttttctttttgtttttcccagacaagactcagtttcctttgtatgagctcacagtagggaatgatggaaactatgggctttgtcagcgttgatgagaccttatctttagtgaagtgtttagaatagattaagaatttggccagatgtgatagtatacaccttaatcccagcactggggaggctgatctcttactatctcttatatagtaagtccctatcacaaaggagaacataaaaagaatttgggtttttgttgcttctttagctaatacagaactaagataataaagaactaagtgtcctatcttttctttttaaactgaaattttagtgtaaacctattttccccctagcatgtaaatgtgagacactacagagattagttttacaaataagtatagctatggacttatatgattatgacatttaatttttttccatttta

SEQ ID NO: 35041 - DNA, 1191 bp, Mus musculus
ccatagtgtgcacacacttatgcgtgttttcacatgtgtaaaaatttcttttaggccagacagtggtggcgcacgcctttagtctcagcactcgggaggcagaggcaggcagatttctgagtttgaggccaacctggtctacaaagtgagttccaggacagccagggctgtacagagaaaccctgtctcgaaacaaacaaacaaacaaaacaaaacaaattcttttaaaaacataccaagctgattgctccattttccttgctctaggtatattaggctattgagagctactaacaaataaagcaattgctaggtttaattaccttgccttatcagggcacctgattataagaaacctgacttttccccttctctcataacttttgagtaatttgtaagtagttactcagcagaagtgaggcttgcctccctggttcttttctttgtcgctgatcagtgctcctgtgatgtctttgtactatcaggcacaagaaagcaacaactccgtaaagaagaagacaagatttgtcaatttatatacaagagagggacaggacaaacttgcagtcctgcttcctggtcgtcacccgtgtgattgcctgggccagaagcacaaactcatcaataactgtctggtctgtgggcggatcgtttgtgagcaggagggttcaggcccctgcttgttctgtggctctttggtaaagtccttctttcatgttttgtttttactctgtgtcctggttgggtggggtttttttgtttgttttgttttgtttttttttttttttttttaagatttatttatttattatatgtaagtacactgtagctgtcttcagacactccagaagagggagtcagatcttgttacggatggttgtgagccaccatgtggttgctgggatttgaactctggaccatcggaagagcagtcgggtgctctaacccactgagccatctcaccagcccgtttgttttgtttttattgttgttgttttttgtcaacttgaattatctgagaagtgtgtgtgtgtgtatatatatatatatatatatatatatatatatatatacatggtgaacagatatatgcatatatatgtgtgtatatgcaaaatattcgaacattcagacaataaaaataaggatatattaaacaaaaaaccctttcctcctattaaattgttttta

SEQ ID NO: 35042 - DNA, 2621 bp, Mus musculus
aggctatagagggagttccagccagccaggactaggactatacagaggatctctgtcttgaaaaaacaaaaagaaagaaaagagttaaaagaccagtttgtcttgaggacttaactagttgacaaccatacaaagagataaaatactaacagaagcagggacaaagactccatagatacattaaaaggatttttttggatatacattcagttcgttatcataaaacagtactttttttcatgtactactttttctttcctatgtaccccctgacagctcctctgttagcccggcttgtcttggaactcacttggcagtcaggctgaggtgggattcaaggtgggcaccaccacgcccttagataaaataatgagacaaatcgtgctgcaaatcaggttttatatgtcaggtccttagcatttccccgtcatttctcaagatgacttgagatcattgaacttatagatatagtagtaactgttttgagataggatctcattatatagcctcttaggtggccttatgtagaacacgctaaccttgaattcacagagatctgcctatctgtctatcatctgctaggattataggtgggaacatgcatttttactttttattttgttatatttatctcattttcgtgtgtgtgtgtgtgtgtgtgtgtgtgtgtgtgcttgtatgcacacgaaattgtgtgtttgggtatgtgtggaggctcaaggatgctattgaatctcctgtattcacaacacaaggaaccatgggtatgtcaaccagggtagcctcaaacttcctctttttttttttttttttgtaatcctactgtctcagtctccctgggtgctggggttaacggtgtgtacccccataataaatgatatacttgactttctcctcatggtttgacagactatcactttttcaaaattaaccatgtttttggcagcctatcttttttacattaaaattttcaatattacctaagtaaaatctcttgtcatttatcagaatgggttggggaggcaaagataaaatgctgaaaagctagttgtgtatctttttaagggtttctctgtgtagccctggctgtcctggaactcactctgtagaccaggctggcctcaaactcagaaatccaactgcttagacattaagcagaacctctttcaatccaaagtactttgaaaatcatgtttcttgtttctctgttttttgtttgtgcttttgcctttttaaataaacatttatttttattttgcatacatgaatatttggcctgcatgtatacatgtggactatgtgtatgagtgtatgtggtgtgtgtggcctgtagagggcagaagaaggcctcagacctcctagacctggagttagagatagttgcaagctgtcatgtgggttttggaaactgaacctgggaccttcacaagaacatcaagtgctctcaaccatggtccatcctccatgccctaagtttcagctttttttagagagggtctcaccaaagctcagattgaactgaaactccatgtagcccaagttggcttggcaatcatactgccttggccttccaagtgctcagattgcaggaatttgctaataaaaggggtgggattgtttttaagaagtatgggttttgtttgtttgtttgcttgtttgtttagttacaacccccttttaagaattatttatgtatatgagcacactggagctgtcttcagacacaccagaagaggtcattagatcccattacagatggttgtgagccaccaatgtggctcctagggataggacctctggaagagcagtcagtgctcttaaccattgagccatctctctagccccttgaagaagtatgttaaattaagttttttaaggttagattttagtggctctgagatctaatttgctctttttcactagtagaactactttatgatggtgagcctaattttgatgtgtataattgtttctaaaatgtaaaatgaacttaattgtattattgagtgtgcatacatatacgtatatggtgtggatgtgttgaggaacatgtgtaaaggttagaggacaacttgtgagaatcagtgctttccaccatgatcaaattcaggtcctcgggcttggcaggaagtaccttgacttgtactgagccatctttccagcccctttctgccccccaccccactcctttgagaaaagggctccctaaattctactatacttagaatcttaaagattaactcttctttcttttggttttgaagatagagtttcagtatagccttggctattctggaacttgcactatagaccagaggctggcttcaaactcaagagatctgcctgcctcagcctcccgagagctaggattaaagggatgtgccactactgcctggctgagatgaactcttttttagaaaaactgcaagtttaactgggacttgcaagtttaaccaacattgttataattggtcttttattttttctttttcttttttttttttaatctttgagaatagcatatagaaatcaaagaaactgtcatcaaatcaaatttgtaggactattagaaaccatcttgttcaatgcaggccagccagtaagtgttcactaaatggact

SEQ ID NO: 35043 - DNA, 1167 bp, Mus musculus
aaaccactccccaaggctttatgcttgcttccaaaaacacaagagaaaaaaattagcctagctgtgagaaatgttcaaaggacttttgcttttcagccttaactctgactagagggagtttgccctgagcatttgtaattggagatgctctgattaagatttaggacactatttggtgttgaaaaaaaaccctagactaagacttgtttcaagtgaataatcttggtattattcctaggaaacgagagaggtaaatcccagtccttgctgtaatcggtctacagaaggagttcctggacagccagggctacacagagaaaccctgtcttgaaacaaaacaaaacaaaaaaaggggatgtagttagcatgtgcaaggccctggcttttgtactgatcaccaaaaaaacaaccaagcaagcaaatcaaaatattgtagatacaggttagtggttcttggacatggcacatggtcatgttttgtcaatactctttggagagctgaaaagaatatatttttgagttttgagagcaatgataattaagaggaatagggccatagaagctgaggagtttctctgttctttctccaaatttattattagcatacaaggccctgtgcacttgaaagcgcatgttactgcttcctttaattagatataattctagttctctgattggacttgcctagtgactcttaagtatgtagtgtgtatcagaatcccttagagagtttatcagagttgtactgttaagactttccaattaaactctacttgctcaggatcccaaaatgtttattttaaacaaattaccagaagatgctcatgttcttggccactagatcatgatttaagattctctgtattggccgggcagtggtggcacacgcctttaatcccagcacttgggaggcagaagcaggtggatttctgagttcgaggccagcctggtctacagagtgagttccaggacagccagggctacacagagaaaccctgtctcgaaaaacaaacaaacaaaacaaacaaacaaagaaatctctgcattggtgactatactctcatgaccacatctctttgtaactgctaattcttttctttgcagtcttccctcatcctgtttttgagatagggagggtctcattgtgtagccccaattggtccagaa

SEQ ID NO: 35044 - DNA, 1124 bp, Mus musculus
caaactcagccaggtcttctggatgggttgtctggggcctaggacttagagccttgggggcacggagctccgattgtggtgctggggattaactcagggccgcaagcattccaggttaagcctctcacagagccaaccacacgggcactctcaaacgtggtcccaggttgtccagcctagactctgactcccgagttcaagtgatcccctagcctcagcctcctgaaagctaggaccataggcatgtgcgaggcacctggccaggctgtttattcttgacactccccacctccatgccaggttaggaagaaccagtgcccctgacctgtctgtatctgtggcttaggcgcctttggggaaaagatttcctacttgaagcccttgcccgttccagctggatccttggtgaggactaccgaggtttaacctccacattttaacttaccatgccctctagaactttgccgaaaaccacatgcttgccatccagccaggaggtcttgactgtggttatgaagaactgtgagccattggtgtctttgcctgcattggccatgctcacccagccaggcccgtagtgcttcagcttgaagttctcatctgggaagcgctcaccatagatgctctttcctaggaagaggcagagcaggtcagggagggggggctgaccccaaacagcaggtgcctgggcgaggatctgtccttgttaggctaggctttggtggcaaacaaggacagatgtcttctgtcttctacccaagctgtcaggaccaagaccacctagggtgtgaggccaggctgggggcgtgggtgtagaatccttcagaaaagggctgctgtaaccttcccagggttacaaaacaggtgcagcttcggggggaggggggagttagaactcctatttgtttttaccaaggaacataaaataaaagatgcccatgaacatttgtcattgtgtggtcttacccgcgttctcgcgaccggccaggaaagacgcaacaaaccggaatcttctgcggcaaaagctttattgcttacatcttcaggagcaagagagcaagagagcaagagcaagagcaagagcaagagagagcaagaaagcaagaaaaagaacaagaaagcaa

SEQ ID NO: 35045 - DNA, 1383 bp, Mus musculus
gcaagggcttcaagtaggaaatcttttccccaaaggcgcctaagccacagatacagacaggtcaggggcactggttcttcctaacctggcatggaggtggggagtgtcaagaataaacagcctggccaggtgcctcgcacatgcctatggtcctagctttcaggaggctgaggctaggggatcacttgaactcgggagtcagagtctaggctggacaacctgggaccacgtttgagagtgcccgtgtggttggctctgtgagaggcttaacctggaatgcttgcggccctgagttaatccccagcaccacaatcggagctccgtgcccccaaggctctaagtcctaggccccagacaacccatccagaagacctggctgagtttgtccggctgcggggtcctgtttggtcactcatggagtcaggggtgttcggaatcacgtctgagcagcgttggatcagctgtccagcatcgtgttctgtgttcacctatgtggggctctctcccaggagtgtgcctcttgacccccgctcaacctctcctctcctgcctttcctgtctaggatgtggtacggaaggtggagagcaccaagacagacagccgggacaagccactgaaggatgtcatcattgtcgactccggcaagatcgaagtggagaaacccttcgccattgccaaggagtagagagcctgggggacctcatccctctaagcagctgtctgtgtgggtcctgtcaatccccacacagacgaaggtagccagtcacaaggttctgtgccaccctggccctagtgcttccatctgatggggtgaccacacccctcacattccacaggcctgatttttataaaaaactaccaatgctgatcaataaagtgggttttttttatagcttgggtgtgggctgtgtttgggggtgtatataacacctgtcctgagtgtgtgtccctgtgtgggactcttctgtgctgatggacgcatgctcctcccccgggttcctgccttagcctgtactagtgcaacccacccactcaccaggcagagactttctagctagctcctgtgcctcatcttaagcttacacctgtcaggctgggctagaaaatacacctgactcttctcagcctacctctgaaattacctcacacctttctctttatcttgacttcgccacgacccctgggcttttaagagtcttgagttctaccagctacagctgtcagtgcaaaccaggctcagagctttgagtggggatgggcacatctgagcctcagccagttacacctgagtctagtccaagggaagacccattttcctgagactgaggcacatagctgtcctgaaaggtggcccaatgcctgggctagtcagggcactagtg

SEQ ID NO: 35046 - DNA, 1176 bp, Mus musculus
tgtgctgaggaagcctggcacacatccagggaatctttgcagggaatggggagcaaataaacagggccacaaggcttccccccaccttgctgtggactgcctttgaagtctgtagagtgcaggtggcctggccagcaattgtcttctaacagcgctgcttctgttccaagactagaaacaggaagccagtaatgacctttggagagcctagagcaggtgagtgagtgtgtgggtgaggtgaaggcagtaagtaggttgtggccattttaagtgtttatgtaaagtctccttaagctgtcagcatggtgacttatgccggtaatgccagcacttgagagactggggcaagaggttcaggagttcacggtcatcctcagctctacaatgagatcaggcctgcctggcctacctgagaccttgtctcaaaaggaaaacaaattctgttaccaggcctgttgtttgcatcagtttaaaaggctgcatccttgctgtagacttagagcctgcagagctgagcaaggtcaattaagttttggtgcctgcttgttttcctagtactctgcatatgtgtaagcggctactgtaatcgctaatacgttgaaggctttccctgagagtgggaccatgtgctccactcccacggtattcatagctcctcacacgtggcagactcaggaaagtgtagactcttggtctgacttggttgaggtaggcagtttggaaaccttattagtgtcaggttttggcatcaggccaccctctgtgctccagtcacccagccctggcctggagtcgcatggcgctggcccattcactggaagcttgaagagggcctgacccaagcttgtgcttttagacattaaatgcctcagctaacagtggctgcagaggctgcccttgctcagtgcttccctggcacagctgctgggggatcctccttctaaggcagagccagccaggactgctgaagagctggctgtgctcctcccaactgccctcccccataggctgccttcgaccagcgcatgaagacatggcagcgctggcaggatgctcaagccacgctgcagaagaagcgggagtctgaggcacggctgctgtgggccaacaagcctgacaaactgcagcaggctaaggatgagatcacagaggtgagtttcccaccaaagctagccc

SEQ ID NO: 35047 - DNA, 1192 bp, Mus musculus
ataaataccagagtcactcctttacttggcctggtgacctgagcaagcagctgactctcggagaatgctggggcgtcttccttgaggcagccagacttagtcctgtgtagtcagcaagagcttctccctcccaaccctgtgaccaactgaggccgtttcttacccttcattctgagtttggagcctggcttgcaaagcccttagttgtcagatatgtgggggccagagtcaacaagctgtgctatgcgggctcgagcgcctttcccctttcctgagagatcagaagcctctgctgtctttgcctccttccagaactagcgctgaacacagccctgtttgccaagagtctagccatgcttgggagctccgaggacaacacagcactttctcgagcgctctcccaactggctgaggtggaagaaaagattgagcagctccaccaggaacaggccaacaatgacttcttcctccttgctgaactcctgagtgactatattcgcctcctggccattgtccgagtaagccttccttcccccagctgtcttctgctcttcacttcctaagaaaaggaccctgtagacccagcaacccacttacactagctagttacctctagttattctgaggctcacagcagcccactcttggatttccaagttggctcattattgttgaggacagacagtattctctgtgcacctttctccaagcaaggcttattacagactgctgcttggcccctggagcagtgactctgcagtcctttggtctttgccctgataagagctcttgctggcttccacttgtctttccagtgtgagtagtcaggtaatgacacagaactggcttggtgttgcatggaggagtgtgctgagagagctttcaccagggccctccctccttgtgctgtgctaaccacactggtagcaacactgcacgctgcccctcaggtcacatacctcgggtctcctggtgaccagggtggtctgtttccaagctctcttaccagttaaagaagctttactgggcagtattattagctcttgcatggcctccatgataaagggagaaaccaagaggaacctggcacttgcactgtaaggacctgattctgcacggtatcaggatgcatgagcctccccctactcctcatccccagcgcatctcccactgtggagcttctgtgctgtgt

SEQ ID NO: 35048 - DNA, 1215 bp, Mus musculus
tcatctccgttatcattactacatagtgaacacagataaagttctctcgctgtaatttgggtggtggtcgatagaaatcctccccatggagagaagctgcactaaactaagtttctaggagataagaaaactaagccttccctgtccgtaggcatgcctatcaacattggtcttccaaaataacccctttcaccgcaaaggaaatccacttccggcctggtcagaaagtaagaaaaatttgtttggaagtggcttcctctgagaaatagctgtagagtctccgttctagaatatcttccagtagtagtaaccttgatctcctttcccctacctctttaggattcatctttagttcttcctaggaactgagtggggcatttggtgacgtataacagtccgttacacgatcctctggctaagactacaagccccatatacatttcgccgccgctccgctaacgccccttagacatcccagcatgcaatgcgcctaacgggccgtaaggatttttctgtgccttctaaatcgagcagagcatcttgggacatgtagtctttacagctaatttccctaggtccttcgcgttgcagttttgagtcccgcctattctctgctcccctaaacctttacacatgtcttggtttatttgaagaccaggaagttctctctcgaggtcggctgcggaaagacggtggctcggttgggacagtcgccagggatggcggaacgtgaggatggagcgagtgtctgggctgctttcctggacgctgagcagggtcctatggctctcaggcttttctgagcacggagctgcctggcagccccggatcatggaagagaaagcgctagaagtttatggtaatttacccagggcactatttgacggtgtttgagaggcggcattggagagggggtggaggagggcctcacccttgggctggagtggacccttggggtttttaccagacttagagggaagcatgttcttccgggtcctaagtcacacagcaatgtcgggctatttctaaacctggagcgaaattgagccaggaactcataaacgctttgttaccctggactgcctacagctctagggacagtgtcaagggatgtgggcagaatgagcctacagtgatcaagaagcaaagcatgccgaagatttcactactcaagagtctttccttctttagttcctggacttgcgttcctcccgc

SEQ ID NO: 35049 - DNA, 1471 bp, Mus musculus
cgcgagagagtatttttctcttgagacggctttcaggaccttagtcattgcattaggatggattagttaaaagcacttgctgttcttcccaaggactggggttcagtgtccaggacccacatcaggcagctcacaatcactcagagcttcagccccaggggatccagtgccctattctggcctccatatacacttgtgagcagtgcatgtgtgtgtgtgtgtgtgtgtgtgtgtgtgtatgcccaagggaaaaaaatcttaataaactgtatgatgagttagctgtaagttctcaaggagttaaatgctttgctttagcaggctggaaaaatgctgctgactgacctctctgtcagcacagttctgttaacttttgtccttgtgttttgcagtcaacaagcagataaatgacaaagagcgagtggcagctgcaatggagaaccccaaccttcgggaaatcgtggaacagtgcgtcctcgagccggactgacccctccctaagagccagtggcttagaagtgttggatctgctagtttcaatcctttgtaagatgtagaggacacatgttgactagataggtgatttgtacctcagagctttttttgttttttgttttttcgagacaaggtttctctgtgtggccctggctgtcctggaacttgttctgttgaccaggctggccttgaactcagagatccacctggctctgtctcccaaatgctgggattaaaggtgtacaccaccactgcctggccttcagagcatcttttaagaggattctttctgagcaaatttcagttatgaggtagattctaattgttcaatgagtaacattctcaggatttctaactcaagtgatcagacagaaaatattttctagttattatgtgtaaaatgttactatttttctgatgaccattctgatacaactgcttttcatgtcaaatatctactgtgcccaaatgtatttgatttaaaccattctaaaataaatatgacacgattcttttaatggctcaccttaggtttttactgaattataaattctaatgtaaacgtgaacttttaacaggcatctccatagctgtgttctctgattattgtgtagagtgaggtctaagaatggaaaggtgaggcctgctttccctttgggagaatgctggacccatgcatttagagttgagggtcagatgacttatctagttttaactagtttattttatgtgtatgattgttttgcctgcatgtatatatgtgtaccacatgcttgcctgaggagttcagaagaagggatcaaatcccctggaactagaattacagttgttagttgccatgtaggtgctgggatcgaacctaggtcgtttggaagagcagtgtaggtgggtgctcttagccactcaacaaccatccatctctccagcttcatagtcacagttttaaaggagtctcctcaagaagagcggaggatct

SEQ ID NO: 35050 - DNA, 1188 bp, Mus musculus
ccaaccacttccccatagactgagctcaggggacccagtgtcccacaaactacctttccaagaggccttgattattgactggcacaaatggtaccagatggcattttcactgctataactgggcccctcctggtacctgtttccccagggatactccaaggaggaggccccaaggcagctagtttggtcccatttcaagtccccttcctattcctgcatggcagaggcctctggatggagctgagggcttcctttgacatcaccccactttcccagcttatcggccccttgcttgcctctctgagcgtggggtgctcagtgtggcttcattcatgtcatctgatgatgccctgccctgggcctctttttctcctccccagaggaactgcgagagtgacacagaggagaacatcgccaggaggaaagcccttcacccccggaggaggagcagtacctcctaactggcccagcttgcagtggctgccagggaggtccaagttcctgccgccctgctgtgcaagctcccggaccctgcttgacatcaggatccagacattctgtgttcctgagcactttgcaagagagaggagtctgcaggactcagaactttccggagaccctgggagttgtggctgtctcccggtggggaacctccagcattcctctggcttgtagttctccagaaaactggctttcatctgtctgctaacctcagaagctggaattgggtgtggactaaggaaatggatctcaaggagtatcttttttttttttaaccacaggttaaaggtcagatttaggcagctttcctcacagagcctaccctgtcaagctcgtgagtaaagactctctagagggagggaccaatcctgtgacttaacagaatccataaggagtcaggctgtttaacgtcagactgtgtctgccagcctcttgccagcccactgtgttgtaggttttttctcatttttattattaaatttcttgtttatctaatgcttgggtgttttagagctgtctccctctggttccctatagcccgagaccccgtggcttggggaacactagggttggctgctaagtggacagaacctcaggtgatctgagcagtcttctcttactgataagatgtggcccttgtgtgtcctcccttgaaagtgtccccctctggcaccccatcacaaaagg

SEQ ID NO: 35051 - DNA, 1150 bp, Mus musculus
catattcatttatgtcttttgcatctccataacccataccaagattcaaattccatgagatcagagtcatggttcaaaactgtatccacagtacctgaaacagtatttgtgcatttgtcaagtagttgtttcaaatgtccgtgaaattcagatgttggggaacaaaagctattaatattacctcagacctgttttctgagtccttttaaatgtcattgtatcattttattttcagattgggacagtgcaactttaagcaatgagtcactcttggacactgtgtctagatttgttcttgcagcactcctcaaacacacaaacttacttagtcaagcatgtggagaaagccggcaagtaacttaaaaactatcctcagacaaatatttgctctcatgatgttagaaactaggtaacttttctattttggttctttatttagataccaacctggtaaaagcttatcagaagtgtatcgttgtgtatacaaagttcgaagtcgtttacttgcttgcaagaaccttgaacttattcaaaccaggtcatcatcacgagacagatgggtaaagttggaaatcaattaatttctatgttttcctgcaagcttgtcagaggtggccccacaatttatgaaaaacatgctacgattggtgtgaatgttcaaaacatgctagcatgttttctagtggaaagtattggaagaataaaagcactggggtttatttacctcatttttatcaaatgcaatagggctgctaggtaatagcctgcatagatgatagttacaaactggcttgttcataccatgggtaatattctccttttttaaaattgattaagttacattggaattaccctgtttaacttacaatgccagaaattatcagggatatttccagatacttcagattgattaaaaaaaaatgcagcaatcatacaagaactgaaaattattaaaaattctcagtgtagtaaaaggtgagaaaaggccaaggttataaacaatgcagcagctctgtagtgtgctctgaaagtgaaggttgaggccactgattgaggatgatccaggagtaaatatgggaacaaataggtgattttgaaaggacttggtgattcagacagcacaaccctgtaattatagaaataagcctgt

SEQ ID NO: 35052 - DNA, 1173 bp, Mus musculus
tttggtgttgctcctgagtaatgatgtgttgtgatacttcagagcctttttgattaagatcttacagagcagcttctgcctttattttcttgtggtagcgtgttgccaaagcactgacatggacaccgataaatcaacaaggctttctctttagttttttacattgcttttaacttttgtttatttttgttctttttttttttaaccaaagtattttgaccagattcacttaatgcatgcatgtgttcaaacatgagtatccatttctcaccacttggtatgatagtagcgctcagccttcatctagtttgagaatgtgttcccttctctacttgattgctgttgatgtgtgattttttttttaacccctattttcatgtaggtcctatgcatagtcaattagaatctctgagtgactcttggactcgcctgaaacataccagagattggttctacaactcctcttactcctttgagtctgattttgaccttaccaagtctttgggagttcacacattgattgaaaatgttgtaagttttgtgagtggagatgtggggaatgctccaggtttcaaggagccggaagaaagtatgtctacaagtccccaggcctccatcattgcaatggagcagcaacagctaagggcagaggtaagttgtggatatttattattcataagcaactctggaaaccaaaagtgaatcactcactgaatgtataattctatgaaaagctttgcccttcttttcccctcccctcccctcccctcccctccactccactccgtgcatgtgcatgtgtggtacagtgtgtgtagatgggtggagtctagaggttagtttgcgtgtcctcctttatagtacgtgtgccacagagttctgaggacatcttgtaggagtcatttctcaccttctaccatgtgggttctagtgatcgaactctgtccttcaatctcggcagcaaatacctctatctagtgaaccttgttgttactagtttttgaggcgacctcaaaaccttctgagcttgggttctgcatagactgtgcctcgcttgcctccagcactgaggtcacagagatgctggcaggcttagctttatgtgggtactgggaatccaaattcaggtctttgtgcttgtgcagtaagtgttctaccttctgggctgtctcc

SEQ ID NO: 35053 - DNA, 1687 bp, Mus musculus
atcagttgaagactgcaaagtaaaatttctaatgagacagtttcctatgaaggaggttataaagatctactacatattcaacaaactagattattacctaaatttcccaagtagcttacatgaaacaacatctgccttacctcctattttgtaagtaaagtacatattctcttgcttagtgtatctgtggttgctttggtactatcctggcagggttgagtgatagcaacagaacccacatgcctccaaagctctaagatattcagatttattatgggatgtttgttcaccctgctttgcagtgcatagtagtaaatattctcatttgaaagctcaggtgcatttcattattgttgtatttagcatcacatgtctagttcctcataataccatttttttcattctgtaatgatgtcagtttgtataaattattctcaacattgtgttcatgatgtgttttgttttgtctacattattttctgtaccttcctcccgtctttccctcacttgctttttcctgtgtcattctgatctttattaaagcttcccaactttttggtcgcctagtgatactccattatataacctggaaccctgtgaaccactgctgtttgatgtggcgcgattccgaggcctgacagcttctgtgctgctggacctaacatatctgacaggcattcatgaagatgtggggaaacagagcatcaagcgacatgaaaagaaacaccgtcatgagtctgaggaaaagggggacattgagcagaaacctgagagtgaatccattttagatgtgcgaacagggttaatgtctgatgatgtcaaaagtcagggtaccacaagctccaaatcagaaaatgaaatagcttcattttctttagaaccaacactgccaggtgtggaatcccaacatcaaataacagaaggaaagagaaaaaatcatgaacacatatccaaaacccatgacatagctcagtcagaaatcagagcagtccagctttcctatctctacctcggtgctatgaagtcacttagtgctcttcttggctgtagtaaatatgctgagctcttgctgatcccaaaagttctcgctgaaaatggccacaactcagactgtgcaagttctccagttgttcacgaggatgtggagatgcgtgctgctctacagttcctgatgcggcacatggtgaagcgagcagtcatgcggtcacccataaagcgagcattggggttagctgatctggaacgggctcaagctatgatttacaaactggtggtccatgggcttttggaagaccagtttgggggcaaaattaagcaaggtatgttatctgatgaaattatactcataactgtcaaaagtaatataattctatagtgatttgttaaaaatatggttctttttggtcaaagaaatttgcacattgtttttcctttgtaagaggaatggttattttttgttacttgtacctgggtaatcattgtctgtaattttctatttaaatctacataaacattagaatttgttaacttttggaaactgaaattaaaataggtctggtagtgcacacttttaattccagcactaaagaggcagaggcagggagatctctgtgggcttaaggtcagcttgatctacatagtgagttccgggactgctaaagttaaatagtgagaacttagaaaaaag

SEQ ID NO: 35054 - DNA, 2326 bp, Mus musculus
ttaattagatattttcttcatttacatttcaaatgctatccccaaagccccctataccatccccctgccctgctccccaacccacccactcctgcttcctggccctggcattcccctgtactggggcatatgatcttcgcaagaccaagggcctctccttccactgatgcctgactaggccatcctctgctacatatataactagagatatatctctggggggtactggttagttcatattgttgttcctcatataggcttgcagacccctttagctccttgggtattttctctagctccttcattaggggccctgtgttccatccaatagatgactgtgagtatccacttatgtatttgccaggcactggcatagcctcacaagagacagctatatcagggtcctgcatgattgtcattctaaggcaagaagttaatggtttcttacagaacacaaacttcagggtgccatctataacacttcctcttgctattcttccagaccgattgataggcttgcctgagggacgtgctcgtaatcataatcgaccccaacaaatccctgtcctggctggagtggtcattgaagatgtggctgttggagctgaacacacacttgctttggcatcaactggagatgtttatgcctggggtagcaattcagaagggcaggtaaatggcatatttgctgctcttgcatactctagaaatctgacggtgttgtttatttgtaagagtgtctttgtattttaaaatattagtgttcagagaatcctttgcttgtgcaagaaatcttgtcatcccctgtagtcacaggagtaagggcaggaatgaaaatgaagagaatgtaaaaagacttcaggtctgtgtccttagtccttctgtctatctgtatatggaagagagacgttggtaggagatgtctgagagactgatgcttctacagtggttttcagcccacaagcagagccatcctcacttcctcccataatctcagatcagagaccctcttattcaaagttgttttagtgagcatttacattctcctcatacctgcattagcagatcaggaagttgtggttgcagtaatcttgatgaaaggagaaccaatggtgaggagcctttggggaattccctggttaggttttgacaaaatcttccttgatgttgaacacttaactgctgctgctaagagcagagaattggagccatgtatattttatatctgtgtacccagaaaccagtgtgtcttaagtaagagttctggagagccttcttttttcacttaacaagaactcctaccctttccaagatacctcttccaagaattcaagagtgtgaccagttgttaagactaatgcttttaggggacagtctaaacttataaggactactactgtgatagagaaatcagaatttattcattcgtttgtttgtttgtttgtttgtttttgtttttccagacagggtttctctgtgtagccctggctgtcctggaactcactctgtagaccaggctggcctggaactcagaaatccacctgcctctgccacccaagtgctgggattaaaggcatgcgccaccacacccggctgaatttattcgttattgaagttgatgcatgactcagatgttaatagatttcattggcctgccttctgcttcttcaatctctgtgcatttgcttttttattcttagcttggcctaggccacaccaaccacgttcgagaaccaaccctggtaacagttctgcaagggaaaaacatccgccagatttcagcgggccgttgccacagtgctgcatggacagccccaccagtcccaccaagagcaccaggtgagacggaccatttgtgctcttccagctgctcttctactttcagtcgtgtcgtgatgctctatctgcttgcagttctcactgcatccaacatgtctaaaatgcatcaaggcttggagtattctttttgctacaagcaccataaatatttcatatcatgcatttcttctgcagacttcagtatatagccaaacttcatgccctctctttctctcagtcctcaaagaaatcagcatgttttttaggcaaacaagaattaattaaattagagcttctactaagtatacatacacttatataggtaagtataaatatacctgtatcgataaaaaggtagcaaatagaactggccatcctgatccaactttaatcccagcacttggaaggcagaggcaaagggatctatgtgaattccagcccagcctcatctacatagaaagttgtaggtcagctagggctggtaggaaaaccctttctcaaaacacac

SEQ ID NO: 35055 - DNA, 1228 bp, Mus musculus
ctattttactctatagtcttttttttttttttttttttttttaactttttgccttttctttacagggttggttctggacattacacagcatatgcagttcacgaaggccgctggttccatttcaatgacagcactgtgacagtgactgatgaggagaccgttgggaaggcaaaggcctacattctgttttatgtggagcgtcaggccagagctggagcagaaaaactgtaatacctcctgaccatgagtcatcaactacaccggacaacatttccattttccataaatacttgatccaagagtcaaatttcagtatgcacttttcaatttccagtttggggtttagtttggtcagtggtagtgacttacccaacatgagcaccaactaatttttgttgttgttctaccagaaaacctcagcaggcattttgattggctgctttagttgtaataattcaatttttatatgtagtttccagaacttagttctgtttgactttttatattaatgttttcagttctcaccgaggcacatttgcatttgctctatactcacatgctgagagccaccctgactgctgtcttcatagcagccaggtcagcgactccatcgtgaggatcgtgtgtgcaggtctgtggcccaccggtttcacagtgactgctcaggaattccttccgactgcagaccaggccgtcaccactgctgtgtctcagggttgctgtgcctcagcattaaataactctgccagtcccgttgcacctgtgctagagttccagaactgctccatttcttgtctctggtcttcttttaatattttcttgggggcagacaggctaggaacactgacaagtgcaaatacgtgtttaaaagccctgcgattcagctgcatggtagaggtatgtcctgtgggtggatctgtctgaccatcagaggtgaggtcttaccccccagacctgacttccaggcagaagtggagtcatagaagctctgggttttaattcactccctgcctgaagcagaaccaggtgaaagtatatgtctctgaacaagaatagtttttattaaattcagtagcttaaaaaatactgttcacagaaataggttagaagcactatttggaccatttaaagaaggcagctagtggcaaatgctggaggccagtgattcggtttgcaggtattgaaacctttaagtcagagtgtacaactccaacacagcctgttccac

SEQ ID NO: 35056 - DNA, 1143 bp, Mus musculus
tagaagtacttaaaaatatgaactgaagagttagatgcctctcctagctttgaaagatgaggctgataatgcagtaaggggtatgtggttcctccggatgtcactgagtgcttcatatctaaatgtcaaaggtcatatgtcactggaaaggccaggacagttttgaggagaaggaaaaaaaaaaaacaacaaaactggggggagaggaatgtttctgacaaataggaagcaacaaataattctctgggctttgggaaagtaagttgaaattttctagactcctaaagttgattctttgtaatcaagggtaagacatttaacagactttcagagaactatgattaggcaaattaaacagataatagagagcagcatgattttgatttgggtatttcttatgtaattctagtagctgtggccaaaaatactgatttttcagtaacttgagactatttgtctacagggaactcttaaatgaatattttttcaatttagtttcaaaaaatggtgtatcagcagatctgagagaaacattctactgtttttacaacaccatcctactttgttttaaaatttttgagattgttattgggatctgtggcatacatggtaagctagctccttgtgtaacagttaaaatagttaaaattgtgcaaagttaaaaaatctaaaactgagagaaatatttatttttatgtaagatagctttatactgttaacctttgactagtgtgtttgggtattaggtgaaacattgctgatgttaatgttattcatcaacaattacacctttatcactgatctttatagggatttaattttatttcttttattaaaatttcaagttactatattgggctttaccatgacatctccttacacaagtggcattatcctttgttcttagccacacatgaacaatttaaatatagaggacatttggaaactacagtattatagctgaagctcttggtctgtactatataaagatgatcagtttccaagccctgaggtggttatgctatgtattatcagtgttgtaaaggcactcttcatgctgtgtgctaaagcgacaggagatgaaggtgggtgctgagcatatgtaggttagtttaccttttcagttaaactgcaagggcttcc

SEQ ID NO: 35057 - DNA, 1145 bp, Mus musculus
aagaactgagacaggaagtatgaaattatcagaaagaaaggacaactataataaactagggcatttttacagtcccatcttttgggttacagacattgaccaagcctcactcaagttttattccttagtggggatgaaagggagacagagaatgagggaagcagagggaacaggaaggcgtacattgtccaggagtcttcctttgtagtcagaactggaaccaagatataatgtggggggaaaagtctatgttatcacttacttggcctcaggaagaggacagttacactttatattccactccattacttgaaaatgaattactccctctgtcttgtagtagatgtgagttctggaataatctaccctgttttgaacccatgggaaacagacaaaagcagactacgggacagctctgcctcctttgcccaaatgtcagttttaccttgtctgatcttcctcctgcccactcattgtcaggactgtctactcctctggctgtggagaggtctaaataatgtttaggtaaaatgtattttcatactatcaaagcagaaagctatctgtgtagaactaagcttggtcctggtatttaagtcctgaaaccaatagcatgtttctaagaatctccctgttcttccccctcagtcccatggtttctgggaatgcttattcccttcttcatgttctttccatagaggtgagaaccctgtggagagcagtcagttccatggctcaaaagaagtctcagccaccagcccctaattgctagctccttgcagttcatagggagttctctgatttagtctcattttgacagcatggaatgtcctcttgaagaacaaggtttatatatttttttccttcttctatccctccctccttctgacttgataaaaatctcttctgctatcagaatgtttcatggtggcagctgtgtgtgcaggatacgtgcatgcacacaaaacctctgacagtcttggagtctgggtggcaccctagccttgggaccaatggcgtcaccacagtaaggacaagcctcaagaagaagcaacacaatttagtttcctgagcttggtccaggattgtcggccaagagctggcataaagcagtccagggcagcaagactgtcctaaagaagtgt

SEQ ID NO: 35058 - DNA, 2163 bp, Mus musculus
tcttcttttttgtttttgtttttttttttaaacaaacaaaaccagaatgctttgcttttgatatctccacccttctcgtgtcttttgtgggttaataactagtctccatgaacttctctttgaaagagcctataaatgttaggtgagtctgaaagtgctctttgaagcagcagcaatcggggagtatatccttgttatatagaaatacattgtccttgctattttcttacatttaactttgctaaattgtatataatttgagctcagaccataggaaagtcactttctgcatggtagaaacaacccaacaaatagtctactttgcttaataatgtacatatgtgcattattttttctacttgtagatgaatttagtgacagagaattgtctgttccctgctgaggctgaagatatctagaagtgtgtgtgtgtgtgtgtgtgtgtgtgtgtgtgtgtgtgtgtgtgtgtgtggtgagagagagagagagagagagagagagagagagagagagagagagagagagagagagagagcgcctttctgtggtcttctggatagggtacatagggatttttgcagcagtattagtggttcagtggctgcactttattattgtgctaatttttgacgattggactcgaaattttcaactagagcctgagggtatcaaacagtgaaatgtactgtaactaagtagcatgtgaatcagttgattgtaaactgttccactgggaacttattctagcctcctgtagttcaggcagatgataacaaagtgatctacctgtgtaccagttgctgccataggcctttttactgttcatgtggacattttatgcagtctttgttataaattttctgaagactatgctctttactttgaaggactatttcttttattatacctcatttagctaactgatattctaataaccagtagaaaacagtgagcccgcctccaggcattcaacacatttaggttgcatgttttgttttgtcttgttttgaactggaggaaaagagaaatactttcgaataaagcatgcatgtcaatacccagtagcatacaaaaatatgactttcctgtccatccattaatgaatttagttgtgcaatataataggttgccctgcagtttatgagtaagaaattgtaactgcatttttcaagctccaaatgctgagatctgtattatggcttataaagtgtcttcctatgagcagtaaaaggacaaattaggcagactttcttttcaagcttgtgacttagattcttttataaatatagttcttaatctttaaagatgagattctaagcctagaattttaaaaccacatttcattatggtggtttactgatctcagattttctacaattcaattttttcagacttaagaacagctaaacaaaaccttcctctagctttttcatcacatccagtggcagagaggagtgtctgcgcatgaaatcccgggattccggaggacatagcaggtcagggtacactgataaaagttatgaatttcctgtccgttagaaagaagctaaacgactgagcatagagatggagagcaacgagcatttgttttaaggattttccggattttactgtgtatcttgaagtgtgtgccatatgccaagaactaacagaactttgtgtctcctctttgtacctttttcattttttaaagtgaacttatggtcgttcattcctgtggccttacggatgggtttgtcttgactgtttgcaactgatgctgcagttcccttaatgcaaaatgccatgaactgtctgaatacagtcaggccccaccatgggaactatggcgtttcttcatagacttctacttgtgtgcttaaacattttcttttgcttcagtggcttactgtgggaagctcctgtggatagtatggacctgccatgtggctagtctgttgaagccagttcattaactgtactgatactgatgttgtgttttttaaaaatgaattttattccaggtgaactttttttttttacaataatgttcatctaaaataaaaactacatgttgaaaaatgattatgactcttaagtggattgtacattttagaatatatatggactttaaaccatattttaattggtctatgttcattttacatgatagcgagtttcata

SEQ ID NO: 35059 - DNA, 1165 bp, Mus musculus
gaaacatatgggagccaggtaaaggatacgttgacttaagtctttaacttaagatgatcattaagatgatgaattttcttttttgcaatgcaaataaaatatatgttgattcttcattctcaaactgctgtctgatgtgtttgctataccatatgtgtctgtttagtacttaacatgtggaaatggaaacagaatttaagagtaaaacactacactgaagctataacttgaaacagatgacatgtctgttacatgctgaaatgttaacggttctggaatactaaatttaatgtttcaccttaaaaaaaacaagtgacttctagaataattattgtttacagaatttacaggaaattctgttaaacttaagttctgttaaaacatcacttaatatataaatgacaagtactttacatgctatcaagaaaaatgaagagctggggctgtgttttcatctgcttttcaagtttttaatgtatggttccccttccttccctttctaggttgctacaagattactacagttttcagccatgcacagactgtggttctttgtgtgggttgttcaactgtgttgtgccagcccacaggaggaaaagccaggctcacagaaggtatggctttttttttttttttttttttttttttttggtttttagagacagggtttctctgtgtagccctggctgtcctggaactcactctgtagaccaggctggcctcgaactcagaaatccgcctgcctctgcctccccagtgctgggattaaaggtgtgcgccaccactgcctggctggtatggcatttttaaacctggtaatgagattttaaatgttttattgtgggctctttaaagagtccccagttcggggttagggagatggctccaaggttaagagcactgactcctctttgaaaggacttgagttcaattccctgtacccacagctcacaactatctctaattctggttcccaggattcagcacatagacatacatgccatacatatgaaataaaaataaatttaaaaacaataaaacttttaaaaatataatgataaaaagaatccccagttcaagtggctaactttatacttatgatactgccattatttttttctaactttagaatacttaaaatcttacagatttattcacctgcatg

SEQ ID NO: 35060 - DNA, 1280 bp, Mus musculus
caccaaacacaccctgcactttacgtcagggtgggttgcaggtgtgggtgcacccggggccttgtgtagatgtgagtgatgtccgaagcatgtgtagtgccactcatctgtgtgtgactggtgtttgcttactaagtgtgcaaaccactaccgggtgtgacgctcagctactcatgactcaattttctaatcccatcacagagaaagtggcccatgccaaagaagaaaaccttagtatgcaccagatgctggatcagactttactggagctaaacaacatgtgaaaccctccttagctgcggccacattctctccccctccccccatgtttaattttgtctttaaacacatgcttaccgtgaaaccccttcaatgcgtttttttttatatatacttttaccactgtcactgaaacatctgccgagagccagctagggcaggagttggggaaagacgcgcagaaaggcaagcccgagtcagggcacttgttatttaaatgtgccatttcccaggttgccacccttcatagagtttaggcatgcagtttgcttagccagtgtaggaagcctcatgagaacagaaccattaacagccagagtgccaatggtgggatcagcaggaagactgatgttggagacaatcgggtgcggattggtgctaatttaaacaaaagggcctctggggtcttttgttcaatattttacaatttagacttctgtccaacactaatttattttgtcttgagttgtactgcgagagaagaatatggggttttgtatgcccgtgttccttaaagccaagggtttgaaagccacgctggtcttctgagattccaagtccttccccagctgacatgcccgtagccccttccgactcagtggggcgagcgctcaacacggatcgccccccccttcccagttctccatatcagggtagaagatctaggcactacatatgtaattggtaaagaaaaggcattttcttaagagttataactatgtaaacattgtataatgatatgaaataaaacgcacatttaggacattttctaaatctggtggtcctgtcgtctgtatggttctgttgtcgttattattgttttactttgtgaacttggtgcgattgacccctccttcctgagagtttgctgacggtgctgtcccatggaagctagattcccccggctggcctctcagaaatgattcacgtggtggcagtcaggaagatggccctttccgaaagtcatcttctgtgctacctgcgtagttccatggaataag

SEQ ID NO: 35061 - DNA, 1118 bp, Mus musculus
actgcccagtggaaatgagctgccccagaggaaatttttctctggggctgcacatctgactgtagatgtgatcttgcaggcatcgcactggctcctgccttctgcggtgcagatctctgcagggtgcaggccttgggttatttgtggtgctctctcggcagctccttcctttcagtctaaaatgcctcctcgtgtctcgtcatcctgctatttttaagattgcggattttatatttctctcattccgagaactagcctgggtgctttgtaattatctagactccacctgggaagagctaaccattctggtctcggtaagaggggccgtggtctctctattggtgtgccgagtgagagctgcctgtctttactctagttaaagaggagcatcgcatttgttaataagaatctctagggccagtgcatatcatttctataaccaccccctacacgaagtgtgccaagcgtgtctgctatgtgtgccctgctgcaggtggcccgtaagctggtcatcatcgagagcgacctggaacgtgcagaggagcgggctgagctctcagaagggtaagcgggcccattgctaccacatgtgagggggtgctgcagagcagctgactaaacagcatgaccttctggcagctgcacatttacccacctcgactccaggctccttgtgctctcaatgtgatgtggatgagccgtgagcgtggaacatggaggaaccacgtggggtgtctgtgaatgcgtgtggcactgcatgccttacttgcactgattttgtgaatggccttgtgcatttcctgtgtccactaacagccaagttcgacagctggaagaacagttaagaataatggatcagaccttgaaagcattaatggctgcagaggataaggtactgatagctcacgtatagtttttaggtttaactgcatcccagacagctttgagcttccaatgcctactggtcggtttggtgtaatgactgtacctccactacaccctctgctacttatatcttgcttcaagtgctttctcttgggcctttatgttctttgtttttccccttcatcgatactccgaggggtggccagtaagaagccaaaccatcacacccagga

SEQ ID NO: 35062 - DNA, 1339 bp, Mus musculus
gagtgtaactctttttgtttgttttgtttttcccagacagggtttctctgtatagccctggctgtcctggaactcactctgtagaccaggctggcctcgaactcagaaatctgcctgcctctgcctcccaagcgctgggattaaaggtgtgcgccacttcacgcctttgctgggtactatgcaaaactattaagccaaaccccaaagttcatgatcaagacggtgatctcacacagtaggacaagaggctctcctgcagctggctcaccctcttcctgtaggatatgcttccaggcagctagcccctcacccctcctcctacctgtcccctgccacattggacattccaggggcaggacagataccaagtgtctgtccctaccccagggtggtttaaaactttcacagaagtggacacaggagaagacctctaacaaatgaaggcaaggggccatgaggggagtttcaggacagtgggacagtgtcctcctgtctggggtgatgtgcactaggaacttgggaagaggtcgttctcaggtctctcctccatggtcgtgggcctacttcgcacctgtcccttgctagcccatgctgtgtccatgtatgtgaatgtcctcgtggctggctgatctctcctcatttcataaaccagcggaaatgctgggctacaggcattacttaatgctgctgcttgtgtccccagaggcactgaggggtcttctggctcctaagggagaaagaatgcagatgtagtgaattgcagtttggagtagtttcaaggcccatggcccaaggcctggaacatggaattcatctgtgagggggactgggaatgcagcagagtgcactcctacctctggtcccgtgagggaggccaacattgggtgttgaatccttacactgatcttcctgtcctgtgtttccctgtttgatggttaaaagtaggatgtgcctgatggctgggaaattgcatttggtttacttctgcctttcagaggtcttttggttttcaggatgcaaaagccatgtttggtcagacagccctgggtagcccttccactggccagtttgggaggtggtcttgaaggtcatcataagctgatacttaggacctaggcagtcctccagttggcgttggtgatttccagaggcagctgccctggcttcagtttgtgcacgggctttcagggctaagccaccacagatctgctggcgcacactcttcgtccagaaaaccctctaagcctcttagcacacacatctgcttgttgtctgagttctcttccggctggtgagagtagggacagctgaaaccaagtgttaaaaaccgtgtaacgag

SEQ ID NO: 35063 - DNA, 1305 bp, Mus musculus
gtcctctgacctccacatgtgtgctaaggcacatacacataccctcaacatacataaatacatgttttgttttttaaaaaagaacgctcatctgcgtccatcaccagaggggctgtggaagacaggccttcacaaaagctttagctccgttccgctcttgtctcctttcagatcattgcagcccaggaggaaatgctgaagaaagaacgagagctggaggaagccaggaagaagctggcccagatccgccagcagcagtacaaattcctccccacagagctgagggaagatgagggctaagacaccccccatgctggtgagccccaggaggtggttcctactcccccaacaagaactggacatactggtgtcccccagagccaggaacttcctggaaactgctggccctccaccggagtctgtctctctcagtcctcagtcccgtcactatcagctgcatgatcatggtctcacacggtacagtgtcccacccacagctcttccagctcccctcacgcctcgctatatctcaggacagagggcgcatttcatggactgttaccaaaaaagaaaagtcagtattacgttgttctcagacacctgtactccgtgtcctctaagactgctccagggcctctttgtgaaatcacactcgggaaagaacaatgctaataacggctcacaggaatcatcagtatcatggacatagagattctctctctggagagaagacagctggagttggacactgttaataaagccagaaacactcccaagtgaactctggagtcacagaggtctgtgtaagtgtggggcactgactcacccacgggggagaagatcccctacccgtttgcacgcttttctcgcctcagtgtgtaagctccttgtacaactacacccatcttgtattctgtggcccagaaaaatggaagttatttttttttcccccttccataatccaaagggcagagttgtggaaagtggtcagggttaggtgggtaggggccggaataaaatactgggctcctcactcagcaaagctgtttcagtttatgcagacacacacatggagactatgtccctgatggatctcagtgcagcgccccctggaggaagagtcaggtagcatttaggaaggaggttcccatgttcgagccctattatcagtttctgtgcacttgagagggtccaagttcaagaaggaaagttatttgtttagaactttgacctttgatctcaagggggcatttcccaccatttatcttaataatcctaaaatctaaatgtcccctctggtcattg

SEQ ID NO: 35064 - DNA, 1125 bp, Mus musculus
aagcctgggctcgatgtgactgctgtcaccgtacagtgcagctcaggagtggggtgttgtgtttggtaaatataccaattttataaaatccgatcgctctaaaatatgctcaattctaatggtgtactctgcactcatgaagagggatgtatcaaagagagctgggcacactgtgggatcagtaaatgcctgtagaatgaataacacaactgtcccacagagttcaatctgaggacaatctatctattcctataaggtagcttgggatccagatgagctagaccctcagaaaagataaacatatcagaaaggtattatgctatcccactaagccacaggctcacttaatgaggctgtgggcatttttacagtcattttacaggaaggtaaatcaactaaattccgtacttcactggacaggggttacaaatagaagtggaattttcctagctgagctcccaaagggcacaagagaaattttccacctagggcaggcttcaatggcagggtccctcctagaccttccctctcctggctttgcctctgtagattggattccagattcgcacacgtgtgcaggaccttggccatggctgtatcttcctggtgcaaaaggcaggagccctccaggtgtgccccacagacagctacaccaagagggagctgatcgagtgtgcccgctctgtcactgagaaggtaagggggttccctctgggcaagatggatataaccattgtgccagctctggtggggacaaaaccaaaatttcttcagctaaaacagctgtctccctcaccaccttggcccttctcagcgaggatggtattccagagtctattgtgatccacaggacttgagaagtccaggaaaaagcaggcagcctgggaaaaaacagggggcccccttgcaggtggccctacaacatcaggagccaaccaggggaaggcagatgccacagcccaccctgtaacagtcagtctcctctcctaaagagtttctaagtgctgctgtgagctgggaccaaaacactaaaagagcgagatagaacaatgcagactgaaatccctacccagcatagggaaggctgaagccaggctgggctatatagtgagaccctgactccaa

SEQ ID NO: 35065 - DNA, 1235 bp, Mus musculus
taatgtagatgtgaggggaattacaaactgggatctgaagagttcagagcagggagagaaagtcgtacactgagcatggccaacagatttgacccagccatgagaggaagtgggggtggggaggaagagaggaagatgagagtgagggcaaaggatgcagagagggaaggaagaaagagagaggggaagagaaagagagacctgtagagcacatgactgaagtggcagggttatatggtatggggagggcggggttgtgagctggagaagttcagggtaaggggagggataaaaagagctaagaagagccacaggtacttgttattctgagagcctataagccagcatggctttgtatgtaataggcatcgcagatagcatttgtttcttttggacctgccatcttttagttgagtgactcagaagcacagccctgggcagtcactgttccttccacagtccccctcgccgccccttacacgaggtaaaacttcccatggcattgccttttgtcctcctagctacctccaagcacaaagcccttccaggaggcccagagtgagctgaaccaggctgctgctgatctgaaccaatctgctggggaagtcgtccatgccacaaggggccagagtggagagctggcagccgcttctggaaaattcagtgatgactttgacgagttcctggatgccggcattgagatggctggccaggcacaggtgggtgggaaggtggtttgtgctgctcacttgagtctccctgttctggtagaccacccagctgggggcatctgggtggatggggaacaggatcctgtaaaacaacctgcagcgccttccttgactgccttggaaattctgtgacctcacaggcttggtatgcccggtgatgatggtgactttttcccacgatccaccaccaaagcctatatcctttaccggagttgggggatggggggttgggagcgaggagaatttttatcagaactgaggtcagttaatgcatgaacacgtacacacacatgcatgtgtatttgtggtttagtgaactcaacttgaatgaattacatctgggacctccgaatgattaaaaatgacctcattcagatggagagatgagctacttgtttatagctagggaacatgactggtctggcatcagattgcaggactggttttttggtagtttggtgaggtttttttgtttgtttgttttttggttttttttttgttgtt

SEQ ID NO: 35066 - DNA, 1197 bp, Mus musculus
aggactggcattcccctccaccacacaccccaaactgctccccaaactcccctgataggatttggagcatccagaggcatccttagccatcctcctactggtcctcgagtccacaggtaactgacaggctttccctagtctttgaggaaacacaggcagcatttctaatgactccggaaaacatgtgcaattcttttagatagtcagttgtcttacctcagcctagaagattcacttatggtatcctaagaggaaaagaatataattagtagctctcggaactttgtctttattgaagtaccgggcaatgagaactgccatgcatgacgaattagcaggatttctcaaatcacaaagaaagtttaagagtgtagaggttatcccattggatgagttgggtccctggtatgtgtgctaagtgaggcacagagggacctgagggagatgtcagacaccctggggtaccaggagcatccactgcagtaagcctatccgtgtctttctaggtggtgagccccaccatcagctctcccgtgtgccaggagcagctgatcgaagctgggaagctggtggaccgctctgtggaaaactgtgtccgagcctgccaggcggccaccagtgatagcgagctcctgaagcaggtcagcgcggcggccagtgtggtcagccaggccctgcacgacctcctgcagcatgtgcggcagttcgccagccgaggcgagcccattggccgctatgaccaggccaccgacaccatcatgtgtgtcactgagagcatcttcagttccatgggcgatgctggtgaggcactggcttgggagaggagggattggatggtttgggtgttccccatgatcacggtcactttctaggtgatctctggagtaaggagcaagaacaatagtgcatcttccttaatctaaaacttcctcaccgtggcacagagaagatccggaagtcccaacattctcttccagggacacaattaaaaacgtcatcagaatttcattatttgaattcacaattttaatgagccccttttgtcccatatacagggcatagttggtaaagtcagagcagtcaccaaaggaagcaggaccaaagcttggcatgaagacatttatttaaaggtccactaggaatctcctccaaggtcactgtagagaaccaggagggacagcagacagtagatgggac

SEQ ID NO: 35067 - DNA, 1144 bp, Mus musculus
tgggagagccaactatggcccaatgaagtcaacatcagttcacttacactcctgttatggagtgggctggctggatactggtctctggaaaagattcattttgttctatgggtctagaggtgttctcctctgttagactagtttcttggagaacttaaagttattttatttccaaactgggataaactattttaaacccacatcatccctagctgaaactgctggctcaaaagactcttcttccagaccgtatcctcagtgatctttatttcttttgaggagttgggaagtattctctgtgggtgagcggttgtgtaggggttgcagatgccagccctggtttcaggagagttatgtagttagtatgtgtatcttgaagctatgaatcttggagtagttccctggacatgagcatgtatgggagtaatgtagtgtgccacatagtaagccatagtttaaaatttcagtgttcagtgtctccatggtgtacatgtgtgttatgtacatgatagtacaactgctcacagctctgaagatcagtgtgcctgataatgtttatataactatgaacttggaccaagtagcagttggcctcaacattttgtatcatgacttttttggataggggttaaatatatggattctgggatcaggaatggggagggggagaggagggagggaggtccttataagcaattctcaggggttgcttatgatctacattttaagaaggttgaattagaatcaggaaaagttggtgtggctataatcctttataacattctccccaacgtgatctgcttggactcagctttagtaggaaaacttctaatccaggtgtttagactctaagggcagctatatagataacggaagatctgtgtgagagacagatcaacagatgtgcaaatgacaagctgttgatctgagtatagtggtattcatcatttgcccctcaccagttactgtaggtgtatccctatggctatgtaataataataatagtaatagtaataataatagtaataatcatcattatcatcgttattattttaaagatgccaggaggatatgtgaatcacaatcacactagtgtttaatgtctctatgcatgttcatagagattagtgactgcatcatagtc

SEQ ID NO: 35068 - DNA, 1172 bp, Mus musculus
tgttttccatggagctatggggagcccttgacagtcaggcatagatgaggcttcctggagctgtgttgatgctatttcccaaacaagctacagccttcagcattcaggttctgtttttagatagccttatggacagaggtattgaacccagatacaagcgctaaagaggggagccgggtctccccataactaggtaagctgtcaccttgaggataaatagtggttttagaaagaagaccacagcttatcatgtctcccacctcacagtctgctctgaggctgggacccaggagacagcctgacccaggagccagacacccttccttttaacttttcattctatcatcttcatcaaataatttctaaggctgttgcagccctttagacccctgtgtttgtgtgctcacttggcagggatggattctataaaatgtgaccatttgatagagcctgcggagacccagaggacaagtgcttggactaggggaccatggccagcctagcttactaggacagagcctaaagttgccgtcatgcctctggcatttggattcctgtttaatcctcttgattggacagacttgctcactgttgcttcaggtgtactcatgggcacactgcgcttccagcttttagaagaggtattgcctcatgcctttgcccctacatggtctttgcacctaaggccctggcctgatataaaggatcctttattctatcagtcctggttcttgccccagccattcatctgaagcttgagtgacacaggcgagccatctagagccccctctttctctctaggtttacccattcgcagtttctttctttctgtttttaaatctcattatgcatttattttaaagatttatttttttatttgtgtgcgagtatattgcacgtgtgtgtgtgtggggggggggggtgggcggcacacacctgtagagcccaggttagggttgggtgtcttcttccaccccttatgttttctttgctaggctgaagctagacagtctcagtaatcctcctgtctccagccacccacacggagctggggttacaggcttgttccagataataagcctggcttttcacgtgagttctgtgaaccaagccctggcctcatgattgtatagcaagcactcttgtttgttgggatgaccacccaccccgtc

SEQ ID NO: 35069 - DNA, 1099 bp, Mus musculus
actggcaactcccacaacagaagcagaaggtgggcaggagaggtgtggctcaaaggttaagagcactggctgctcttgctgaggctctgctcctagcacccatgtggcagctcataactatctgtaattctgtttctggtagatatgactccattcttctggccattgcaggtaccagatatgcacacatacacatgctggcaaaaaaaaaaaaaaaaaaaaaaaaaaaacaaacaaacaaatcaaatcaaaccaaagccaaaactcatatacatatatgaaaaataaatcaagtacagagccttactttattatttattatttatttatttagaagactcccattcctgtcctccatcctctgtacccagttttgattcctgaacatcctcaacctccatgacccttgcccttgctctcattttgctgagtacccagcccttgattagacccgccctctgctttgctttcactgttctacccccccccccaccccccacagtaatgagcctgggtggcgaagccactgggccatctgcactgctgtgctcttgatgtatgactgaatcccagcgggcctcctgacgccgcagacccactgtgctttagtgtgaggttgctgtcagccggtgacttggtttccctgattcctgcactgaagcagttgactgactactgaggagtccacgtcctccctggagttcatgctctctgcacttctgcagctgtcccttcccctccacatcatcagagtccctcgctgatggattatcttcacaggagatgctctgacatcttcatcttaggcaaaaaaggcatcccttgactttgtgtcttagccattcatctcccatttctttgctttcccttcttagcagacactaggagaaaaactacttttattttatgttctgtgtatgagtgttttatctacatgtatgtctgagcactatttgtgtgccttgtgccttcagaggccagaaggggaactggagttatataggtggttgtgatctaccaagtgggtactggaaactgaacctgggtcctctgtaagagcaaaatgtgcttgctcttaagccatctctccagcccttca

SEQ ID NO: 35070 - DNA, 1206 bp, Mus musculus
agaaagttttctccattgcctctgctgcagtttttgcctctactctgactttccccagtgatagagcctgacctgagaatcataagctaaaataaaggttttcctccccaagtcctttaggtcatagagttttatcacagcaatataaatcctaaaaatgtcaaatgataaaatattttaatacagattttttttgtttgtttgttttttgtttgtttttgttttttcgagacagggtttctctgtatagccctggctgtcctgaagctcactttgtagaccaggctggcctcgaactcagaaatctgcctgcctctgcctcccgagtgttaatacagattttaagcacactgcttaaacgaagagctcaaaaaaagctgcacatacccaagataatgggtgtgaactcagggaaaaaagagttagtttaaaggccattcacaagagagatcttaaacactgggcagggtatgtgttgggcaggtagacttagaaaggtccttagaagtaagagaagtgggcctgcggggatggctcagcagtttagagcacttgctgttcttcctgaggacctgggttcgattctcagcacccacatgatgccttacaatccagatccagggaagttgtcgtctcctgcagacccttttgtgcaccaagaatgcaatgagcatggtgcacagacatacacattgcacatgggaaaacacatatacacagaaaatcaatccctctgagagaaaatgtttgattggtttagggaaagaaggaagcatagccacgtgtgggacttgtccttacaactccttctctcagtgtttgggaaactataaagctattattttcaaagttttgctaggaaatccaaatgaattctcaggggagttttactggacagaaactggtgaccccagtggttgaataagggaaaaactagaagaagctgaggaggagggcagccctgcaggatgaccagcattctcaattagcctggacccctgagatctctcagacactgagccatcaaccatgactactagcccagggatggcaccacccacaatgggcggggccctgcccccttggtcactaatggagaaaatgccttacaaatggatctcatggaggcatttcctcaactgaggctcctaattctgtgataactccaccttgcgtcaagttgacacacaaaaccaggcagttcag

SEQ ID NO: 35071 - DNA, 1117 bp, Mus musculus
ttgtagaagaggcattgtgctgtcatagcttatatttggcagctgtttgttggtgttatgaatatacacatgcatatatagttttaaaaagttatttaaaaagtctgagccaggcggtggtggcacacacctttaatcccagcactcgggaggcagaggcaggaggatttctgagttcgaggccagcctggtctacgaagtgagtttcaggacagccagggctaaacagagaaaccctgtctcgaaaagaaacaaaaacaacaacaacaacaaaaaacaaacaaacaaaaaagtctggatggtatgtagccttttagaaaacgctagtctgcaaacatttttccatgtccctctttgttttgttctgtaatgcaggtatgttccggcctctgcctcctgctggaccttgagttctcacagatttcttccatctgtgttcttagcattgcatccttagtgtttgatagatgtaacatgttataataatggccgtattaatgttacatttcttgtctcccccccctttttttaaacaggtaatgtggctttggataatctgcagataaaagaaaatgctctggtaagggttattattttttaaattatgcttaataactcagctaatttggcaagctcttagaaacgtttggttactagacatctgtaccaggtaccagataaagtgactgagtcactccaagttgggttctttatttaactatttgtcattggaaatcatgagattaaagatctacagttttccatttaatgatcaattttttttttcaaaatgggattcagtccatgacctaatttgactatatagctttgttgtctctgtttctcttatagacatatttttcttcaaaattatctttatgcattttccaggcaaattagcatttggtggtaatcaatgacctaggctaccactggagcagtgcggtgacgttgttagccatagagtcctgagggaatagtaaggtgtaaggggggacttacccatcagctttagtgaggagtttgtatcatttgcctttgagctaaaagccaagcagccaagcagtgctcaccctccacccagtgaggatacattttaacctggtatgcaaaactg

SEQ ID NO: 35072 - DNA, 1196 bp, Mus musculus
ccaaaatttgcagacttttggttttatgacttggcactagctatgtattctctttgtgctttggttttctcctttatataatgtaacctgtatcttgtgtttattgtaggggaatatgtgataaatcatttaaaacactttgttgtgggcctggcccttaggaatgactatgcaagtgatttttttcatctttctctttgtcattggttttagcatatggaagagagcaaaataaagaaatcccttccaaagggacagaaggaattaaacatgaacagcagggatatagagggctttggctaggccgtgatgatcactgggactgtaggtttaacaaggagggcagagaaagcttcactcagaaggattgggcccaaggaggttgagagagacaccagaaagatgtgcaagggcagagctgactcaggaggaaggaatggaccagttgaaggcttttggcctggggagggtggcagccactgtgatttacaggaagtggcagggtggagtggaagtggggctgctgggagtctggcaggtcaccaggctggtgtgggatcttagaagcagctgtggattttggcttgaattggcaagtcgttaatattgaatttgagaaacaggatgttatcattggggatgctttagaacttcttctactttccccttcttcttggtcctacctcagttagcaagcctgggaactgaaaccccacctacctctcttctgcccagctttaggctgtcaccatctttatttaaccaatagttgtacattaaggagcaaggtatgcatggcagtcaagcctttgggggagggggaggtggtatttagcattataatacctagcaaaagaccttacctcaacaggggaggagcttggtttcagtggaggggatggaacgtgccagagtctaggtgtttgaaggcagaacccatattacctgatacagattagagataagagagttaaaaaccttgggttattttggtatcgaccattcagaggctgactctcctgaggatctatcccatatacaatcactaaacccagacactgttgtggatgccaacaagtgcttcctgacaggagcctgatatagctctctcctgagaggctctgccagtgcctgacaaatacagaaatggatgctcactgcgacccattggactgagtgagcatagggtccccaat

SEQ ID NO: 35073 - DNA, 1193 bp, Mus musculus
tgtgcaataattgaactaagagaacacttttggtaagccagtcagttgactgaagaaatgtatctaaaggagaggcagtgcattttctatgttcattttatgaaaatgttatttttcttctaataggatgagttttacacgagtgctttttcttctcctttctatctagtctcagaccatgggcggtctggcagctttggtgggcagccctgcaccgctgtctgtagcgaggcacccaccggctgtcagagcatgagcacaacgacggattcttgagaaatagaaactgagaaattgcactatgagctcctcagcattcaggaatatataaaatacaatatttttttatatttccagagatctattttagaatataaaagactacaaagggcgccataaatgaacatttaattctaatgcatacctgtaaatgtcttttaaatacctgttaggaagaatgaaaaatccctacttactttattgtataggttttcttcaaggtctgtacagagttgggaaacgggtgttccctgtatgcatcaagctgctgtccttcctcgtctccctgaggcttgttaggtcggggctgcctgttggcaggttaggtagaggggcacgggctgcctgttactctgagggattttatttctttgggtggacctttatttagcctttttcagggtgttgaacatggcattgagttaaagcgcacagtcagcgatgagatgaggaaggtatggatgctcatcttgctttgcctttgttgatgcaggtcctccttccaccctcaatgccagtcacgctttcaagattgcacaggaagacttcttagcttcccactgctgcttcatgtttctctaagggagagtgcagaaatcagtatctgatttttagtagttgttagatttttaattcaattccttcatttcttatcctcaccatgccccccatctccaatctccagttccttcctccctccctcccttccttccttccttccttccttccttccttccttccttccttccttcctctctctttctctctctctttctctctctctatctttttctcttcccctccctccctccctcccctcctgtccttccttccttccttccttccttccttccttccttccttccttccttccttccttcctctctctttctctctttctctctctctctctc

SEQ ID NO: 35074 - DNA, 1131 bp, Mus musculus
tctctctctctctctctctttctccctccctccctccctccctctctccctccctctctccctccctcccttccttccttccttccttctttccttccttccttcttccctccctccttccctccctctctgtctcttcctttctttctttccttccttccttctctctttccttcctttcttccttccctctttccatccttttgataggatctcacaatgtagaacaggctggccttaaactcacagagatctgcctacctctgcctcccaagtgctgggataaaaggcatgcgccactgtgcctagcttaatactgttattcctgttaagaaaatcattacatataaaactgatagctttaaacctaattgaactttctagagctagaaggcagtatgataagcctaggaagtacactagcaatctatgtctttaaaactgacttaatcaggaatttgaatatctgactacatttttcatgttaatcccagctgtcaatggtattataaatatttaaggcattatattgcactgatggtttattccagaaacaaatgtacagaacattagactaagaatagtcaagtctataaactcattgtctcagttgatacctgtggcatttttatttgatacagtgttctggtacaggagtaacccactggttgtatgtaattaggtgtgtggtcttttttacaaatgcattcaggggcagtgacttgcttataactttttgagagaaataaaacattgttacattgtttatatgtgtgagatctctgtgtttgtgctaaataccgaagtctcattctcttctttatttcaacattcccctttgcccatctgctttcatgatagtcagaagacaggtgagacactgcagagagttttacatggtgctggtgagggaaagcctgttctaaggctctgagcctccctcccacactggagctgtgtggtccagctgcagcactctggaagcacaatagcattgcgctgagtcctgcctgtcatgagttctcagtcactgggaagagtgacagggatgcgaaggcaggcgtcctggggagcagaattcactgtggcagtcttgggcatgcattctcttcaatggttttgaagatccgg

SEQ ID NO: 35075 - DNA, 1182 bp, Mus musculus
gtccccttgtattctgcctaattgggctgcattttaattttgtggcaaatggaggttctgttttacatttctgttagactgacaagcccaagactggatctgaattagggagtttgcagtaggaccgattgaagctgtgagcctcttagaattggctcagcatcttagagtcttctcccatgcatcttttagggtcaggcaggagacttcagtagaaggccctgagaggacaagagactgaaatctagaagcaccgaggtaagctgagaataactaaaccatgggttatgcagagtgaggaatattccagaaacttgtaccttcgattcaggcacatctgtttgtgtcactggtgccttgggtgttgaggtaacacaaaatagtaaatgttaaagtcacccaggacaatactgggacacctgggttcccatcacagcttagctctttgttgtaagtggccccagtcggtatcctctccccaagaggctccacctctttctacagtacagagatatgcagaggtctgacttcctgatcgccttgatgttctgagatcctgtgacagacatcccgctgactgacttacagcaccattgagcatcgatgcttcctttcgataattgttggggcacaatttgaaatgacccccctcttgagagtgaagtcatgttttggtaagttttcagggtttcacctctacctcagtatacttggatgttcatatcctgccactacctcagcctacttagacattcatatcatgccaagatggtaccttggcacgtcccttattacctctccacgccccagcctggcctgtgacaaccgttactcttcatttactgtttctagaaatttcactggaattgaattatatacaatgtagtctttggatctggctgatttcactggccatagtatttttaggactcatcggtgccatagaatgtattagtataggttggatatcctattttttttaaaagtcccaaatctaggtttttcaaatttttaaaatattcacgtagactttactggctattcatccttcatccacaagtttcagattttcacattggagatgctgaacttttccctttctctgagtgaccgatagtccatggaatgaatgcaccacattttctaatccctccataactgctgggctcctttttctttgtg

SEQ ID NO: 35076 - DNA, 1211 bp, Mus musculus
tgggagagaatctcgggagactccatccctctctgagaggtttaggtaggtggtggatgctgggaagggacagtcagctcctctctgtacatatgggcaacactaactggactcagtaggttagaaggaggagaaggaggaggaagaggaggaggaggaggaggaggaggaggaggaggaggaggaaaagaagaagaagaagaagaagaggaggaggaggaggaggaggaggaggaggaggaggagaggaggaggagaagaaggaggaggagaagaagaacaacaacaaacaatagcaagacaaagaagatgaaagagagaaagagtatgcagcttagaatggagtgtgagcaaggaattagtttggagataagttgaaaggaaggaatggtatggatatattcatataaacaagaaaaagttttaagagtggataaataaaataaaggtcctgagtcccaccgactgtgaagccctaactcagtggtggtagtggaggtgctgtgtggaaaaaatcttcataaatgtaggaagaaattaaatgaagagtgtgtttaagatgttgctttttcagcacaggctgcgggaagaaaactcactgacccaagcttgattgaccctaggttgtgacgcgctatcgccacctggtggtcacatggccaaattgtaggtctaaacttcagatcctaagagtttaggcagaaaacttcaccagagtcaaaaaatcctagtcaagttgtctgcatcccctgagagttttaaaagtctataaatatctgcataagaactgaatatttcatatttatctgaatgtcttagtgatgtaggcattgctgctttgaggaactcaaaatcattcaaatatagcagatagaaaaaaaaaattatctccaggaatacacagatctctgagtccagctggaagttgagaagactcaacagctttgagccttgtaatgaagggataaaaagactttttaaaagcatccctggcaggttgatgtctaacagacttaactgctaagaagcaagtgagcaatgattcttccaaaagttctcttttcagctgattccgcagcctgactcattggcgttgcaagggctgcttctggaacagagctgtggctgatcctgtgacttacttttgtcactgtgtccaatcggacagaatcaacaactatggcttttttttttttttttttttttttttt

SEQ ID NO: 35077 - DNA, 1101 bp, Mus musculus
agttcaattcccagcaactacatggtggttcacaaccatctgtaatgggatccgatgccttcttctggtgtgtctgaagacagttacggtgtactcacatacataaaatgaatctttttaaaaaatagagagagtgaagagtgtattgttttatttatgtatgtgagtgcatctctgggtgagtgagtaccacatgggtacaggagtctgtagaagccagaagagacccggatctcttggagctagagttacagggagtcgtgatctacctaactgggtgctgggaacctaccatgggtcctcaggaagagcatcaagtgtccttgccagctgagccgtccatttgtggtattcctctacaatgccatctagccatctgtctatctcattctcccattctccagtatagacccctgggtgacaccgggcatcacctacagttaaagatggtgtctgcagctgccaaagcctctgaccgtgctttgagaagcgtgctctccacacaaaggtgcccctttgcccagcgatcccctcacagtgttccctccatttaagacagacactgcctccacagtctgttctagtgttttccttgcttccctgtgctgaattacagccccagtcaacggcccacttgtgtgtaattcaagaagcaattatgggctttttgctttgaacaagcaagggaggggggtagaatgaaagatgatcattaccctactattcctctgctttagccaaacagttcacagagccttgatgccaaaagtcacgggccttgaaacagtggagggttgggggtgggggggaggggcactgccttccacaaccacgcctgcctactagaaggcagggactcatccaccatcaggttgagggacacaagctgactttagaattgtgtttaaatacgattgtaatgtctgcaccatgatccacagcctggtgatgctatcgctgcaaattaaaatgtgcaaacttcagagtcctccgaaggaagctcacagtctcggctgtaagccttttgttttattctgtgggatttactctaatcggaaaatggcagccttatctctctgagcgaggccacatgaatggtgt

SEQ ID NO: 35078 - DNA, 1172 bp, Mus musculus
ggacttaacatcatctaccttctatgtaagtagctctattaagtaggatttgaagtagctcagtcactatgagctactttccctactgaaagtcatggctggaagtcatggctgtgccacaattcacctcgcccagaaaatccctcacaggaatgctctggggcgtctcttgagtgattcttcatctagtcaaactgataattaatattaacctccatgggtaccccatgcacctctcacacttacatataatttccactttaacagtgttgggaggtgggtcctttaacttgtcatgactagattaatattgtcattgcagttatggatttctgacaaaaggagagctcaggtctttctccacttgtcctcttaacctttgctctcagatctggtgcagtaagatttctaccatgggaaagatctagaacgtccattctagacatctgcttccatagcagtgagccaccttagctaaggtttaccaatgaccccttcagtggggttctgtaacagtgcacaaaccaatgatgttgcagttcctttgaagagagtctctcctggacatgatgatggtgcttgcctgtaatcttagcactcaggaagcagcggcaggaggcctctttgtgatcgccctgtattctacaagctaaaggcctgagccaaaagcagtgtggtcatggaagtcttcagaacaccagaggaaatgaggtgtttttggacctccctcaggacctgcactgctcgctcggtcctgatgctttgcatagatcccaccaatgctgcctgagtcagataacgacctttagtgacctctaatgaagctcttgcaaataagcctgtctgttcagactggatttacacaaacactgtttttcatttttgtttttgtttctgttttttttttttctttgacatcagattgttttcttaattgacttcagtgttatcatgtgaccctactgagctcatgtcagttgaaggtgacaaggcactgctttttctttcatgggctttagctattttaattgttactgtgcatgctggtggatggtggtaatatctgtgtgatgtgcatgtggaggccagagcagggcactgctcagtctctactgctctccccttactgccttgaggcaggatctcaccttgaagcggaggcctgcagtttc

SEQ ID NO: 35079 - DNA, 1142 bp, Mus musculus
gcctgtcaatcacgcagtcatgaccatagtgacagttagtggcgttgtgatctccaggcctctagatcgtggccttgatttcttatggactagaagtatcctcttcacaggactctttggagaaccgaatcaaagtaacccaaatggtctccagacacacacagagagtgatggattctctgctttgaggagggagggctgtctccttgtcctcaagaactctggggaggcaagctggaaaatcctgtagtagtttccaggttacccataccctgaagggcacagttgtggagaaagggatccggaggtggcaggagccattgaattataatgcccgccatttttgagcttcttagtccttgtggtaacaacatgctgtaatggaacatctgttgagctgagattaggattaggttcctctctggtccaatcaacattagaaactacccaacactgtttagcaggcattgggtctcaaagaatgaagagctagatagatcatgagtgtatcttggacagtggtcgttgggtagaccatcctcagagtaagagggaatagtatcataggcacagaggtaagaatgaccagtgcagtagagctatgagccactatcagtgatggtttggaatgagtcaggacatcatgtcgcattgggcttagtcttgagttctgtcctaagcatccgatttccccaggtgaccacagcttgcttcccagatgatcctatttgtgagatctctctctctctctctctctctctctctctctctctctctctctctctctctctctctctgtgtgtgtctgtatgtgtctgtgtctgtgtgtgtgtatgtgtgtgtgtgtatgtctgtgtgtgtgtctctgtgtgtgtgtgtgtgtgtgtgtgtgtgtgtgtgtgtagatatgaatgtgcccccagctttcttcctctactctactccatcttaattgttgagactcatccctgagttttcagattcagccagactggtttcccccctccccgccctgaaacgccccagaaacctcctgtctcagttctttcagcactggggctccaagaatgtaccttcacacccctttttttcccatatgtgggctagagaattaacttgattctcatgtctgcacagcgtgc

SEQ ID NO: 35080 - DNA, 1174 bp, Mus musculus
ttttagtctatcattataccttggagaaataaacactttttttcaatacttatagatcttttacattttcttctcatattaatgtaacccatattgctctctttctggctactcttgcctcagcctttccagtgccaagattatacatgtatgccaccacacttggttgtttccttgttgaatctgacttcaagcatctaccttgtctgtggcttccatgtagggagccatagatgtaagatcaaactctcccatgaacatgttatgatgatgtttctggcccagtgcagggcactgtagcagcaagttatgcaaatcatttgtctggtctttgagttcatgtgtccgtcagtccatttagaattcacacatgaatattagcatggcacagcatgggagaagaaatgggactcaggggaggtatagcagagtccagggcaggaataccaaggactctgagaatacacttcctgaaggaaatgggatttgtgtgcaacactgaaggaatgatcacatagaggaagaagaagatgagtaaaacctctgtaaaggggctcttagggatggagactcaagacagatggccttggctgctgtcccagctttgctaattcccaacaatctctgtgatcttgggcaaatcactaccctcttgtcctccagtttccccagtagtaaactgggaaagaacaatagtatctgtctgatagattgctccaaagctgcgtcaaacatgtgctgcaagacacacagctaaaaaagcaacgtcattactgtggtggagagcacaaagaagtcaaagagtagaaccttctagaatgaagaggctgcactgaaagctagaaggcatacagggattccagccattgggcagtcatatgaaactgccagataagactgccgttggtgaagcaggaaagatgggattgttttctaagggtgagatgtgtaaatatagccattctattgctatgttaaaacaccatggccaaagcaacctataaaagaaagcattgaattgggctttcattttcagagggttagagtcaacaatggcagagcaaaggcacggtggcaggaagaactgagggctcttatctagatccacaagtgggaagcagagaggggagatcacactgtgaatggagtgagtcttttagaatagcaaaccctg

SEQ ID NO: 35081 - DNA, 1194 bp, Mus musculus
ccagcctctagttttccagctgggttttaacttaacacctttttagtcgctagcttccaagggaatgtatttatatgcttttttaatctgacttttggatttaaaaaaaaaatggaacccatgggactgtgttggacacatacttataaatccatgaaggcttagcctacagaagccacaggaaatactatgatattttggaaaaggtcaagtttcatagattctgtgaggcgctcagcaggttgtaattatttcttttatttaaaagccctccagatattatattttttccagagggtctgcaattgagggtaattcacatttttttcatactgtacattctttttggctgagtgctggaaatacacaggaaatcaagtggcttcggaggacccagcagaagccaggccgtgaagtcactggagcagaatgggaagtctccaggtctgcaggtcttgaccacctctgcctggctttatttttacaaggaagggaaaaaatgaagcaggtgaacgaacacactgatcggttgtgttctaacagaaaccaaatgtcaccatgtcctcaggcggggctcggcagctggaactgctcaagaggtttagacgcaggacgacaagacagatgtgccgaggcagccaggaaagtgggaaagagttgcctgtgtctccattcaagttcctggtgctgcactggccacagcttttgctggcctggcacagggtgagagcagagctgtccatgccaaggccaaagaaagcatcaggctcccttgtttcccagactctgagctgtctcttaggaaaaatctgtgatgactctttgaagactcttgcctcagagggagagaggaaggaagggatggaggaagggaggaagggagagggagaaggagagggagagagggagagggagagggagagggagagagagagagggagagggaaagggagaggggagggggagggagaaggagagagggagagggaagggggagggagagggagagagagagggagagagaaagggagagggaaagagagaaaacagaataagacttttagtttcagcaacacaaatgaaaaagaaaggaccctatcatgtacccagaagcaaacatctgcccagcctggcctccttttcataggccagcacaggtcctgggagggaccatgtctgcaggattagaactca

SEQ ID NO: 35082 - DNA, 1190 bp, Mus musculus
ggcttttgcttgggtgctggagatagagactcagttcctatgcttgcatagaaatccttttactcaccaagacatttttctacttttaaaaacatgaactatgatgttagggataagggcattaagtaactatgacctgacttttccctaataatgtatcaatatattttcttccaagatgcccactgaagctggtgagtgccgaaaaattgaaactctggaaaatttggatatggacttcgatggtgatgtcacagaacttgaaacctttggagtaactactactagtccacctaggtcaccaagttcagaaagtgactcctctgcacccctcatgacagatgtccacgcagtccccaaaatagcagctgtgcctctggcaccagctacgcctgtggcacccactatgcctgtggcaccagctacacctgtcacacccactatgcccatggcaccagctacacctgaggcatcagctacacctaacattactgatgattctagaagtttatgtcagattctgatgaaacaattacagaaggagaaacagctattctctggtgtggaaggtggtcctgaagggtgcaaaaataaagatgatcaaggacttgaaccatgtggtgaagaggtccccagtgccaatgcaaaatctctaacacaagataatgaagtccacagaactgagggaatttctaaggaaagtgatgtaggtgtgctgtgtaccaatgatgaaagacagggtggtcaggggaatgcaaacaatcccaacaacacagctactgcatcagaagcagctgaaagtgagaaagggattccttgtggcagtgatacagatgaggactgcttaatcattgatacagagagtagaagttgtgatgggaagacagctgatttaggttctaggccaaattcttcagcacaggcttctgcagggaatcaggccactaccactgtttctgaggaatcttgtgttttaaagaaacctatcaaaagagtctacaaaaaatttgatccagttggagaaattctaaaaatgcaggatgagcttttaaaaccagtttccaggaaagtacctgagttgcccttgactaattcagaagaatctaaacagccgcctgcttctgagcaaccctctgctgctttggatgccgctccctggccaaaatccagttggccctctgcatttcaga

SEQ ID NO: 35083 - DNA, 1233 bp, Mus musculus
ttagctaagcttataggtgtgcattaccaggcttggctgcaatcccctttctaaaagatcctgacatttctatatctatcttggtctatggtcaccaaggacaattgtgtgtgtgtgtgtgtgtgtgtgtgtgtgtgtgtgtgtgttttggggggtcagtgcagccatgcttcttagggcacacgattaaagccagggacagctaagctgttagaaattatttctccacgtcactagttattttcatgcatccttaaagtccacaaaacttcaaagggaggcagccaaggttctaccctgtcctgtgcagaagggcgcaggtgcaggagaaactcgggcctgctgcagaaggccctgcaggacctgcagtgtgggagacattctccgccctccctcgcagtcctgacagggtgacgtaccatttcccactgcgcttcagagggccagggctttggtccactgtgcaggcctgcaagtccccagggcacaccaaggctatggcgggttgctgtacaatctattttttttttcttctgacactacttttctttctttctggccactgcagcaagacaccaagggtgactaccagaaggcactgctgtacctgtgtggtggggatgactgaagggctcagcacagtggatcacccagaagtggctctacctgtgccccaacctggcgttctagagacttcgctctccactaatggacccctgagctcctccctgtgaggatgatgacagggctgccgaccctttccccatcttagctgcccttgcctggctttctcctcattctctcctttatgccaaagaagtgaacattccagggagtggggcgtagcgtctgtgacatgagacacttcctcttatgtactgtgtcgtgaataaaccgtttttactttagaaacaagaatgccgttgcctttgctttcaagccactgttcagaaagcagacatacttgggatttgattgttcgcccagggaggttgcccctagaggatgaaagttctagaacttatctcttccctctggtagccactatacagatgcacttttttaaaaggatgagtgaatttaaaattatatacagttcaaattttaccccttaggcaagggctacagctcttatctgtgtgtgtacttctccttggggacagcaaatgttttattcacccagatgaacgctgacaacacaccagagaaatgattccaccgcagtctaacttg

SEQ ID NO: 35084 - DNA, 1674 bp, Mus musculus
ctgtgttttttcattgaacagagttgatcaagagcttaatggaaaacaagaaccaccaaaaagtgagcagtaagttccgtgtccagcccggacaagagagagcaccggggaggcggggctgtagtgcatcctattgcactcatggctcatgtgtttatgtaatcggttgcaaattttacttgacttctttccaaatggactcttgtacaagggactgttcactgctgtcatggtttgcaactcttgaatttagctctttaatgactaattatattgtaatcattttatattgctaaatagtaaagagctacactttataaaaagcaatttttacatttgtttatttgaatgatgcatcttcagtaaagtatttatatacataaatgacaaaggaaagaaataatatatattttttatgttgggggcaataatttttagtgtgtacctatctcgtggatgaatatatacacgtaaataagaccacgattttaaatgtaaagtgcatgtaagactttgtttttgtaaatggttggatacatttcctgggtaacaggctgggttgtcctaaagcagggacaggtaaatgacgccaagaagtacctaaggtcatgcatgtggtcgagacagtagtagcagcctgagcttctcctccctgaaagcacattgtttcttaatgtggtggaagggcaggtgagtgaacaacttgctttcctctctaaagatgtgttagaaccagaactagagattttgaaaagctagtagttagggtttatatatttgtatataagggacattttactttacccaaagtcaggactgtttaaaaaagaaagaaagaaagctcttaagatgtgttcagtaatgtgacatgagttgtgccatgtgtgtgaagctgtgaggggttgcagaggctccgatgagtattcatgatcagctgcgtctgtagagcagatggaatgccattgcagtgctctcccagtggggcactttaccagaggacttcctcgtttcctcgtcggctgttggagcacagtggggtttggcctacgcagacgttgctgttgggtggtgtacagtgctgtactgggtcgattctgtaaggattgaagtgctgctgccgtgcactcaggacaacatttgctgtctgtaagccttcatttcatgtggttacgtaccttgactgaacattgaaataaatattatttgtgcctccaagcagggtcttaattaccttcaaaatcattctaaaacaatgaatttgtccagtcttgtgtcatggacttctctggtgtatacatatttagtgcatatcagcttcatgacacccagcccttcatatgagcggtttacaaaagtgatctagcaaaacaacattgaagcaggtgtgagctaagcttaggtcattttctcccacacgtagcacatgaccttcaccactgtcagtgtttagggttaagtttctattgcaaaagagaatttttctttacttctttgtccttctcaggcatatatttgacctgctaggttaaaaccagttatgatcaagctggaagactttctgggtaaaacatttctccacaacctctcagcctagatccagcactagtgttattgtagtacgctgagccaaaaccattttacttgtgtaggtgaaggaaaccaagaataactata

SEQ ID NO: 35085 - DNA, 1708 bp, Mus musculus
caccctttacttaaaatcgtaaatacaatttttacaacgttatttccctaagtgcagttgagcccgattccctcagattttgaaaggcttttatgaatgaaaagaatttattttcaatgcttgatgctctagccaagactactattttggaaaaaaaaaaaaaacccaccatggtgatttttcttttgattaaaaagtgaatgagttgctacaggtatgtattgcccctcaccctacattaagagaagtcctggtagagttcagctttaagtccacatctggattgtatttttgttgtctatatggttttttttttttaaatgttgggttttttttttttttttttttttgtaaatcacctgtcttttgtagagaagaagtttaacactgggagagaaaaaaaaaagccctgcaatttatataatgaaaatagttttttaaaattgataattgccatacagattataaattaagtagaaacttacaacgtttatctagatcccacaaggcacgatatttatatccacctaggggtaccggcttttactatttaaagctatttttgaaaccactcacaacctgtgtagtgatagccatatatttaataatgggatggtggctaagcaacctgtttatcgaacagctaattgttcatcagttgtaatgaatgttagaatttttcagactttacgatttacctaaatgttccctaaacaggcactacgtgctagggtttatagacatttgttgtaactgtctatcttgtgccttggttttttttcttacgtcgctgtactgtcctctgtaaaaaaaaaaaagaaattacccacaaaatagacagtgtggtaaacacatcagggttgtggtgtaagactgagatcctatgtaattttaagcatcctaatgatttcatcgctgtcatggtgggccgcactcagcatccttcatggaatagctgcacacacctttgtatggacagagaggcaaagcgagactacatttgtaatactgcgaggagacgggtgtcccggcacctttgcaggcgttttattttcagttgccatgtttgagtcattgaagacttgagcctgtgccatttgcacttctgtgttaaagtgagggcacagagagagagagggagagagagagagagagagagagagagagagagagagagaacaggagcatttaaaagttccaagaacaacaccccatcctttcctttcctctctcatgtgcaaggactcaggaaaatcaaaagcattttctatttctagaataaaccacactgagattctacctggctcttactgttgacccatgtaagatatgctgctaaagtacctaatattctactcttgggaccttgaaaactttgatttgagtttggatgcatgagaggttatgtgaggaacatgtacccatcctgcatttcttcatctccccacacatcgtttcgtctccatgcaggaggatctgcccacctaggagaagtcagcgatgcttcgtgaccagacagtgtggtttcttctttccctgtgtgctcggctagccatgttttatcgagtgattaagcacaaatctcactcaggacagggccacacctcctcagtgtctctctcccctggggactctaagggggaagggtgagcacacaggacacttgggaggaggagacaggggacacctgctgaccctggcctagcag

SEQ ID NO: 35086 - DNA, 1149 bp, Mus musculus
acaacctctagtacctccagtttcagggggtcaggtgccctcttctgatctcctcagacatcagacatgcaagtgcacattcaggcaaaatacttctacacatgagctaaaaataaacacatctttaaacaaaaaggatgctttgccttgtctcttatttctacttttttttgagttacagtttttctttgtgtgtgtatatgtgtgttcacatgtatgaatgcatgtacccgtggtgtatgtatagtggtcagagagcacttgcaggagtcagttttgctcctccaccatgtgagacctggggcttgaactcaagtcatcaaccttagtggcaagcacctttacctgctgagccatcctgccagccctgcctcatctattcttaatgatcaccaaggaaactgcttgcaggaatagcagagttatattaaacttactgcagtatttgatggcagttactgtcagtactgtttgtgtttgttctaaatttacctggctgattattaaatcactttgttttgtttgactctcagtggaaaactagacaaaaagttttcctgtaaactctttcccgtctctgaagacagttagtacctgtgtgaccagatcagccctggctactccagagaaaacgtttctaggccgaagtgactatacatctcatgttgtagtattcaggcggcttaggagtttgaatggctttcacactcctttatttgctctgacatggaattcagatgaggccaagatggtctagccttagaatttgcacatttatttctaattttgaattaactgcagggcccacgtaatttagttcagaaagcttaagtgtgacacattaggcacagcctgggcttccatctccacacaaggtcagtgtctttcacatgcagctttcagcaatgtgaataaaaggtagatggacagactgggaaccctttgtttcctcttgggggttgtgtttaatcatgctcctctagtcagatttatatttgtgcttatttgtttggaggcaagctctcgtggggcctacgctggccctgaagttcttggagcctaggattgatctttctgcctctatcttctgcatactgagactgcaggtgtgtaccaccacaacctgtttatgtagcaccaaatgagcct

SEQ ID NO: 35087 - DNA, 1185 bp, Mus musculus
caggcagccttgaagctcagattttaagcatcttacagttgctaagctgtgatccccattttaggactagaaatctgtccctcactcccgctgggactacactgcaggctgtagggctcagtgttcctctctactggcatttgcttttcgggatgtttccagaaaagcaaatgcatccagagctgtgactgggagacactgaatggcaagaatgtggctcttatataacacagacacagaagaacccagacaacagtctcagcttccttcaaaccaagttcccttgcttacttctggaaatttttaaaaagatttatttgtgttcatttttattcacatgtgtatgcatggcagtgtggacataggtgcacctgagtgcaggtccttagaaaatccagaagtccctggagccataagcagttgtgagcttcctcacgtgggttctgggcaccaaagtcagaccctctgcaagacaataagcactcaactacctgtccttctctctggcccctttctgtaacattgtcgtggtgattagacattatctgtagagcttgtattggtctgttttactttttcccccctcaatggctacgtaagccactacttggatgtggatgaggagtttcctcagttttacaagctgatgaagtgcagatctagaaatagctttgttctggtgaaaaggggctggtcactgcctagaaaggtcctctattcagccctgccccgtctaggtccatccttctcatcctgaaatacacaggtatgtgctgaggagttggacagtctgaaagtgtttctgactatcatggacactcggcactccatagctctgttagtcttcatgattccaaagcacagctcactgtgagacccatcagcatgagctgtctgcatgacctggctctccagagtctgatgtgggcatttgttgtgccagctctccggagagcccaagactaactgctccagtctggctgcagccgccgtggtttctgccctgcaccctggtcgctccttagagactgcttgaggcaggaagtctggacttccatgctacacaaaagtagggcagccctcttcccacagcagctcaaactcagctctggcagaaactggaaggttctattctgaggctgttcgcagcaagctacatccgctcatttgctctggctacctgct

SEQ ID NO: 35088 - DNA, 2206 bp, Mus musculus
ggaagtcatgcagcacatggccaagaacgttgtgaaagtcaatgacaaccgtaccaagttcatcgtaagtgctcccgtaccaagtcccgatcccgggaaagcattagattctgggctggctgtgtgtgcacgtgttgttctagcaagcatggctgtcatagcagagtctctaaggaatgggatgtactcattggttcaccttgactacctaaggtcagtgtgtggtcagccagcccgtggattcccacatctgcatcagcatcttgcgtaggtcacactcactagtttgtatgtcacatactccatcaacattctgattgggcaccagcaagccaggaaggctgttacccatgggtctgggaagagagccccctctagtggcctcaaattcagcagctcttaaactcagcctttttgaaaggttcatagtgaacaaacatggagaagggagaaagaactgtgggggaaatgggaagtgttattatgcctgtgggacataacaatcagaatacgcccaagtgacagagggcagagcacttgtgacctccctgcatgatctgcctgctgactcgtaggtatggtgtgactgtgaaccgtggaggcacagaagctgggatttggaaagcactagtggctgcacacttttaatgccatttaaaaaaaaaacatgatataggtgttttgcctatcacatatcacatacatgccaggtgcctgtagaggccagaagagtgtctgattccataggactgaagttataggtggttgtaggacactggatgcgggtgctgagaatccaacccaagtcctctggaagagccaccagtgctctccatctccccagcccctcatttctagtctgtggctgcccttcccagtagcacatatcaatgacagagagccttcatccctctgagatcctgttcttcagaccttgagactatatttccagccgggcaatggtggcgcacgcctttaatcccagcacttaggaggcagaggcaggcggatttctgagtttaataccagcctggtctacagagttccaagacggccagggctatacagagaaaccctgtctcaacgcccccctccaaccctcaaaaaaagaaactatatgaaactatttcccctactggcgatgtgaccagcggggttggaggagacagcttggtggcttggtgcagggtgctgtgagggagagacccaggattgtgtgtcatcagactatctggagatggcagtcacagcccttacactgtggggtagactaggtatactggaagcatacttaaccccagctggcttctgcaggctgtcaagaacaagtatgccagcagcagactcctgaagatcagcacgatccctcagctgaactccaaaatcatcaaagacctggcctcccctctgctgggcagcccctagacactggactgccatcctgcgcttctcagatcctgtatgtattttattctagtttacatcacaaacctcttctcaaactcattttctaattgtgtattgatgaaaaataaagctattgattttcttatactatcctgtgtatgtttgtatactctacactgaagaaatgtagaatggcctacaataactctgctctgtattgaaggaaaataaagctattgatctacttaaggtatcctgtgtatatttgtatagtctacactgaagaaacagtgatttacccatgctttggcttttgaatgtgtatcaatggccaaacagcttcccatccagatgaaccttggctagtggtccatgtgttcctttataggtcataggtgagtgtcagcattcaagaacaagccaacagaagaaataagctgtttttaccaaagcctaacccaagatagtccctggctagatttggagtggacacctgtatccacagtcagctgcttgagtgcctgtaaatggagggagacatccccccccaaaaaaaaaccccaaaaacttagaactttttctttaggctctgctaacaagaggactctaaatataggtgggtcacttcttccatgtaaatgcctcaggatactggggccatgcctcctgacaggtttttgagtaggtgaggttctaattctgcttgagaaggcagctgagtttagaggaatctggggtatgagactctggtcagggctctctactctcattctctttgtgcgcatccagcctgacaaca

SEQ ID NO: 35089 - DNA, 1207 bp, Mus musculus
ttaaacttggagatccacttgcgtctgccttctcaattctgggaatccaatgtgtgaactactatgcctggcttttttttctttttttttttttttttaaaaaaaaagagggactgtattttgctaggttgcccagactgaccttgaaactagagctagcttcaaaccacctcagtctgccttacctaggccttcttagtaaccatggctgagtatgtctcccaacatccatctatatgcagagttctttttttttttcaaagatttatttattattatatctaagtacactgtagctgtcttcagatgcaccagaagagggcgtcagatctcattatggatggttgtgagccaccatatggttgctgggatttgaactcaggaccttcagaagaccagtcggtgctcttaaccactgagccatctctccagcccccatatgcagagttctttgtgtaaggttgtattttaaagggagcctgtctctcttaatagaatgtacagttggagttatggcttgtcttttaagctgagtgtattaattgaatggaggttgatgtgatagtttgtatatgcttggccgggttagtgtccctgttgggaggtgtggccttgttggagtaggtgtgtccctgtgggcatggctttaaggcctggaagtcagtcttctaccagcagccttcagatggatatagaactctcagcccctgtaccatttctgtcaggatgcttccatgttcctgtcttgaggatactggactggatctctgaatctgtaagccagccccaattgaatattgtcttttataagacttgccgtggtcatgttgtgtgttcacagtagtaaaaccctaagacagaagttggtaccagggactagggtattgctgtgatggacctgaccatgcgtttgtttggaagaatgtggattttgggactttggatttagaaagcagtggaatgcttttaagtggggtttaatgggctattgtagtaggaatatggaaggctttgttgctgcgtgtcatttgaactgtgcagatctggcccaagaggtttcagtggagaaaaacataagtacatgacctagagactgtttttgtggtattttggtgaagaatgtggctgccctttacccttgtttgaagagtctacctgaagctaatgtaaagagactcagattaattgcattgacgaaggaagtctc

SEQ ID NO: 35090 - DNA, 1499 bp, Mus musculus
gcagtcttgagatctaattctcttctctagtttaatgaaggaagctttaaaggaagtgtttgattttgaccaaatatgctatattgtgaaagttagcaggaatactgcaaggctcatttggttattagaagttgtcaagacttgtgtactagttagctgtgtctgtgagagtggatagaagcagagatactagaagagttgtgagacagtcaagtggctaactctgcttagtcacactatgtcctcgagtggaagaatggatgctttatggatgctacagactctagatggctgtgcagcacagatgtacctagttctttaaatgcctgccttgtttctcctaggccttccctgaagtttcccatgtctcaatggactcctgaatttaacgagctctacaccctaaaagtggctatgaagagtgggactcctgatgcgcccactacacaggagagtctgaaggcggtccttctgcacccacagcccctaggggccaccaagagcttccctgcagaagtggagatgattaatagcaaagtggggaatgaattctctcatctgtgtgatgattctcaaaaacaagagaaggacatgactggcaaccagcaagaacaagaaaaaagtggtgttgtgagaaaaaagcgcaaaagccagcaggctggcccctcatatgtgcagaactgtgtcaaagaaaatcaggaaatcctagggcgcagacaacagctagagacaccgagtgatgaggataatgactcttccttaagtgagtgtctgtcttctccctcatctagtctccattttgggggctctgatacagtgacttcagatgaggataaagaagtctcggtgagacatacccagcctgttctgagtgctaaaagtagaagtcacagtgcaaggtctcacaagtggcctcgaactgaggcagatcctgtgccaagtttgttaatgaaaagaccttgttttcatggcagtgcactaaggagagtcacatgcagaaagaggctggtgaagagcagctcctcgcagaggacacagaagcagaaggagaggatgctagtgcagaggaagaagcgggaggcgctagctcagaggaagtatgctcttctctccagctccagtagctccagtgagaatgacctcagcagcgattcctcgtccagctcctccaccgatggagaagaggacctgtgtgcatctgccagtgagaaccccagcaaccccgctgctccctcaggtgagaaggctggagtgcagtcgcacagtgaaactgtgctcacacccagttctcaagccaagttctcttagcttttattctttttgtgaagctcttagcatttttaattagtgaaaacattaactgcaaaccttgattaaatccaactcataagacatttagacataaggcaccaagaacaatgtctggaccatgcaggagggacaaaacacacttctctatgtacaatggcccaatattatcccatgtgtataactgctat

SEQ ID NO: 35091 - DNA, 1113 bp, Mus musculus
gagccatctctcctgctcatctttgtatttataataaatacatagagcattgaagcacattttaggtatatttagacagtgttttattacagtaacctaaacaacaaaactgtatgtcttcgagttctagagttcaagatcaagcagttggccatttctactgagatttccctttggcttccaattagccaccttgctgtatctttttttttttttttttttaaattaggtattttcttcatttacatttctttttacatttacatttcaaatgctatcctgaaagtcccctataccccctgcccactgtatctttatatcgtcttttatttgtgtatttgtagccatcccccatttttctgaatttatttatttattatatgtaggtacactgtagctgttttcagacacaccagaagagggcatcagatctcattacagatggttgtgagccaccatgtggttgctgggatttgaactcagaaccttcagaagaacagtcagtgctcctaactgctgagccatctctccagcccccatttacatttcaaatgctatcctgaaagtcccctataccctccccctgcccactgtatctttatatagtcttgtgtatttgtagccatcccccatttttctgaatttcctcttaaaaggacattagttagattatactaggagccatccatatgatgctgaaattttttatgactgtgagtcaggtgaaatggcccaagcctatgatccaaaatgaggatgctgaggcagaggcaggaggattgcaaggtcaaggctggcctgggctacatagttccagaccatcttttttttgttttgttttgttttgtttttgttgttttgtttttttgagacagggtttctctgtatagccctggctgtcctggaactcactttgtagaccaggctggcctcaaattcagaaatccgcctgcctctgcctcccaagtgctgggattaaaggcatgcgccaccaccgcccggcagttccagaccatctttacctacgaaagatgtttcaaaatttcaaaaacaacaatcaatttctttctctctctctctctctctctctctctctctctctctctctctcca

SEQ ID NO: 35092 - DNA, 1182 bp, Mus musculus
tcgaaaaacaaaaaaaacaaaacaaaacaaaaaagttatggtaataaagggctttggtatcatgcattagttacaacttagttatatgtgtccctgcttttaccccaactccatggacttgggtctttaatagagggaaatagactgacagaacaacaacaacaaaataatagtaattaagatttgttacatttgtttaggtgtagtatggttgttgtacattggatctgaatttattgttaacttttcttgaagttatagccttctcaattagtaaaatgagtataaaattcataaatgttcatttctagcctctggttttgggtgtgtgtgtgccacatttaatagcttctatttttagttctttcaatattcactgttagatttatcaggacagctctctagaaagaaatgctctatggagagtataaattgatgcgtgtatgcaaataaagcacatacatatgcattaaccttcaatgaagccatatttgttcatggtagtggataattctgtccattggagaagttactcagagtgttttgtttgttttgtgttttccgaagatgggagtgtactataacctggttctcattgaatatctcaggctggccactcaggtcaccaaagtgctggtgattacaagtgtgagcttgtgtccagttttaccaaccttttacacctttcagaaaattctaaatatgaatacaccccccaaaccccaacccctgattttgagaccaggctctcaggcatctcaggttaaattcactgtaaagccagaaagttccttgaatttctccccctcccctcccctcccttcccccccccccttctttctttctttccctgagactaggtttctctgtgtagccctagaattcactttgtagcttaggctcaaactcagatctgcctgcctgtgcatctcaagtgctggcatcaaaggtgtgtgtcaatttaagtatattgaatttctaatcctcttctagatgtgggatagtatgggctacagcattgtttataaaaatgatactttggttttggtttttcgagacagggtttctctttatagccctggctgtcctggaactcactttgtagaccaggctggcctcgaactcagaaattctcctgcctctgcctccggagtgctgggattagaaatccacctgcctctg

SEQ ID NO: 35093 - DNA, 2087 bp, Mus musculus
actctcaactctccagccccacatttcccctccactgtcaatcacaggctctagcctttattgaccagttaaaatggggagaaagttcacatgtacctgagtacatggtgggctgcttgtcagagccatcccctcttgaggaagcagaattaacatcagaatgtaaacagcattaggacaatccacaacatttccctctttttttttttcccaattaaaaaggctccttctcttaaggtaacaaacaatatatagtaggagctattttgaaacaattataaaaactattaagtaatgtcagtctattatacttggcaatcaagataaaatcttaccctaactaaaagagtttacagctccatacctcaggcatgtttgaattttaactcgtattaccatctgaaaaaccatcctttcaaatctagaacatctttaatgttaactaacttaagttcagttatgagactataactagtcttcaaccccatcagagatctgagaaggaattaggtataaccttaagtataatatgtaggaagcacaaagataaagtttacaaagctaatgtaaattgtagagacagctgactgcctggagagtccccaatattccttaaaatgttggagcatctgttttcagtcttctagcccagaaccatctgacagaccttaagtgaagcgggaactaagaaggactagcttaccctgacttggtagagcttagcagtcatctatcccagatccagtttgcccttttttgaacagaatcttgtctatagatggaattaaggcaattcttgcccaatggctagcttgccgtaattggagtaactccttatggaggtaatgatgcttactatcttctttgaagtgggtgggggcaccttcaggagcagacatgtttcttagtcaaaagatcttttaataattaaataatattaaatgccatattctatggatctctgatgttttttttaaagattatatagtataactgaattgtcaaacattgcttattcttagctattcactatttgagtaatcttgaaaacacttgtaattaactaagttagaatctaatataaccatgagtttcactgtttagctattaacttgcagtacttagtcaccctagacagtttgtactagcagatgttaaaaggactgagtctaagccttgtattcttaaatgagttgcataggcagaaggcctatctaactaacaatattttaaattttgtatcaatatacaaagatttataccaataaaaaccttaaaccagtatcagtatataaattctgtaccagtgtaagaaattataacttcaaatttccatcaaatataaagatttctaccaatgtaagattatagctatagaatgatttgtttaagagtaaatttagccggtagtggtggcgcacgctggtaggatttgctgaaggaggcagaggcaggaggatcacgagttcgaggccagcctgggctacacatttagaggggctggtgagatggctcagtgggtaagagcacccgactgctcttccaaaggtccggagttcaaatcccagcaaccacatggtggctcacaaccatctgtaatgagatctgactccctcttctggagtgtctgaagacagctacagtgtacttacatataataaataaataataataataataataataaaaacattaaaaaaagagtaaatttaatatcctatccctatttacatatttgtctaatttctataatgctactatattctcccttttctttttcacccctttatctaaaaaagaaggatagagaagaggagaggaaaggtagaaatccctgtgtctaagcgctctagtttcctccctgtcaaaaggtagaacatttacaaattatcccttaaaatggcaacatatctataattcataaaataaccagagccatccaccttgacctcaggaactgggacgatgatcttttgattgcttcttgttgaattggggctgagaattcctttctgggagcccaaagggaaaaaagaaaattggttttgtcaaaggaaggctagttggtatcatttgccatccagtct

SEQ ID NO: 35094 - DNA, 1173 bp, Mus musculus
tagagctaatcccaccctgtgtctcccttcctatttaaattgatagtgagaaattttaaaacaattatcattatattatgcatacttttcaagcatagactgatgttacaattgggaatttattattaatttgaagtaaacttcatgtttgtatatgcatatgacttccaggctctttgatattaaatgagactggcacatggagaatgtagttagtccacttcttagaagctatgcatgcatctggacagtttttagactgtagcatggtaattcttaaatacctaaacttaaagtacttctctaggattcaacttgctatttcagtgtgaaagttgagattcggtcctggctcattggttttggtactgactacctgtaaaagacagtttatgtgacaggtaaaacacttgcactttcactccaggactatcgtgaagtacaatcaaatctgccatatatagagttgtaaatttccgaaagtgtttggtagataagacacaccactttgtctctagttgtaccaaattttcttaccattaaaaggactgtgaattggagaatcaagagacacatgaccaagatggaaatgaagagctaaaggacttggaagaatttggtgaaaatgaagaggaaattgtgcattcccaggagttgctttctacagaagagaacaagacaactcaggaatttgtagaggcagaagcaatagaagatagagaaaaagaggacatcgaaagtcaggtctttagccagttttgttaaaacatgacacagataaattatgatttactaatagaaaatattttttttctagtttgatatggaggtctcagaacttagaaaatttatttataaattacttagaatcctatcacctaaggcttttacattttttgcttattttacatgtatatttacatagtttttgccatgtcataaattgctgttgattctctattttgcttttatataacatgccataatgacttcataatcaggctactttctgtgtgtctaatagcctctttacaaccttggatatttaaggtttgggtttttgtttttttgttttttttttcatggcgctagagatgagtgtgccaatttcactctgaccttaccagtactactgggtggtagggccctccacccccttttgctgctttagta

SEQ ID NO: 35095 - DNA, 1119 bp, Mus musculus
agttaaagagctaaaacttcagcaaaacaaagtagtttaacagcatttctaattagcagaaactatagcaattacttttttttcaaatttacttttttaaaatagcaaataatttgtacatcttcagtctatcatgttgcacctttaatagaatagcttggaagtggtatagtgtttattaaatttatttaaattattgtttattaagttcttggggaactagagagctagctggtggttaagagtatacagtgctctttcaaatgaccagagtttgcctttcaagataaactagtaagccatacataaatgggttcagaatttgagaatagcttattttccccttgcttccttgagcaaccactctacccaaagcagcattctttacaagtgctgcacttcagagtgtaatcaagagcccagaggtagtgatttatttgtttaaaattttaattgtgtgttggtacgtgggtgtcacagcacacctgtggaagttagaagataacttgtgacgaaccaagtttattaaattcttgggaaactagagagctagcttgtagttaagaatacggtctgcttttccaaaggaccagagtttggttcctagtattcatggtggtggggagctcataactgcctgtggctccagctctgagggattctggaccttaaagacaactgaagtacagacagacagacagacagacacacaaatattaaaacataaatgaaaaaaggaatcatggtatgcagtatcagtatacaggtcgtatttacattgctgttggtttataatacaagcatgtggtctggagctcagatcccaagcgttcatgtaaaatcccaaagtgatgcactcctggaactctggagtgctgaggtggggaggacaggatggcacaggcagatccctgcagctctctggcaagccagtttagctaactggtgagctccccgtggaagatcctgcctcaccacaaaagggaaaggaagcgattgaggaaagacacctgccattgacctaggcctctgtggatacatggaccaacactctcttgtgcatatgcacacacgcaaacacacaacattattgttgttctccatgataagaaatctaat

SEQ ID NO: 35096 - DNA, 1166 bp, Mus musculus
tcactggtgggagagtgctgtggtcttcttaccttcaactggaaagaggctttgggaggtaggagctgaagagtcaggagttcagacctgccaaggctacacagccatttgagcctctcccccataaaaaacaatagaatgtgtgaatggggaatgctaattttggatgtgccatggctgtaacagtaaaccatgcaggctggtagtgactccaccgataaaatctctcctgaaaaacaaaccagcctttgtattagacagctcaatttaaaagaagatcattgcagtaatgagggcttttctggcagccttgccataatttcccttaaaagaaggtttcatcactataggttatgcagatcaagttgagaatctgagcaagtcaacacttctgaggacctgtatttgtttttcttcaatagacgggaacggtttgttggtcaaagtgaaggaaagaaaccgagaccagcagcccgaagagaagagccaagttttgaaaggtaccctaaaaacttcagtgattccagaagaaatgagcctccaccaccaagaaatgaacttagagaaacagacagacgagaggtccgaggggagagagacgagagaagaacagtaatccttcatgaccgacctgaggtcgctcaccccagacaccctcgagagactgtgcccaatccttctagaccaacttcctggaaaagcgaagcgaatatgtccacagagaaacgggagtcacggtagttcttagtaatttcttcatggtatactgtgcatttactgtgcatttgagtttttaagaatataaagtgaggttttgattcttgtgctatgttaacagagttgaaaggccagaaagatctgggagagaagtctctggacacactgtgaggggagcgccccccgggaatcggagtagtgcctcaggctatggaacccgagagggagagcgaggagtcattgctgacagaggaagcggaacacaggtaaaagctgccgaaagctacctgttgatgcttacgtttttctctcattttaaaaatcaaatttttattttacgggtgttttgcctgcctttatatatctgtgtgccatttttatgcctttgggattcaggtctcctggaactagagttacagacagatgtgagtgggcggggattgagccag

SEQ ID NO: 35097 - DNA, 1266 bp, Mus musculus
ggtggtggcatatacctttaatcctagaatttgggaggcagaggcaggcagatctgtttgagttcaaggccagcctggtctacagggtgagtttcaggataaccagggctgcacagagaaaccctgtctcaaaaaacaaagcaggatacacttccagttcttagtttcttccctggtaaggaggggttgataacgaacggtatgcactgtacaggactagggtcttggctgtggtgagtaaggcagagagcagcctgtgcccctaagcgtcaggggctatgaaagcagcttgtgattgttggtttgttctgacctttgtttcccttttaaccccttcagcactgcgtccccagtgaacaggattgtacagatgagtggtaactccttgccaagaggaagcagctcggggtttaagccgtttaagagtggacctccacggcgattttaacgcaagcttcctgctgtggcttcaagataatttattgagatctcctgtaaacgttccctgactgcttactaggagaacctctgactgcttgagagttctagctgactgttgtttttctttataaaaaaatttaacacgatttcttttctcaactttagagaagatgtttaaatagttctgttgaaacttttcatagttttgtgtaccattcaaccttttcttgcagcactgagacccatttgaaaggattggcacaaggctgttctgtttggcactgtgtgaacatgagtggtttgcagctgaatggtagtggtttcatttgcagcgtagctctgtggtgtcaccagtgttggctgcctccattttgaaggctatttgagcttcaaaagcctgctgtctaatttttagagaataagattgttccctgcatttcggagtattatgtaacctatttttgcagaaggtactgttacattaagtgcatctgtgtatcctggttaaaaaaaaaatgtaatctttttggaaataaaccttcatattctgtatagttgctaatgtattgagaacctttttaattgtaaactgaaggtaaaatttccatatagggagcaacagacttgttcaggtttgcatggtataagaccatggagttgaaggagatcttgtccatgtgtcatgaagttctcagtttactgagttgagcaggtaagtgcacttgtgggggatcttcatgttttgatagatggatcccaattctcagaatcttgtgataacattcccatctttccaaaataatgcggagacgtggacgaagccca

SEQ ID NO: 35098 - DNA, 1100 bp, Mus musculus
tgttggaaactaaatcaggttctctgcaagagcagtgcatgttcttaagatgtggcatctttccagtcccacttgttttttaaatgccccaccactgtatttaatcaacaatagtttaatcagtgtaatagttaatagtttaatagtgtaatagtttaattcagtgtattcaagagtacttctaagtccagctctgctgtgcattccttttgccactacttaaggataaaggacaaacctttgcctgtagagtcacttgcctactctcacaccccccatcctcatcccccagggtctcacaatgtagaactgagagatcagcctgcctctccctcgaaagtggtgtgattaaaggtgtgcaccaataggcccagcttcttcccttttcttccctttaaaacaaaggacaatttctcattcaaaagtcacttttaaaataactaaaataacacaatctaaataacttagattggcatgctgtggggaggaagctgcccctcttagtcaaactgttaacggattactgttatggtcactgattctgtagtgctggtgagtggctccgccctggagagcctggtaggtaagagtctttactattctgctgccccttaagccacacatttgtctcagcagcttaagcatcactcagaacaccactttccatttctaatgtaaacaggaacagggaggcaaaagcaagcctcacagcttattttctccctccttatactgcacagaccccttttaaaatcccaggttggtgggccatagtggcgcacacctctaatcccagcagaggcaggtagatctctgtgagttccaggacagtcagagctacgaagtgagctcctgtctcaaaaaatcaaatcaaatcaatcaaccaatcaatgcagcaggcactcaatcaatcacaggttgatctttacctggaaatataccatctcttgactcttcacatttgtttttctacagtctgccaatgttttaagataatcaagtctctcacattaaaatgtaaaaatggtgaggggcagtggggtggcttcataggtaaagactacctgcattcgattcctggagccgatatggtagaaaga

SEQ ID NO: 35099 - DNA, 2439 bp, Mus musculus
tcagaggccccgagagagttatcaaatgggacacatgcgacgctaatgcagcttttgccttggttcttcctagtgcctacagtgggaaaacttcactccaaagagaaacctgttaagtcatcatctgcaaatgatacccttacagttaatagttgaagaaaaatggcaagagatcatgtcctcagatcaggtggaattactcaaaatttaaagcctgaaaattccaattttgggggtgggggtgggatggaaaaggaacccaattttcttatgaacagatatttttaacctaatggcacaaagtcttagaatattattatgtgccccatgttccctgttcttcgttgctgcattttcttcacttgcagacagacttggctctcgataaacttttatcacaaattgaaatatatttttttcaactgccaatcaaggctgggaggctcgaccacctcaacattggatacatcacttgccaatgtacataccttgttatatgcagacatgtatttcttacgtacactgtacttctctgtgcaattgtaaacagaaattgcaatatggatgtttctttgtattataaatttttccgctcttaatgaaaaattactgtttaattgacatactcaggataacagagaatggtggtgtgcagtggtccaggattctgtaatgctttatgcaggcagttttgaaatgagaatcattttcccttttcttatggtggagttggttcttacatacatttttttccttgttacatggctgctgtgagcaggagaggctgtgctgaagaacgcagctgatggcttgcaaactggacagcaacagcatttggcttcagagtcagctctttttgtagatgtctgatttctgcttagtattttatactttctaaatcaattccatttttaaattgctaggtgaattttttcatgccttggaattatgttggaaatgattaattttcatctgtagcctgcttattactttgtgtattccatatacttcaagcctgctaattctgtttttatccaatatgaaaaagaaaatcagtgtcttcattgaaatacttggacagttagttcttcagcactgtcactgatcactggtaaccactagagatgggtgatttgctcagcaggtagttgaaattgtagataggtttttcgacgttgttttccccccaacattttagcaacaatgaaggtagacagcacagtgtcccattacaaacttcttttttaagcagataaaatattggcttttttaaagaaagagaaagcaaaagcatttaatgtattaacaggcttatcgctatgcagaaaatggagggggcattaaaaaatgtaagcttgtgacatattcattgcttctgttttccagctacatcacttaaattagaagtcagcagcagtgatcttcctggctttacataggaggcaatctagagaaggttgacaagattactgtgtttggcttttttttttttttccttttttcttaagagtctaaggtttacacaatcactcacaatgtgacgcgagccagcaaggccaaaaccgctagagaaacaatgggatctctccttgtaaacttgtacagtacgcgggacttttttcaaaacagctttttgtacatgatttagagacaaattttgtacatgaaaccccagatagactataaataattctaacccaacaagtaggtagctgtgtatgacactgctttaaatcattcaaatgcctttgtttttggactgtgcaaaggttggaagtggatttgcatttctaaaatggtgacttttattctgcaagagttcttagtaacttcttgagtgtggtagactttggaacatgtacattttttgcttgtaatgttatcctgtggtagggttttgccctattttattttgagtctaagttaaatgttttctgaagagatacatgcactgaactgtttccactacaaatcaagatgtggttaaaaaatgaaaggaccaggaccagtgagatctaatactactgtcagtttaatgtccactgtgttttatacagtatcttttttttgttgttcactttggaaatttttactaaaacctgcaaaaaataaagtattgtgcaaagatgtaaggttttttgaaacttgaaatgcattaataaatagacttgatgaaatcaacttgaggtctatgctctttggactcagaaacatcagaagtagccaccatgctgaatgaaggactattcagcagaaaggtctctccatgcaagtgagggcatcactgctacagtccagagccatggtgcacagttgattgccattatcacatgtacactgtatgttgaaagttactcaacacaacggcttctcactgtttctaagcagtgtccaggacttgtcctagtgaagagctgaagctaactggaaacttgtagt

SEQ ID NO: 35100 - DNA, 2051 bp, Mus musculus
tggaccttttcaagtataaatttctataagacttcagcatgcagcattaatgttttggctctttttgtgccattttggtgtgtccttcaaatctagaaaacatgatttagtctagagaagaaagtcagtggaagatgtcagcaccacattggtgatttctaacaaaggcaggtggttcactgcatacgcgacacttcgtgtgtctattaatggctgctgtagtgccaagctggtttctcagtgtcttgtgtggaggtgagctgttttgattgcagctgggaactgcagcaggctgacagctctcggaaacattgccccatgtcttgacaggacactaatgtcagctgcttgtgttgccagagagacagtgggagccaatgttcctttatttccggtcctgccacatatctaaggggagctgtggatgtgtaacttggcctttgtgtttgttttaaaggagatgcaggcaaagctcgcagcacagaaactggccgagagactgaatattaaaatgcagagctacaatccagaaggggagtcttcagggagataccgagaagtgagggacgaagctgatgcccagtcctcggatgagtgctgaagacagggctgggacaccccgagagctggctgcagagctctcattggctcatcgaacttcctaacaagtatcaagaccagcgtcagaccttgttgagggacagcaggtttttaagttacacaaaggtagctacaaagtaagaacccagtttgtctttcagaagacgctcttcacagcttgcacagtttaatatgtgaaccttgtatttggccgtattgtgttacagttttgcagtatgttgtgcattggtctgatattttagtgtgagtagagcacacgttttctttagctgcattttccttatctgtactcttatcagatagtgctgcttacaccctttctggtgaaatactttgttaccccaggcacctaaagtgaattaggaaggcctggttccctcgctcaagaaatgaagtgtaaagaatggtccacgtgcctgcatggacatgttcctgagatgctggatgtgaaacactgtggaagacactcagaaatgttacagcaagtgcattggctgatcctgtctctctggggtgactgctgtcttcctaggatgaggacaaggagcgctgaagaggtgctgggcgggggagggtcttctgagctggtgtggggagctgctcctggcctcccttggcttgaactcattgctgtctcgatgataggtccctgtacagggcgttcacgtttggtaaggaaaccgatgtttttctaagagttacagttgacttgtgagtacattgcttttttcatttttaaacccaaagaggtgtttataggctgcagaaacctcagtcatgtatgtacacatttgtgttgtttaaaatgattatatgatcgttttgagcaaagataacagtatgttatcaaaagcctttgtctattacgtggaacttgtaaagaagaaataaaataccaatcagagcagctccccgagctcatggcgatgtgttcttggtacttgtttgagtttccgttctttaaaagcagtgttcatacatgaagttggactgaaaacacatttagattagacacatactgggaagggcttgattccatagtggatgcttctagctgtcagcactttccacatctctcccatgaagaaaaggttgctgtaagaacagtatggaacctgtggttttaaaactgctaataggtgatttcaaaacacattgttttatattccttatctggaatgaactagtgcttctagaaggctgtaaaggagagaccacactcaagcatgcagtcgcagtcagtcccccttgagctgaccacttagtctgtcaatagtcgagtgtactctgatctgctttctgtgtagccattttatatgtattatcagtttgcttcatgttttgcaaacatttcctgtgttaaatgttttatatctcaaccatctcaaccacaatatgcattttatggctgctctatagcttttaaacag

SEQ ID NO: 35101 - DNA, 1469 bp, Mus musculus
tagcttgggggggcgggttgaggggttcaagacagggtttctctgtgtagccctggctgtcctggaattcactttgtagaccaggctggcctcgaactcataaatccgcctgcctttgcctcccaagtgctgggattaaaggcgtgcgccaccacgccctgctcatagtttgggttttgactacacctcatcatcctgtggtcaggtgtgaaactttccaccctgagagaatttcatttcccattcagagcactcccttgggggaggggttagaataattttacgtgtttggttattgtcttaagccagattttttaaaaatcaaaaaaaattttttttaaacttttaagagccagcttttctttgattccattttgccttttaaatactgtgttccccatgtttaaaaacatgcctgtaatatgtatgtgctggtttctttttttccactccacagaaaattcatttgcaaattgcccgacaaaggtaaaaagatctcagacacagttgccaaactgaaagctgccatttcagaacgtgaagaggttagagggagaagtgaactgtttcatcctgttagtgtagactgtaagctaaggcaaaaagcaaccacaagagctgacaccgatgtagacaaggcccagagttctgacctgatgcttgatacttcatcattagatcctgactgttcctcaatagacattaagtcatctaaatcaacctcagaaacacagggacctacacatctcactcacagaggcaatgaagagactttggaggctggctacacagtaaacagcagcccagctgcccacatccgagcccgggcgccctcatccgaagttaaggagcatctcccccagcactctgtttcaagtcaagaggaagagatctccagcagcatcgacagtctcttcatcactaaattgcaaaaaatcacaattgcagaccagagtgaaccctcagaagaaaacaccagcactgagaactttccagaactgcagagtgagactcctaagaagcctcattacatgaaagtgctagaaatgcgagccagaaacccagtgccccctcctcataagtttaagaccaatgtgtaagtgtcaccggaacaggcttgtcataagagtgaatgtgtgtggagctcagaaaaagagttcaaagtgtcatactagttgaggggatgtcatgtgaggagcatgtgggtcggattgaccatactgtctgtgaaagtagaccagaggggctagaatggaaaactgcttttggaaaaaaaatgctagttttgaaggcaagtcattagaagggttttaaatagcagatggggagtcttgtgtttcaagacacttagacaatatttcataataaacacagagtgggagggcagatgtaccatgacttctttcagtaccatttgctggtgtgcagctctcctctcagttgctgtgtaagccaagagaagcaattgc

SEQ ID NO: 35102 - DNA, 1085 bp, Mus musculus
gctcgtggaagggagagcagaggccaccactggaaacacttgtagagtccctcaccccaccacacacacacacaccagaggaggctaaacgagatgagggcatgtctcctgtgctgtaatggagtgggcagcgagccggtgtgtgcagtatagtcagtgagtgacgcgacactggaatgaggtttagaacgaggtttgtaagtcccagcctcatctcttccctgtgatcctgacaggtgcatcctgggacaaggtggcgattaggactccaggtccttctcagctcgaatctgttgagcatcccttggtcttcttatatatacatgtttttctgtttattcctttaagaactaatcctgctcaagagcgttttctttagctagcttaaaaatatctcctgtaaaaacatacatgttgccaagtgcaatgttgagaagacaatcactgtatggcttttataaatttgtttttcctgctctggagtgtcattccaccatgacagttggaatattctggtgggtcttttagtagggattggttactatgcgttgtcatggggaagagacattttttatcacagctacctccatgggaatgacttcatggataaagcaaggtttcctttcaataaactgtcacttgacaggaatcctggctcttgtattattttctatcttttgatttctgtccagtttggatgctgtgttactgtgcaagcatgaggacccattcaatccccagaacccacacccaagaggcaagtgtagtggcgcactcctgtaattcctggggaggtggagacggggatttggggagcttggtggcccgccagttatgtggaattagtgaggtccaagcaaaaagaaagcgccaatgtatatgctgggagctacaggggttgcccagggccactctgagagactatggggtggtgagcagtgaatgctgatgaaatgttagccatggccttgatgtgctgagtcccagctggttcattccaaaatcacaaagggaagttactccagcttgacaactgagaatcagatccctgtttcctaaggttggctgcctcctctgcaagcaca

SEQ ID NO: 35103 - DNA, 1584 bp, Mus musculus
cagcactatcgccagccagatctgagtctgcttccaggcccgttgatcctgacaggactctgcagtcatctagacagagtaggaggcactaaatagagcttgtgaatggagtcagacccacggttaccacctcacattcctcctggggcctctgcgtggttgagtgaccttggatcttagatagggagctattgaagtttcagatgacctaactgggacatttgggggtaagacaaagccccattgtgcactgctgtctgccatcactccttctcctgccccggagaaggttccagtgccagctgtaatgatatagggacacatagggatgaaatgatgtatagactgaaccagaccttctcaaggaccgctgttctccttaaggatgctccagagcctttcgagtatgacatctttgtaaagttcacaaactgatcttgattatcttttaaaatatgaagctaccagatctcaagtattaagaagctggaggcaaaggagggagagtgaaggctattctggaaaccagagggggtcagacagtgggaatcaataattggtttgtatgggaaaccagctcattgatggttggggaaggacacttaggcggagtctgaggccttggttgcttattttatctgaaccatgcaaagagcagtccctactccccactgctttcaagcaagcagaatgggagacagatgagatttttaacaagtgctgtgcttcctaaaggacaagagcgctgttgttgtgtctccttggcccttttcctccatggcagacctccaagcgaagctcgctcaggcctggaattggaggaataggaggggccttgagacgaggcctatgggcttaggtatgaggctaaggagggaggcatccaggaagttcatggggcaggggatgagtaagtgggtatggggctgatgtaagaaggaatacagagacgttcttgaaagctgggggatgtgcaagaagggcagggggtgggggttgagctggagtttggaatgatgggaaaagggattgggagtgcttgccatctgaagggctgtttttgggaacaggtgtcaggaaggggtgaggtccaagggcaagcacatgatgccaaggtagttttgggaggatgctgggcatccctgcatatctcctggcctacccatgtctcctcatgactgtgacagtcacctatgaaagagccttgtgagttgcctatgtgtaaggcagaggtgacaggacactggagcagagtcctcaggcttcctgatatggggactcctggggaccaggttaccataaggtcctgtccacagcaggtcagagttcacacagctagattcagagaagggatctgaaggatgagcatctgctgccagagaaccaagccctattacacatcccgagatccactgtctccctcgcctgtctcctcactgggtatggagagacttctgctttcagccattcttccatgtaacaagcatgtactatcatccatcaaaatgtgtcaggcacagacttgggcactggaaacacagtaaatagaagtaaaaatgttgagccggaaatgtagctcagctg

SEQ ID NO: 35104 - DNA, 1194 bp, Mus musculus
agttccaaaggcagttcctaaactctgacacttctgcccctcagctcacactctcagggaaaggcacacactgatgctgccgggctccctaccttctagaagtgcacaccggaggctgccattttctgatacctcccctgggccaggcattttgctagtgacttcttcagctctaactagagttctctctgggttttgtcttaactctggcaacccctctggaaggtggatgggattcattgtttctaaaagggcagggccaaggtcctcagtggctaaggctacagctcaaccatgcaccggttagggaagagcaaagttccgatctcagggctgtgtacccagcccctagtcactcttccatgctgtccccaaggcagggttaagccagaccccacagcccagacctggtgcttggcagggatgattggagatgctttccatgtcggaatggactccagatggagcatggcagggtcccctcataccacgccgcttcctctagatggccgacattgctgaggcctcccgcacatcctctttggagctgcagaagcagctgggcgagtataaggagaagaaccgccgggagcttgcggaaatgcagacacaactgaaggagaaatgcctggaagtggaaaaggccagactggcagcctcgaagatgcaggatgaggtaacgcctacctgccgggaaatcctctcctttatctcttctgagagtcagtcctccagcttgctttgcaaggcttctgttgagggggctgggacaggggaatgcttaaggaagctttggggcttgttttgtctctgttctctagtgattatatgtaggtagcatcctaagaggcaaaactcccactgacacacaagcgaaacaggaacagctttaactgggccacgttctggttcggtccaaagttttctgcttgaaaagttgaatcaccttttatgagcaatgacattgtgtcgatctgtgtccaaacatgtcattcgcctccgtgccttctatcatccctagaacaagatggcaggaagtgatgaggtttttttttttttaacaactttttctttttaagatgactaggttattttaacagccattttgtttggttggttatgtgtgtatgcatgtttccacatgagtgtgtctgtttgcatccacgtatgtgctggtgcccacggagaacaaaa

SEQ ID NO: 35105 - DNA, 1218 bp, Mus musculus
cctatcttcttcctctgacattcagcttgttttttcaatactgagtattgaagtgattccctcagctgggcggtggtggcacacacctttaatctcagcactcatgaaacaggcaggaggatctctgtgagttcaaggccagcctagtctacgtagtgagttctaggatacagggctattacatagacaaactgtgtcttggagaaggagaaggggaaaaaagatggaagaggaagagaggaaaaggaaggaaggacgaggaagagaacaagaaatgaagatgatgatgatgatgctaagcaagcctattgccatgaggttacatctccaacttttaaaaaaatctttaattttgagatagtctctctaggttgcctaggctagcttcaaattcaccaactatctcaggctagcctggaattttcaatcatcctgcctcatcctcctgttattgggatggcagacatataccaggaggttccagcagcaacttccttcacgggttggggaccacctatgaatactcagcactttgttctccttgttcgcagaatgttgaggtcctggccagcaggagcaactcctcagagcagagccaggcggaggctgacctgcgtgagaaagtgctgaaggaggagaatgagaagctgcaggggaggattgcggagctggagcgcagggcagcccagctacagaggcagatggaggatgtgaagggtgacgaggcccaagcaaaggagacactccgaaagtgtgaggtaagagggccttggctggggtttggtggcttatagccctccttcctgaaagtgatttcagaggtggggaaggcagtcaggatttagttaagatgccaaggtaaactgcaagcataggcctaggccacacagttcccagagactcaggcatcagatatactaacctccctgaggctcactggggaacctcccaacacctgcagaggccattgtcacacctccagtaggctgactcactaaagacatcttttctttaacacatagctgatatttttggagattttagcaaaccagttatctggtttgcccaggctttaaagtaggaagcagttaggaaaagaggtggtgagaaacggcagctgagtggcagagggccatcctgggcacctgcatgccttctacagcacggccttgccctaggtggagtttctgcatacctaggggtaaagcgtgggtactt

SEQ ID NO: 35106 - DNA, 1146 bp, Mus musculus
tatttttggtgattagcttcttgagttctttatattctttggatattagccctgtattggatgtggggttagtgaagattttttaccaatctgtaggttgccgatttgtctcatcgactatgtcctttgccttacagtttcatgaggtcccatttatcaattcttgatattagagcatgagccattggagttctgtttatgaaattttccccgtgccaatgagttcaaggttctttcccactttctcttctattagattcggagtatctggcttaatgttgaggtccttgatccacttggacttgagtactttgtacaaggtgacaagggtctattttcattcttctacattcagacaagcagttagacgagcaccacttattgaagttgttttcttttttccattgaattttaaagtatttattgattccttctaaatttcaaggcatcgattcaggcactgttggttattcagaagtgacgagcttgatcattagcagcaagatgacttgtctccttggctttgtgttatagtctagtctcctgagacaagatctaggacttgggagcccggcacagctgtcttcttcaggaaagcctggaacaccatactactcattctctgccacaagttcgagaagaagaccgctccatgattctgtagccctaggtgagtgtttgacacagaaaaccctgtctcccaggagccctcactcctttagtctgtatttctggctgtgcttttaatgaggagaaatgtactttctaagtcatcatttggaagtcagggatatttacatacaaataatatacaggctgagtattcccaatccaaaatctaaaatccagagaactaaagtatgaaacctgttgaatactgacattttatacctcacctcctgagacgggccacagccatgaagcacactaaataaaatatatacagaattacctttggactatgtagaaagggtgtatatgaaacataaatgaacctaatctttacatgtgggttctgaccccaagatactgcatgatgtgtatacagatagtcctgctacaagcatttcaggtaagggatactcatcctgtatgcgttagatacataatgaatgaagttgtcagagctcccactgttgcaaagca

SEQ ID NO: 35107 - DNA, 1183 bp, Mus musculus
gtgattgaggaagaactgaaacttgtctcagacctaggaaccaagtacaggtctcattcctctcagtaaaccccagtcagttcagatacaaacaggatttggcttctacaaaaggaagaaagggaaggaaaatgcccaaaggcactgttttacaagatagtgatgtttagtgcggattgtcaacttttataggatttggattcaccaggaagacaagctcccaggaatacctttgagggataattatcctctaagcatgcctgagagggagggttatgctgataagattatagaggtggaaagatctaaaattaggtggcaccattttcttggcttaggttctagattgtacaaaaaggaaaaagcaagttgagcacagcccatgtgctcctgccaccaggacttaacccctgtgatgagctgtgtcctcagactgggagccaaaagaagcccttcttttcttaaggttattttgttgttgttgtttgtttgttttgggttttttgtttgttttggtgttttgttttgtttcatcttgtcttttagacagggtctctctatgtagccttggctgtcctggaactcataaaccaggctggccacaaactctcagagctccacctgcttctgcctcccaagcactgggattaaaggtgtatacttccatggctgactttttctgaagtttttgccttgtcacgtattttgccagaacagaccaagtacccaagacaaggatctataggggattgaacctgaaccaaaacagaaaagaagtactccagtaaaaacctaaaaagtacaaagaaagaacagtgcatcacttgggcagcgcaagaggatgaaatgagagcttactgcccgtatttgatgccttacataggaagagggcatgcccatgcctgtggactgggcattcttttctacacatgatatcaagtgatctacattataacagagaaaagtaaaagatgaaaggaccagttatggcatggtgactgggtatgatggctcatgtaaccccagagctttaggcatccaaacagcagaattgtacaagtttaaagccagtctggacttgtaagtagtaagttccaggccagctggggttattaagtgagaccctgtcttaaaacccaaacaaacaaaaacccaggtggtacagagacaaatctgcaaaatt

SEQ ID NO: 35108 - DNA, 1176 bp, Mus musculus
tagccctggctgtcctggaactcactttgtagaccaggctggcctcgaactcagaaatccgcctgccttttcagaggtacagcttgctttttttttttttttttttttttttaacaaaacaaaactctcagaactgcaagaacctcttcaccttggttagcccactacatccagattcatatgacatgctcctgacatttaacaaataaagaacaccattaggctctggaaaactagctttctagaagaaacatggcagaaggtgctttgtagctgttcaaagaaaagtaaatgtaatgcagagtaaagtagcatagtgcttatcagatggctttgtgtgtttttataactcgttttaggtgtcttgctcagcctagtaccagtcgtaccagtcaaaagtctaatagttgaggacactggttttttttttttttttttttttttttactgtaagtctctacttacagccatcatttccttgctgaagtctctacaaccaagtttcaaggagaactctatacaattgatattgcccaaactagaatttgtaataaacccaacagtattatggagtcacactaaagtgtagaatcaccaaaatatcacaacagaactctaaacctaatgatttgatatatgtgatttttttttctgagataatgaaaatgacagtaactttaagggagccattgtagcttatcatctgacttcatggagtttcagaagagtgagtctttaatgctttctcaatgtgtagtcatttccagatctctgaaagtgtgtggttttattcactgacctgcattctcacaccctttgctgtttacttacacacacacacacacgtgaatggggcctagttaccactcaagaggccaaagcctggagagtgtacatggcccagttcttggagctcttcagctcacctccccatcaccctgcccccatactgttttagataccatgtgtacttctgctgtttttactctatagctttttctttctccatctattgcgtagcacctttatagccagtctgatctgttgagtacactttacagttctataatggcgttggtctgagagataggccttccttaagtattcccaaggcctgtgtctaattccagcccagtgaagatgaacttaaaatctgatgatacctgtagtaggaga

SEQ ID NO: 35109 - DNA, 1237 bp, Mus musculus
cccataaaaattgtttgagaaacatcaacaaaaatttcaaaagtaagccaggtagtgttggcacatacctttcatcctggcactcaggcagagacaggcagatttctgtttgaggtagtgtgcaaagccagtttcagacacgtgtcctgctgacaaaactcttagatttaggtacctatcaaaaggaaagtagttgagagcctgttaggaattgggtttgacagtccatttaagaaggaataaggctgtttccgtgctgtgaatgccactaatgaccaacacgcagctttagaggggaagcattggtgcctcagaacgctttgcttacatactcttgcagcgtaaatgtggccaatgtattttgaacaacatagtacttaattattttatttagacaaagaacttttttccattacaaagttctacaacattaaaaaaatccaatcatattaagtttctttttgacatcatacaaaaaggctgtataagagaagtgttgttctagtagcctatgtgtttaggagatgtgaatctactgggaggaagtgaggcaggtgtgttgagttcatcttcctcttctagcaacttcagtgcttttcatatgtatggtcagtttggcattattgcttggaatagctttttaaaaagatactttattctccccatgaaatagtaagaaggtttccttttttttttttttttttttttttttaattcgttgcctaatttctaagtataatttcttcagctgttcaggctgtttgcaaaagacaataatatgaagaaccattatgttcccccacccttgaaagctaatgcaagcagctacatgtatattatcacaccaaaattttgttgaattaaataaatacattgtttaagtggtttatttttctacacgagcaattaggtaagtatgttatttcaggtggaagacttggagcctgtaggcggaacaatggtaagcttttgttaggagggaagacttcatggaagaacatgagtaagtaggtaaatagctagggtggtatggttcatctttgtaaataaaggagaccaacaaacatttgaaaccaagggcaggaagtaagtggaggggcaaaacatacctgtagtttgtagaattgtgtatgttaatttcatgtttatacctctttcaatttcaatgaaaaacattttgaatgggaagtttttctttgcagtgtcatatataacaaaacagtatactaaaaactaa

SEQ ID NO: 35110 - DNA, 1616 bp, Mus musculus
cccttgtagagcagagacagcagtagacctggcagatggagaggaaagaagctgaagtgacatagtcatttcaagtttcattcccaacagcacttagaacaatagtgtctggtgagctcaggagtgccgtggtaaagggcagccgagggagatctgaggaggtctgtcatacacttcacctgtgtgttcaatcttattaaatcagtttaccagtaatagcatggttagtatgaatttccacatttaaaaaaacctgaatagaactttagtgaaaactaagtttgtcatccaaaggtctcttagcactttttgataaaatcttgtttaccaatatgaaattattataatactaattgctatgttcatcagacttttccaactttcattagtactaaaagtcctcatcacctgaatatttcttttagtaaacttaaaggaagagatttaaaaccatgcattttttaaaaatacctttaaactgcctatcaactgttactgttaatgaagactttgtttttactatgatcctggtgataaagcatgcttagagtgctaaattggcctgttgagaacttggatgaatataaaaattaagtttggatttaatataacattccaatctgtcagaagcatgcaaacagaattttagaatctgtgcacctccatacaagtgttagcctgccaggctgtcagcttacctttattaaactttcagtgaaagtgaaattatgaaaatataagtttatatttgtgcttttagtcagtgtataagctgtgcagaaccccacctcagcccccatgaactagttgtataaagtagaaatctgttattgaagctcttaaatagctactatgcttttaatattatttcaatgatttttagcaatagacccataaaaatggtctggaaaccaaaccaaagtatggtagaatgtaggcaaaaagaattgacctaaaaacatgcctccgcatgtactcaactatgttaagggacttccttaattgtaaaagttgaaacttcaaatgggaccctaaagcatatgtttaaaaacaaaaaaaaaaaagtttgtggaaattagcctaatttatcagctattaagttgatttttagatatagaaatgaatataacaaacaatttcattttaagtactaataaaattttattttaaatgctgcatttttaattcttaagatgtactttgaattcttaaactgtctaattgaatgttaaacgttttcaaggcctgttaaaattctgttgtatatagtagtttttgagcagatatttgcaataaaaacctgtctttgaataattttatattcagattcctgtttggctagcctgtctttgttgctgtcgtgtgcattgtaggcagtagttcttgtacactataagctccattctgtgtgctttactaacagactgaactgaaaacacaagggacacactgctaatacttacacagtaattctttcacattaagagaaagaatagtattgtacatttattttccttatcaatttaaagaggttgagtaggaaaaacacataattgttttcttgaacatttaaagagagctggttttttttcatctttcctgcttccaatacaagt

SEQ ID NO: 35111 - DNA, 1190 bp, Mus musculus
ttttaagtcatttcaaattaagaatccataataagaatgattatgtagtcattaagtgcaccacaatgaaaccatgtatttctttctaataagcaatgagcaaaggaaagatacttgcaaactgaacgataattttaaaaatatgtgggcacagcagaggttagtggaaagtattatctttgcagttttagaaaggagtagttaaaagccggtaatcttgtgtttacacatatatttataatagctaaaacatgagagtagccttcatatccatcagctgatggaatgtaaacaagatgcagtatgtgagcctttagtggtactaaggagtactcaagaatactctatgaatagatgacacatgtggacctttgtcccctgggaacagctgtgggacacatttgtgagagcttagattaactgtgctggcagcttctccacagtcaggggagagttggtgacagcaagaagcagacctctctacccactccccaccaactggaaagtcactgatgggtgatcactcctctgtccttcccagggaaggtcctgagaacacagcttcagtgagcactgtgtaaccatctttccaacttgccctgggttgggtttcttctttcctgatacattctgttctcaacagagactctggaaagttactggggtccgagtgactgtacagcaaatgatttaaaggtttcaagaccaggttttggaacacaggaaagggcagaaatttggtagcccgcactgctggtgactagtctattccttatgcggacccagcagggggtgtatggacattttcacattaaagcaattctttggccaaacattctcctgccttttgttctttgcaagatgtcttcactactgaattgaacaaaaaattgaaaaaaaaaatgtgtgctgatgccataaactcgaggcattcagactaaatgtcacaaactaaactgttctccaagcccttgatgtctgtgcaattatttggcaagtaagtacaaaatatgcagtataaaacatcatgtacccagaacataaaacaaaatatatgtctttgagtagcttgattagtttcaggagggaatgcgagaggcacatgcccatggaggaagtgagaggctggtgcggctgttaagattttagatgcatgaacagtggcttcccagagcttgggggcgggggga

SEQ ID NO: 35112 - DNA, 1146 bp, Mus musculus
ttgaggcttggcaccatgaggagaacctatgagaagctattgatgaagcctaattgtagcagaagactccagtgtaatgaagatgccactaccatggaatgaccaccaagaacagcagcagcagtggaagagtcagccagagcctagagtgctacggagggcaaagctccttcctttgaaggagcccaaaggactatgtgtggatcccaaacactggaacaagaagctgtaacactgaagttgtcttggagacctcaagatgatcgagatgccagagccatgggatatctgctaaggaacgctgctaacagggagtggaaccaacccaggagaaagaactttgttgcagtcaagaaagatgaaaaaggagttggaaatctgaagactgctttgacaacagatatggacatgcagagaatggagtttgcccagctggttttctgtcttgctttggagattacagttaagtgattgtagaatcttaggagactgaattttgaactttcaacattgttgagactgttatagactatggaactttggaaggtggactaactgtattttgcattttttttttttttgaaacagggtttctctgtgtagccctggctgtcctggagctcagtctgtggaccaatctggcctcgaactcagaaatctgcctgcctctgcctcccaaggcctgggatcaaagccgtacgccaccactgcccagcgcatttttctatggctaggtacaacctctatagattcatgtgtttgaacatgcccatgggagccaggtttgaatatagttggcccagggaatggcactattaggaggtgtgaccttgttggactaagtgtggctttgttggaggaagtgtgttgtcatcggcgtgggctttaattaagaccctcatcctagctgcctagaactcagtcttctgtttgcctttgtaacaagatgtagaactctcagctcctccaacaccattcctgcctggtctctgccatgctccagccttgatgataatgaactgaacctctgaacctgtaagccagccccaattaaatgttgtccttataagaattgccttggtcatggtgtctgttcacagcagtaaaactccagctaagacagtgataaataacaactttataaaa

SEQ ID NO: 35113 - DNA, 1149 bp, Mus musculus
tgttagagggagggtttgtacaatttaaggaactgtctaaggcagtccagggggcagttacttgatcctagagttaaccttcctataaatcgcagttacgtgcatctgaccctccctcctgcttcatttagatgcaggcaccctcattttgatagttttactatcagaccagatgaaatggggtcatggtagcagcctcaagcaaaaataatagggactttgatagttactgatgaaaattcagatgtttctaataatgtaactacttctttgtgtattgttttcctttagtcagttctcaggtacacactactgttctttttgactgttgtgtgtcattttgtaaatgttttaaagatgcattgcgaacatctctttttggttggtttgagtttggttttgttttgtttgatttggtttaattgttgtttgagatggagtttctctgcagcgctggctgtcctggaactctctctgtaaaacatgctggcctcaaacttagaaatgtagatccctgtctttgcctcccaagtgttggaattaaaggccagttccaccaccacctagccttgtgaacaccttaatcttacttttcctatttcagcctttccataatactttaacatatttccttgtaaaatttatttgtatactttagcctttttttttttttttttttttttgatctttgaatcgtttttattttgaatctgtttttggcttcaggtgatttttaaaacttgaataggtatccattcccagcaccattcattgagaatcctctagcttatcaaaatttgtaatgtacaggtctttttatagactcttcctctccccatcagtgtcttgtgtactatcactttatatgaaatctggaaaatagttctataaacaactcattgtttatgtcatttccattcaagttttagaattactttgtcaatttctatttttagaaaaaaattattgatattttttattgggacttcagtgactatgtcacagtcttcctctatgagatagggtttttcactattatagttgattcttccatattttctctcaatatatctttgtagttttctctgtaaatttcatacagattttcttaaaactattcctaaacattaaaatttttaaagtttagat

SEQ ID NO: 35114 - DNA, 1138 bp, Mus musculus
aaaactcacaagggtcacaattattatctagcattagtgcttaaaatactgaagctttgtagtaattcactaacaatgagcagaccatttttacaatgtgctttctcgtttatctcactagcatatgctgatcataaagcagtagcttttcttattcataaatatattcataattgaatatgacattgtggtaatgcttaccccctctgttgctttctctgatcctcctccctttaatccttttccctttcaatgtacctaattgtcctgcttttatttttatgccacctgaaatgcctgtatgaaagaaaatatgtggtatattctgatattggctattttgtttccatctattttctgacaagataattttcattgtagctgaataaaactgttgtatatcagtatcacattttgtttatcctttatcaatcaatcagcagtttaggctgctcttacaacattagtatttcaaacatatacagatactttttccatcttttattgattattttatttatttacatttcaaatgttatcccccttcccatttcccttctccaactctccatcctctaccctcttaccccgctaccaagatacttttattgtatatgctgctgaaggaatgtcaaagataataaaagttagtgtgacatagtaatgtatgcctacctgatctttctctctactttgtgattttttttttataactttagatttttaaaaacaaaattgggtactaaactatactagaaaggtccccatctggcttcatcttattttttaggattcttcctcacaaaagaattaattagaacaaaacggataaaagcttcatcttggttgatggtaaaagtataacctgatactagaaagcattattaaatctatccataaatgcaaactaattatccataagctgaacttgtttctgattgacagctaggacccaaagcagagaagcaatcagaatagtgttgcaagctttaaatcaagttgagttattaacaggaggttttgcttatttgtttcactgtgtatatattgtttaaaatttataggaagagattatcagagctggggggggggttgttgttgttgttttgttttttatttttttacagtccagtcatta

SEQ ID NO: 35115 - DNA, 1152 bp, Mus musculus
gccattttttcagccccttttatcacctggttattatccaatcatctttgctttaacagtaaaagtggagaaagatgttagcttatcttgtttccctcctgtaattcaaaaacatgggaatctccctggttaaaaaataattataatgttaataatacacttaaaaaatgttcttgtcttataatgaaagactggtgttaacttttttttttttttgcaaccattaaagcaggacatagaaaagaatagaaaaggccctttttgtatcagagaaataatatataagaaaacagaaggggatgaaaattaagaatttattacagattgacccaagtgtccaccacaggctggcccatgtggctggaagaaggacactcaagcacctgccctggccacaatggtgttggatggccagaagatagacacccagtacctgcctctggccctaccacagtggaagaatgtgtgatggagagatggaagagaaagtgaggctaaggggttcgtacattgtggggaaagtggaactagaggccatggtgaggtccttacctgagctgctacctagagcatgatactgctgtagctggagtctgtgttgagatctgtggtccaggttaccaccaaagcagatgtccatggtcgtagttgccattggggcagtgggacatgctgatctgagtggcctctgctcctgcagggagggaacatgtcagggtctgtgattttatggcagccaggggcctgtgttgatgtccaaggccgtgttaccaccaaagcccatgcaggtgctctagtttagactgatacttgagacactgtgctgaactggccctacccctcaccagcagcacctagactgggcagcatagtagagctgaccctgaggacttgcaagcaggggagttgaccctgccctttgcaggatgtggcattgagtgatctaacaagggcagtgctagagagcttaccctgatggttcgggcactagagaaactggtgggctgactaactcagctaccttccaggcccagatctacagctttgagttggcccaccccaacatctactccatctatgatctactggagtccatgaaagggcaggtcctgcagatccaaagctgcaggatctctgtaacacagggtatct

SEQ ID NO: 35116 - DNA, 1131 bp, Mus musculus
tccccatctcttacacgcacgcacacacacacacacatgacattaagatttaatagaagaaatacaagcatgttaggaagttgtctcgtgttttattatttgcttgctgagattggagtgttagaaggaaaatagaggatttttttttaagtttcttcaccaccgctccatgtacatactgaaattctactgaagaattcattattttttaatgcttttcaccatggtatcctttagtattcagcttccctcctcagtttgctgactaactcctttgcttctctgaatgtagtaatacagttctatcatggatcaaaacaccaagcaggaaagagataacgttaaaagcccagcaaaaaagcatttcttcacttgaggtctgaagcctcagatctttctatctctgataacacaaaggggatgatattagtacttgaagagaggagcattttattacatgcttgacttatttattgtgatggacacagttgcaaaagaagcaaagcactcaggatttgttttaaagtgtttctctgtggctcccattttgttttatgaatagtatttatgaatctcatgttaacacaaaactagtaggcagctccatttaagtgagtttcaaggtaattttcaaagagatgttaaagttaaccctgagttttaaaagattacatgaaaacattcactgtactctcctgactagccaagcttttcttttaccttaattcaaaaagaaattagaagactacaatctgaatatttaataaatatgatagaagggttaatttaataagggtccattgttcaacagatttgaaagtagggtattaacatattctaataaatcaatggtgctagagttggctcagaggtttatctatggatatgtcctagttactggcatatgtgtgtgtttgctgttaatttgatttaatgatttgttagttttttttcttgataatagttatttcttcactgtacattgagatacagcactactgcacaccaaagtatgtaatacccaaaggaaactgtgtgatttcttctaacaaatgatgggagcctttctcagtgagatactctgaaaaggagactttgaggccattctaatcccttgtttacattgttagc

SEQ ID NO: 35117 - DNA, 1035 bp, Mus musculus
ccgggtcctatggcgggcggcttccgatcggccaggagcacgcttttcaaatgtggctttaggttgggggctagctaaaacgcctaatctgtaggcgacaggctcgcgtggcgggctcccagggagacctgttgttcgagcaaaaccgcaaggtagtggctttgcggaagagccacgtttctcggcccttcccccactccaccccacccccgcctcctccgggggctgcggggcctccgccgccaacctcgcccgcccttccccccacccccgcgcgcgcgctgccgcccccgccgcgggccccgcgacgcgcgctccggacgagctccttgtttctggagtcccgccacgcttgctccaacccagccccccaagcctcgcgcgcagccgcagagcgggtcccgccccttctcgccgcgcgcccctgcaccccagcgcgctcccggagtgggcctcctccgccgcagcgacgcctcctcctcctcttcctctctccttctctctcggtctctcgctctctctcgccgctgcagcctagtaggggcgcttcgtccagcatgagctcggacatggcagccgacgagtcggaggccccagtactctcggaggacgaggtgcgggaaggctgcgtgccgcgcgggggttcatcgtggcgaggggtggccggggtgggtagcgggggtggcgggcgatcggggcccgaatttggccccgcgctccggagcggggcaggcggtgagggggagatggagagaggcgcgcacgaggcctctgcgggagcagattccccgcttgctcgcctcgctgctcggggccttgggcctcccccggggggcctccgggggcctttggctgcggcctgggcgcgctcgctcaccctctccgggagggccatggcttgggtggggcggcctcccgagactcagcatcccgctcctgccgcagcgggagccgacagaacttagcgactttgccactatggcttcccgagggccagggttgggaacgaaggggggtggggggagggtgggattc

SEQ ID NO: 35118 - DNA, 1185 bp, Mus musculus
cttcaattcttgccttgatttccctgtatagccccagctgtcctggaactcaaatccacctgcctctgcctcccaagtgctgggattaagtgcgccgcctggcggactgaatgtttttaagccaaatccccaaggttgctttttattggaatattttccccagtatctgaaatgaatccagaatacctacccttttttgatttaaacgatttataatctgtaggttaagagtgcgtacaacagtgtagtccacagcttggagacattacctacatttgcacagactcacatccaactttttatttgctgagccacttgagaataagttacagaatttgtgccattttctgctgaatactttgttattcatcactttagaaagtataatatttttattattttgttgagaatttcacaacaatgtatttatttttttaaattatgggtatgggagttttgcctggataagacagaagatggtggcggatcccccggaagtgatgttacagatacttgtgagcctccatgtggatgctgggagttgaatccgaattccctggaagaggagcacgtgctgttcactgctgatccgtacctggagctccacaacgtatgtttttaaattcttatttatgcgtatgggtgttttgtttgtatgtatgcctttatatggtgtgtattcctagtgtccatagagactggaagagggcctcttcagaccttagacctggacttagagatggttgtgagcccccgtgtaggtgctaggaattgaatccagatcctttggaagaacagctaatgctttaaactgctgagctatttctcaaccccccaaattaatgaatttcctttgaggcaggatctcataatagccctgactagcctggaacttgctatgtaaaccacgctggtcttgaattgttctagtgctggctccaaggggttaaagtggcttatcaccacacctagccatagacaatgtaatgtgatcatatttaccctgccaacttctccccccagctaccctcagatgatatatctcttttaagacaaggaaattctcccatgagacctcattccactgttgacatgcaagatcattggtatttgacatatcatagtgtgttcactgttatttataaactgtttaatggtacttaaaaactaccttttctttgtagt

SEQ ID NO: 35119 - DNA, 1174 bp, Mus musculus
ccagttatcccgttgtagccctgtgtcatggagatcctgcagctggatctgcagaactagccttgtcttgtgtctcagcttgtctcagatggggtgggccaatttcagaacctctggacctgggcctgtgtggtagcagagctagccaacccaccagcttcttctttacctggaccatcagtacaaactctccaggcttgctctggcatggccacccaatgctgccgttggcaggaggcagggctagctctcctgcactcatacccttagctggctcacctgtatctaggcctccagagccagttctgtgctgcccagtcaaggcatggggcccactctcccaagttctacactaaatctttggtcattctacagatgtggtaattaaagtttttaataaagtataaatttctataactgtatacagatccctggtttttagggtacaaagcaatagaaataatagaactgaaaatctgataatttgaacagttggactaaattactattagtaactactaaaacttacttgtttttaacttttaacagtgatccttacgtaagagtgacattgtatgacccgatgagtggaatccttaccagcgtgcagacaaaaactatcaaaaaggttagatttagccagctttcaaagatttttaataaactttgctttttctatgacaagtcattctaaaaaataaattatgctacgtttattgtcttttagtctttgaatccaaaatggaatgaagaaatactgttcagggtaagtattattttattaaaaattttttctttgtaggtaccattatgtagtcatttacaatatcttaaaataacactttgaaatgtgcctagagggtgttttttatgagacagggtttctctgtgtagccctggctgtcttggaactcactctgtagaccaggctggcctcgaactccgagatccgcctgcctctgcctcccaagtgctgggattaaaggagtgcgccaccactgcctggcagaaagcatggttgctgggaattgaactcaggacctctggaagagcagtcagtgctcttagcctctgagctatctctccagcccttacacgcccttcttaactcaccccacctctcatcctgtcctgctattcaagctcccagtagagtgaggggcacacttctgcc

SEQ ID NO: 35120 - DNA, 1099 bp, Mus musculus
tctgttgatgctgctgtgaatgagagcagtgaatgtgggtgtgctagcatctctgtggggtagtaacttactggatatgtactcagggttaaatttcaaactgaccagcacctgaggtgcctatttaacatatcaaagtagatctggcccagatcatgctgaagaacattcagtgttcttgacctgtgtgtcatctcctgtccagatctggtgaggttttttgttttgttttgttttgttttcttatttttttcaagacagggtttctttgtagcactggctattctggaactcattttgtagaccagggtggcctggaactcagaaatcctcctgcctctgcctcccaagggctgggattaaaggtgtgtgccaccatgctcggcttttgttgagtttttaatttccaacatttctctttctcaaaaatatgaattttctcactagatttctatttcactcacagtgctggattgatttctcatctgttgaaatagatagtgtggtgcgggatggaagtgtgcgggatggatagtgtgatgcgggacgcagctggaagttcttcacccatagtgtacacgtgcatgatgaggatcagggactttaaagatacaaaccatcaaagcttacttaagcagaaataggttgtccaaatagtcccgtcttataaagaaattgaatattgaagttaaaaacatttagccaagaagaatttgatcccagtattcctacttttgaattatgtcatacattctacacaatgttatatgaaaaaataaaaaaggagggatcatgtagcaatttgtttgtaaaaccagaagtactctcttaaaaaaaccaagtgtagactgtgagagaatagaactgaacatcattagtattctagttttgtttctgttcttttttttttttaagatttttatttattattatatgtaagtacactgtagctgtcttcagacacaccagaagagggagtcagatcttgttacggatggttgtgagccaccatgtggttgctgggatttgaactctggaccttcggaagagcagtcgggtgctcttacccactgagccatctcaccagcccgtttctgtt

SEQ ID NO: 35121 - DNA, 1099 bp, Mus musculus
gtggcattatctcctgcgaaggagatcttagattgtgttaagtgtaagtcttcacagttgcatagcacgtactgtagccaggaaaccccatctgaaatatataaatatatatatataatcttcaacctctggtatattaaaaaatggtttcttttatgtttagtaataagtagatttttttttttggtttttgtttttttgtttttcaagacaggggttctctgtataaccctggctgtcctggaactcactctgtagaccaggctggcctcgaactcagaaatctgcctgcctctgcctcccaagttctgggattaaaggcgtgtgccaccacgcccggcccagtaaattttaactattgaaatatttctgcaaaaatgggagacattagctttgaaaaataccacatatcatttcaacaacaaaaagtgttggaataagtgtgactgtgggtaacgtgagtcttgcctattctttgtgcaattgaactgcttacctgggtcagtaagttgctcattttgaagatgtttcttggcatctacaggtgaatggatattcgtgtttttaaagaaagcttgttttcttttatgtaggtccttccacagcgacaccgcattcttttcgaagtgtttgatgaaaatcgtttggtaagttctgtcacactgcatgagtgtgtaggttgcattgatggtgaacttcaggagagtggtggcagttgggtcaggaacctgagatctgagactgatctgagagacttctgagctactaatggggctatggtatttttctttctcctttcctggagttaaccctcccattccattctgttctgaaggacctgtcctgcttgttaagactgtaaagtctctctcaacgcctatgtgacagaaggtggggaagggaagccgtttttcctcgttttccatgccgtgtactctgaatctgcagttgtgtgtactgtgtgtctgctacagtgcaccacctaccgggtgtgtgtgtgtgtgtgtgtgtgtgtgtgtgtgtgtgtgtgtgtgtgtgtgtgtgtgtgtgtgtggtgtgtgtgtgtggtgtgtgtgtgtggtgtgtgtgtgtggtgtgt

SEQ ID NO: 35122 - DNA, 1275 bp, Mus musculus
tttctcagctggtaagaggaactgtagttgaggacttgtcttcatatgtgcctgtggacatgtccgatgggcattttctaggttgatcattaatgtgagagggtacaacatactgttggcagtggcaaccctgggcaagtggtcctgggttgtatgaggaccagattcttgcccttggtgatgactggagcctgtaaaagaaaatcgccttttccttcctgggttgctcttggtcagggttttatcatagcataagaatcaagctagcacagtgatgaactaaatatcagctcttaacacatttgcatgagatttctacttccaatgtacattttcttctgccctagtttcccagaccaaagtgttgacagtgtgattagctttggtcagaacccatgaattcaatctagggatgagtaagcacagactctttgattatgattctaactgtaacaaggcaggggtgacgccttcttacacttctgccctagcgatgacctcacggatgaagacaatgatgatatgcagctgcaagcgcagcgagcattcaccaccaggcggcagatatcggaggatgtggatggccctgacaaccgggagtcccctgaggtatgaacccttccttctcttgttcccgtgtccggcacatgttatgcagtggatgagtgtggactctgctcttttcagaattgggaaatcgtacgagaagatgaaaacaccgagtatagtggtcaggctgtccagtcacctccatcgggtcacattgatgtgcagactcaccttgcagaagagtttaataccagacttgctgtgtgtggaaatccagccaccagccagccggttaccagctcagtaagatgatttagatcttgtcatgaatttgtgataccttgtcatacattgatgtaacagcgtatgttttatgtagacttttgtcttcagtgacatgccatagtaacatgttgggggctttcacttacccttccactaactccgtggagcagagcgtggatagttctaatggaccctgtgttctcgggtccttcacccactgccaccagaaacacggaagccacaagctgtggttcttggtcgtttcacacaaagaatcatggactggcagtgagagggtgccagcgaggacggtggatttgattccttggggaattttaaaagaggttgggggagacaggagactactctagatgttgtcaggaagtggaaagaattgtgtttgaataactcagatctcctcctgtgaggacacaactcgat

SEQ ID NO: 35123 - DNA, 1164 bp, Mus musculus
aagagatggggggccgaggctcaggagagtgtcttatctgtcttagaaaaggattctttccagtcctgtgctgagttcacctgactctgaagaccactggcctagtcatcatgacagtagatcgtaggggtcaagaagggactcccctgttatcttgttccggtgtccataccctggcttgtctggcctccttttagaccacagcatgtgcaagcaaaagccgaatctcactacagtcctggagctcacttggtagatcaggctggcctcagactcacagatccaccttcctctgccgcccagcaccaagtgaattgctatgttttaaaaatatgttttaaaatatgatttaaaatgtggttcattgttctaaattttaaaacaagagttgtttcagagcaccagcagtgaagaaaggcaggaggcttctgtcagaaattcctcctggttaacactgaggggtttttttgtgtctgtgcatattagcttttgcctacttcatctggattgccaccaggttgggaagaaaaacaagatgacagaggaagatcatactatgtagaccacaactctaaaaccaccacatggtccaagcccaccatgcaggtactctgaactcttagcttgtctttggtaagctcagacctcacacttctagagcaagagcagagtgatgacctgctccttcagtgattgtgttgtttagttttggcatgcatgcctctgtgtgtgtgtgtgtgtgtgtgtgtgtgtgcgtgtgcgtgtgtgtgtgcgtgtgtgtgtgtgcgcgcacgcgtgtgtgtgtgtgtgtgtgtgtgtgcgtgcgcacatgtatgtgtatgtacaagtgggtatgtacacgtgtggggttgtgtggggggtgcgtatgaaagactcatgtggaagcctagagttgacactgtgaattcctcaattgctcttcatgttattatgtatttagtcagggactttggctgaatttggagttttctctaggatttggtctctagctctcaggcagtgggaccatagactggccgccatgcctgagtggctttctgtgtgtgtgctgtcgatctgtactgtgctctttacactaatgacaagcattgtatccactgagccagctccctgggcacttcttcagatagtttgctaagctaa

SEQ ID NO: 35124 - DNA, 1192 bp, Mus musculus
acaagggtttcacagagagactcgatctcaagttaaaaaaaaaaaaaaaccacaagctttttaaaataagggagcttgggcctggttgtgcacacctttaatcccagcactcaggaggcagaggcaggcggatttctgagttcgaagccagcctggtctacaaagtgagttccaggacagtcagggctatacagagaaaccctgtctcaaaaaaaaaaaaaaaaaaaaagaaatcataccacttccacactggatatggggatgcataacaataagtccagactgggtgggttgggagtgggctttgagggtttctaggctacccggagcaagtgaatggcaatcctggatgacaaaaatggaccctgtttcttaaagcagggtggggaaagaaagttcagtacacctaagtggggttgtcctggtggccttacttaaagggaaagggtatcggtgcctggtgaagtgtgggaaacacactgggctattttaaacatgtctctctccctggctctgcagactgacattccaaacaaatttgaaatgaagcttcgccgcgcaaacattctggaggattcttaccggaggattatgggtgtgaagagagctgacttgctcaaggccagactctggattgagtttgatggtgaaaagggccttgactatggaggggttgccagagagtggttcttcctcatctcgaaggaaatgttcaacccttactacggcctgtttgaatattctgctacgtaagttcctgctgcctcagcctcctcatttgctaagactcagccacacgtccttacactgttcataaatactttaaatggctgtgcactaaattatagtctccaaaactaggttacatgttagaaagcatgggctacgtgatcggggccacaaggagatatttcagaaatagctttttaaagattgttttataggacctgaaaattgtatataatgtacatagaaattaccattttaaccttgtgtgtgtgttgtggattgcacgtggtaggcaggccgtcctccacagaatgcccacctcacagacctctgtaagcacacacttggctggcgtttcaagtgcttcctgtattgttgatctctgtacctttcccatcctcctgaataattctacattcattaaacacttttcccaccatatacaggcagccaccagtctgct

SEQ ID NO: 35125 - DNA, 1122 bp, Mus musculus
atctcagttctcttaggacaagcacaccctagttctccccgattctgctcagcttttgccttgggcccagctccagtctctctgtttctttttttttttggtttttcgatacagggtttctctgtatagtcttggctgtcctggaactcactttgtataccaggctggcctcaaactcagaaatccgcctgcctctgcctcccgagtgctgggattaaaggcatgcgccaccatgcccggctgtctgtttcttttttgttgttgtttttttcaagacagggtttctctgtgtagccctggctgtcctggaaatcactttgtataccaggctggccttgaactcagaaatctgcctgcctctgcctcccaagtgctgggattaaaggcgtgcaccaccatgcccggccagtctgtctgtttctaagtggtataaacatgtcctaaaattgtttcttggtttgtattgggggggaaatggaaagaaatgttttgttttgtttttcctccttttagccttgtaatacaatggcgatttgtgaaccgtatccagaagcaaatggcagcttttaaagaggtaggtacacagcactcttgctcaccatacccagacttccaagacccacacatctgagagggtaagatgtggtgggctctgtaaagtctttctcaatatgtttctagtttgattttatgtttttaaaataatatacatatgcactcatggagatcagtaaagaaccccctggagtgtacaagttgggtcccaattctttcttctagtcccatgctcccagaaataagactcagacccaagtcttacaagtaccctggccatatagctaggttcttctctgactaggatcataacttatagataacacatttatttcaatctttattctgccatgtagctggttacctctgctcaggtgctatatgtcagtctcactatatattcctgggcaaatcttcctgctctgactgtcttcaagaattcttagaatcttagtgggaagtggttagggaggctcaaagcgggattaagctggggactagaggaactcagagaaaaagccatgagcaagcagctgtgccagtgagaacgagagtcttcagtcctcc

SEQ ID NO: 35126 - DNA, 1058 bp, Mus musculus
aaatacaaagtgtttaccagaccgttacagtgctgaccttggctgtgtctgcagcagggcaggtggcagtgtggtggaggggcagttggcgtacaaatgactgaatttagctttgcacactctgtgtacttgtctgtgaaaggaagaagtgagaggtgactttgtgcaggcttcagtgggtgaaggagaggagcagggagctgaggacactgcagaagcctctgaggccttgctgaggggtcttccctcctgcagtgggcgtggccagggtggggggaggaattttgtctgactcagtctcctcagtactgtgaacaagggagggagagggacaaaggaggctgttaccagccactttaagaaataaagaacagccatattgaaatgcagtgtgtagcggcaaagtctgtagaagtgaacgcgctcccctttaccagacgctggagcatagctgtgcctgctcactagcttccgacgcgtttcctttccttctagggattttttgaactgataccacaggatctcatcaagatatttgatgaaaatgagctagaggtaagaactatttctgcatgtgcttgggaatgtagttaatgagcgctgcaggccatgagttcagtccttagcaccactggtgtggggtagaggggatggccatttgtggaagggatgagggaggggcttccttagcgtgtgaagccctgggccccgtcctcagacaccgtagaacgggtgtggtggtgcacacctgttacccagctctttggaggtggaagcaagaagaccaatagttcttgtcatccagagctacactgtttgaagctaacctgggctacagggaccctgtctttaaaaagagaactggagggctgacaagatggctcagtgggaaaagtagaccgccaagcctgacagcctgaatttggctcctggagtggacatggacccccaatgagttgtcctctaactttctcactcagaacatgacatacacatgctgatgttgccatacatacatacatacatacatacatacagtttgatagatagatagatag

SEQ ID NO: 35127 - DNA, 2803 bp, Mus musculus
gtgggactatggttaccatggtgacatttcctccctctctgtcactctaaccagatcctctcaatcttttcagcttcaatcgcctggacctgccaccctacgaatcctttgacgaactctgggataaacttcagatggcaattgagaacacacagggctttgatggcgttgattagattacaaaaaaaaacaagctgtggtgtcttgtacaccatagtttctaagcaaaagcaaaaacaaaatcacattttaacattttccagatagtttctaaaagatggtcactggctcttcccaccgagaccagaggacagtttatccatgatttagccaccaccatgctgacctgttcacttgtccagttactttgtccagttgttggggttcatgtgtacggcaggatgtgagtcctgtacgcctgagttctgaccctatctcatcttgctaggcacatccttctgaaactactgagattccaactgtgaaatatctgtaatgagtagctggtgggaaaaatttgatgctttttaaagatgaaatttggacaaagaaagtctttaatgattagtatactgcgacatacttagtaccacatgtcgctacttattctgtagacctgcctagtgtaccttatcgcctagaaccttgaagccgctttggaagatgtatcacacgtgtttttagtcacttaagtcactagtgtttaaaaaaaaaatgtactcttcacttgggaagtatttcacgtttgttagcatgcagcttgagccttacaggcgattctggagacaagtggagcaagcttttattgcagtgtgtagtgagtcttaggcctcctttttgcctgtgcatcctaaggctagagtcattatgtgttagtgcgttagaattccttcaaacacgaaacaagctccacaacgcagtgtttctaagcatgccgtgaagaaccgagttccatgtatgacttgcccttaccagccactcttcacgcttgcagtcacgtagtacatacgtgtttacggagttcattatgtttacagattaagcgaatttctgtagttgcatttttatatttttagtatcacgttagtataaaaatttgtttaaaataaccaaagagtagttcaatgcataatttgtatgaatttgttaccaagtttcttatgctttctaaaaaaatactgtttcctatgaaaattatgtttaatcaaaagtcaagaacccttggggcaaaatgctacaggtggagtcccaccatagtcacctttgaggcacaggaagaggttccatgcatgaatctgcacacatgagcagtgctggctgctgtgcaccgggcccttgggatgaagccatcagcactgacatccagccccgtcttcatcctcaggcttagaaacaagtgggatggtgactttacagtcagtgggaagtaagagcccgcagaataacaaaggcagaaggacaggaaagcgaggtccgagtccgactgcgaggtcatatctgccaaggctccttctagtcagcttacactggtgattatacggaaaatgctcttagatatgagaaaagcaatgtggcatgtaatgagttagtgtaagcttgtgttataaactttccgaatgcttataagtagcctgtgggagctgtaagaaatacttggggccattgatttaagcttgttggctctaacatgactaatacctgtcagcccatggtagggatttcagtgacagtagtggaaacgctttccacagaccacaccactatgttgatcggtgaaagacacccccaggccagtgcatgcttccagagtgtcctgatcagtcagccaggcatggccaccgtccagtgttgatttttatcattagccagctgagcctgcagcacggggctcatttccccgtctggcagatgtggatagctgggcccactcattctgtctctcaaggctatggtaagttcttaaaggggtacttttctgcaagccaccagagtctgagtcagctgtcccctcccagtaagcatgttcacctaaagtgatttagcctaggcgaggaggatccctactacgtgctggattatgtgtgtgttcatgtaaggatttcagcgtcaaaagttcacttcctccatagtggcaaaataacactaatatgggctggtgtgttatctggagtgcccccattgtgtggaactaagggtgaaaacagaactgtacacggttgttcagtgtcgtccccagaactcatccccagcagggcttagaaaacacgagcttccttcctccttcacactcattttcctttggatgattcagtgacatcacagaacctggtgtccccctccctaccccaggtgtgtagtaatggtccgaagggaccctggctggaacaccacagccccccatgctagtgcatgaaaacatctcgttcatattctaccactggggcattgtggagtcacattcacgaaacacgaagaccttgtacttctctagaaaagtgttttagcctactttttctctaatccccaccccaacaaatgaaacacaaaattgcattacaaaagcaaacccaaatggtatttgttttcgattttatttataccgctcgagttattccttatacgtatcaagttaaactcaattggttttaatgataagctatttgacattgtttttaaattttttcttatatggtaaatgtatatccagattaaggtatcgaaatttattgcataaactataaaatcattttcaaaatctcaattccacaaataaagttctattctgattttaaaaacaaagctg

SEQ ID NO: 35128 - DNA, 1144 bp, Mus musculus
ttgaacctagacttcactgttaagggctggtgtatctggctagcttgctctgtggatttcacctctgccttcttagcactgaaattacagatgtgacaccatgcccacctggcagtgatgtggattctaggaatctgacctctggtcttcaggattgatcagcaagcactttacctattgaatcatcaccccagtccatacctccctgtactttccttaaatgatactgcgcactctcgtgtgtgtgtgtgtgtgtgtgtgtgtgtgtatgtgtgtgtgtgtgctcacatgtgtgtgtgcatgctagggcgtgttcaagaaggtcagaggacaactttgtggagcaggttttccccttcccccttccatgggtttcagggtggaacttgggtcatctggggtttgagtgattgtgtgcactgagccataggcccctccctgtgattttctcacttcctccacttagttttattgagtcgtgtgctttttcttgtccccaagtctttccttaaattttagttaagacaaactttgtcatggagtcaggttccatgggctagtggtcctgggttctataagaaagcaggctgagcaaaccaggggaagcaagccagtaagcagcaccctccatggcctctgcatcagcccctgcctccatgttcttgctctgtttgagttcctgtcctgccttcctctagtaatgaacagcaatgtagacatgtaagccaaataaaccctttcctccccaacttgattttggtcatagtgtttcactgaagcagtagaaaccctaattaaacaggaacatacatgcatttctggccagcaggataaattttgtttaatgtatgcttttgtttatggtattaaagagacaattttcattttagcatcttatgctccttcagataattattatatatgcattacgttatttcttgtatgtaatctaaagatagatgatagatagatccctatgtagactatatataacgatatagaataaatgggtgaatggatagattcattggtcaatagatgagtatattttagtgaagacagaactgaaagaaattgtatgctaggccatgttttgtgtgtttgttgtgtatcttttaaatgcttctagtgtctgttatgagct

SEQ ID NO: 35129 - DNA, 1155 bp, Mus musculus
atcagcagcacgccccccacctcgaatcccctcgctggtggcgattctgatggggatgctgcaccgaagaagcacggagaccctgcgcagcccttgccagctgagcagacctcagctccgcagacatctgcggggctgcgatatgctgccgagggttttccggtctagacagccacgctcagggattcacaacaagcacctgttcgaaggacaatgagcagggagccaaagccttttgtgaaaatcttgatgtcttactgtttattgtttgttttgtttgtttgttttttatctttttttttaaactatttttaagcttacgaattttgaatgtttcaactgtcaacaatgtgaaaaagggcagtcaagatgcttgactggactctaagataaatcactggagcggagggaagactgcctaagccctctgctgaatagctacctcagtttgctgtgggcagactctgaagacaactgtgctgccttcttcgagtgctggtttctctcagtggcataaccagcgggacttgctagtgacgctgtgtgtccattgtgtgtgtgctgtgtgtgactgaaggagtccgataggtaggagaggaaagatgttgatctgaagctctgattttttttttttttttttaaagaaccgtgataatgtaacacctctggctgtgaggagaaaatatgggagtatatttatttgaatggaagaaacaaatacgtctctttggagaagagaacattccatagtacataggggatcgtgtccttgcaaagctgttgggtttgggacaccagagcaggagaattttgctccagcctgcatcagcctgccctcagcctgcaaaaccacctttccctttgctccacagccggccaagggctgcgctgtcttgtggaacgttttcaaagtttacagagctagctgcaaaatacaatgtaggaaagtggattttttttttaatggttcagattttcttttttaaaatctcagtttggcttcaaatggggcaaagaagaaatgttattaaatattaagaatgaagataaacgaaacagtagagattaagacagacttgaggttttcataatagcagtgccttccattgtgagaaattttgccttatacctttttaatattcacgaagatgttta

SEQ ID NO: 35130 - DNA, 3129 bp, Mus musculus
ggacatttctggaagaacgtgctctgtttaatgataaataggcccttagttatgataggtctttagcttataattatttactagttcattttttgttcttatacagacttttctgtcaattctgttaccaaagaattttcagtagacagtaaaatttctatgataagtaccttaaatccaattcactagaaacagatatagactcgaatataaacaatttctaaccctaatctgaagggtttatattgatagttaaaattaattaggctagtgacataaactaccttaccgtcaccagagtttaaaataaattttaatttccttgccagcatatggttacaaactctttaaactgtaaggttttttttttctccagcaagtaacgaaaccttcaactctatagtattaatgtattttctaattgttgaaattacttgttggagagaaaaaaataaatattactactaatgtcatggactaaagtatttaatgttcaacagaggttttaggcttggtgaaagccagcctctctgaagtctgaagtacgaaattccaactaaagtgtgaaggttatcatgtcttcctcgaggtttcattattcatcgtattcaactccaaataagctgacatgcaaattagaaactgtttcattttccaaaaacgtatttgctggaagcggtgataacctggctgcctgtcattttttaatgtcaaatattacaatatactgctcatcggtattttcataccaaagaccattaaaatatatagtttagcctgtaagtaaagatgagcaggtttaaagtaaatttatttagaaacagatagggaatatagctttagtggcaaaaagaaaatatcaaaaggctaagtttacatagttaaaagcaatacagttatattggtatttatcagtgttttttattcgagtactttatatcagcaaattaaaaagaaattaaaaaccaaagatatttaaggttacctcagaatataggaaagtttagctgtacattgaactgttgtttgttgttttgtgttaacaaactgtctctccagaacctctcctctgtgcagacagcgtcctgaggatttatttccatggtgtctgctcactcagtctcaggtgtgtttttactacatggtgtgctgcttccatacagcctgtgagggtgataggtcggcagagagagcatcaggcttgtctgtattgtgggaacccctacatcattctaagtcgtctgcattcctatgtaaagtccttctctagatactcagacagcttgaggaaaccaaaaggtgccactgttcggacgggcagtgctttgggttcaaatacggttcctaaatcataagattttcattgcgtcgaaaagctggctttcgatctcaagtgaaaccctgttaaagtgccagggggtgagatgctcctgatgtgtttgttagaagctctcttgcctttacctcagacacgagcaatggcagcaatgcagcagagactggggtacgcactgctgtctctcttctgcaggacttctgcaaacagcataaaaaaggctcatagctgaccagtcaggagcaccgcttaagtccccgccattggaaacagtgcttcctgtcatcgaaggctggggtggttcactcctgtcatcaattgcagcagtcggaggaagggggcagcatgcattttaggaagtcagagcctgctgtaattcatggttcgattctgtacatttgcatatcatcagatgtccattttgaataccagatgtggaaaaagagtttgaactgtattgtaaagagctggtacctgaagcaaccatgtattttgcaagattttcttcctgaaaatttactacatgcatcactgataaaattgctttggtagaagtaaaaaaaaaaaaaaaaaaaaaaaaaaaaaaatcactcctgggctgtgtgagcacagagtggtgggttctggagaccaccacccatatctgtctgtctaattgtgaattttgttgacatttagaaggcaaccataggttttatgccaggttgtccatgctcaggacacaagttcacaggctatcgccatgcttctgttacaggcttatctagcagacgggtactgaattcattttcttgcaatttttctaacaaaccagcacgaacttagtgtctgtaaacagcaccgcacagtgttgaaggtctgtaggtcagaactctttctttttgaggcagtttcctgctgtaaaaccctctctgtcctggaacctgctgtatgtataaaccaggctggctttgaaccagtggggaccctgctgcctcagcctatctttaaaaaacaaaactgcttttcaatgggtttttcttatttgccctgtcctgtagtatctggtccattcccaaactaaaacccttcctgcagataagcctgaacacagatgtgcctctgcctcttagtagggcttaggagatatattaagaaaatgtgtctgtcagttactgttgttggacaaaagtttatgtctgtatgtgtaggaattttttttctatttcaaagatgtgaatttaatgaagtgtgggagccagttaagttattttctgtagtgggtgttctgggtcctgccactctctgcttccttgtaagggcaccatttcctggcttcctggtggactgtggagctgggttacattcgatttctgcttgtctcaggggaccagctctgcaggctccatctcatgaagaaagtgaatgtttgccttgattttgaatgtatttttaaaaatgtcttcttaaaacatattttttgtttaataatgtgggtttgttttcttttcctagcatgatagtaaatattgcttagtaccccacatccctaccctacccctggaagtttatattctaccctacaggtcatgccaaaaatgaataaaagtttaaatgccaaaatgtttattgaaactgctgtctacatattgattgattgcacagtttaaataaaacctttccttagttttaaaaaaacaaaaacaaaaaaccaaagacatgcgtttttcttctttggatgctagagaataaaaaacttggttgggggtggggcacccttgatccaagcactggggaggcagaggaagatagat

SEQ ID NO: 35131 - DNA, 2318 bp, Mus musculus
ttattctgtaactgtaaatgtctgtttacttttgagagtcaagttccatctttatgaataaatgcagtgtgcctataaaataatgagactgctttctgatgtctttagttcctgaagcggatgctttaatgagcaatgttggaggctgctttaaggaagcgtggataacttcttgctgttcaagagttaggtgtgcagagagaggcatgaaggtgtagtgacctcaggttgtctagagatggttagaaaatcttcatgattgaagtgaccttgcatctaaacttgctatgaaactagcttctgggagagaagtgagggttggtgcgtggatagagcagggcctccctggaacggaaggtcctttgcagaggttggagagatggagacctactttacagaaaccaggtgagctggcgtgatcaggaaggtctcccttttgccctcaagtgcctgtcttgtgagatggagaatttctgaaggatcttgtcacggggtgggatggtgcctagtcctctagatgactggcagcagccaagagggttgattggcaaggtgtgaagccagctgtggtggtctgcacatgagaaactgatgggagtttgaatgaggtcatcagaggtggtgaggagcagacaagatacattgtcaacaagtcacatagccagacacttctaccttgtgtaagggaagtagaaagtaagtggtgtaggttcacctggaatgacttcactgttggatgctgagattactcagaactccagaaggaagctctaagcaagaggaaccagaagcaacttgattttggaggtatctgttgacatttatttggagaggacgggttggtaggtacatggccatttctactcacttcgaagccagtccccattggtctagtgcaggggacaatgctatctgtgctggttagagagaaggctaagcgagaagagtgcagagtgatgcacgtgaacccagagatgtcaagtcaggtgcttagagctgagcgctgcagagcgcttgtgtgcaggtcctggcgtaaggcagtggaggagccagcaggcagagtgggaagacagcagtgcctgctcactgcacttgcctggaacgggggaaggttggagactgctctgcgagctgtgtctcttctctcattgagggataaagccgatggagacgaggctggttgttcttatgcttcctggagtgataacggaaacgcctcattattttatggttacattcctgctcctcgtcacctgtcaggcctccccttccggccagtgcgggagtattgatgtctgccctttttccttcagtgttgaaataatacccctttttcctggaattagagtaggatgttattttctgttttatctttttgcagtgttcaggtagataagtggggaaaaacattgttctttttacttttagaaaactgaactctaacatagattaaaaaaatgtgtttactactttcagtcgacctgataaaaagcaacgtatggtaactattgaaaacgccaggcaccgaaaacaagagcagaagcaccttcatccacagccttatgaaagggaaggtaaatggcaaaaatacggtcgcgctaacggaagacacacggcaaatcttgagctagaactggggcagttacctttcgatcctaagtactgatttgtgattaagttaggaagttaagagctgtggatgctatctacttggtttgatgttgagatgaactccccatgactgtctttatattatgcaaaagcaaagcttactaacttgcattttcctgtagcttaggtttgttaaaaacaaaaactttttttcctgctgggggggggtgggggaaatggtagttttattaaggaagccaggcatgaaatagtctgtgcatgaaacagggcttggtttgaggagctgagctcagctcacacaggcatttcgtgccgtgtggaggtgtgcagcagggcctgaggactgtgctgaggcgggactccgcgctaacatctctactctcacgcttttgtctctctgtgggttcaagagcccgttggtttgtgaagagctggctggcttgtcttgtgaactctcttgcacacctgaatgctatggaagaaacaataaactgcaccgtgaggaaaactaaaggtctctctcaagtctggcgccgtatttgtgttctctgagaatgcctcaggacagtgtatgggacagctgtccccagtggcttcctctcatttcacggtcacctacagtttctctcagttatgccaacgtctctgcagaagtccttacagttcagttccctcctgtgttgacc

SEQ ID NO: 35132 - DNA, 1958 bp, Mus musculus
gtgggtgaagtagggatcagtcagattgtctgctgttagccgaggggtcatgaagactcttgtgtctatccatggtctgttgggttcagtgcacctctgaacatcgctcatgcttctacagtatgtatgtttgcatgtatgtatgtatggtctcttcatatgtacgtatgtttggtctggcacctcaggatctgctttcacttgtctggagactgccaatctgacttttcccatcaagttttggtggtggtggtgtttcccagtttgttttctcccccccccccttcccccattaatgtaactgaaggaatctctttttaattaaacggcgtgtttatttgctatctggagggagggagttcactgtctgtatttaagcagtcacatttgtgggccagtttaagagaagtgttttgtagcctgtagctttcactgggaatgtggggcactgatgttttttgatagtggaaaacatactttgcatggtagtttcaagtggctttttttttttttttttgagacagggtcttttcatatagtttctagctggcccaaaactccctttgtagactaggctggcctcaaactcacagagatccacctgtctcagcaccctaagcactggggattaaaggtgtagttgtcacacctggctctcagaagacttttaaaaaattgcacatctatcatttattgccattgtcctttgacccctcctcagaaaaaaatagccatggccactaagcttttactgtttttgaaataagggactctttgaaacaccaaactcatcattgaggcctatacatctgaatcctatatacccaggacatgaggcccatcatagccgtgccttccagcgttgttctaagacttcagtggagcatactgcttgtttggcacatttcttaatgtctctcttgtaaatacatcaagtcaatatgccagacaggtattggtggttcgttcttttcatctcccatacttgagaagcagaggcaggcgatgagtttgaagctaggcttcactatagagtgagtttcaggacagccaaagatacatagtgaagtcctgtttcaaaaaacaaacacacactaggcagtggaggcccatgcctttcatcccagcactcaggaggcagaggcaggtggatttctgagttcgaggccagcctggtctacagagtgagttccaggacagccaagactacacataaaaaagtgaatgtttgcacagtggcatagtgcgggttttgagaagtgagatgccgctcctgttggctccacaccaggcacggggcttaatgtgtgtgatagttgcccaacacaagagctgccttgaattgttgaaacaaaacaaaactgagttctctgaaaatggtttaaatttgataaaaaaaaaaaaataaccgtactttttgtcactgtatttttctatttacaaatctgtataaaaaatgctctttagtgaactttgtgccaattaaaccataataataataaaaaaaaataataaaagaggtccagtatatcaagttctggtgaatatttcaaactaggaattgtgatgccaaaggaacccgaattcaggaatgcagagtccacgagatgcttgctgaggaccctggccaaaacagcatccagggaagatagctcgagatagattttttttttttggtcaattttatttcatgtatatgaatgtttgcctgtgtgtctgtgtcctttgtgtgcatgtccttggagaccagaaaaggccattggattttttgggactagaatcacagacagttgtcagctgccatgtagttgctgggaattggacataggtcctctagaagagcagccagtgcttttaacatctcttcacccccaattcaaaatgttttatccaatatttattgagtacctttgagagttggtgaactaggtagtctgatggagcaaaacaaaaatggt

SEQ ID NO: 35133 - DNA, 1111 bp, Mus musculus
agctctgaggtcagtctttgagttcactgatcttgagtttgcataggcttcctgcggtgaaacgggtacactatggcctctctgaagaggtttcagacgctcgtgcccctggatcacaaacaaggtaccttatttgaaattattggagagcccaagttgcccaagtggttccatgtcgaatgcctggaagatccaaaaagactgtacgtggaacctcggctactggaaatcatgtttggtaagtgaactggaaaggccaaggtaaccttttcctgatccctgtatacaccttgactgcagatgttcttctgtattgaaaagcctcttcagtggctgtggccctaagaaatagaagccacctcactcccaggttccccctgctccttgtccaggtaaggatggagagcacatcccacatcttgaatctatgttgcacaccctgatacatgtgaacgtgtggggccctgaaaggcgagctgagatttggatattcggaccgccgcctttccgaagggacgttgaccggatgctcactgatctggctcactattgccgcatgaaactgatggaaagtaagtaagggatgggacgggagtgggtagggctatcctgtccagcaagtcttggctccttgggagggctccaccttgggaaagtgggttttggagatgttctggaaggccagaagactgtgtttaggaacccttagctcctactccttcaggttacagggtggttgtccttatcagcctccttacactgctttcttccaactcagtagaggctctggaggctggagttgagcgtcgtcgtatggcggcccataaggctgccacccagcctgctcccgtgaaggtccgcgaggctgcccctcggcccgcttccgtgaaggtccctgagacggccacccagcctgctcccgtgaaggtccgcgaggctgcccctcagcccgctccggtgcaggaggtccgcgaggctgcccctcagcaggcttccgtgcaggaggaggtccgcgaggctgccaccgagcaggctcccgtgcaggaggtccgcgaggctgccaccgagcaggctcccgtgcaggaggtcagcgaggctgccaccgagcagg

SEQ ID NO: 35134 - DNA, 1798 bp, Mus musculus
gcaatggtgcatttgtagaatgctttgtgcattcccaagacctgggtgagtttggctagtattcctaactttttagtaatggctgctactgcggggcagtcgggatgcgttgtagaatactggactcagttctgcagagtcatgcacgagttcctgtgttttacatttttctcctatttaaatttgagtttacttttgagaatctcacacatgagcactgtatttacattgcatcttctgcatcttttaaaggcaaaggaaagcagctggaggaaaaaatggtccagcagttacaggaggatgtggacatggaggaagcttcctaacggtgctgcccgcaaccagccctgagcacgctggagtggagtggagactttcggcccctaagttattcattggttccataaggtccttcagacaagggtgattcaatgtgcttcccccttcaacgttgcagcctgtaaaagcatccccttgtgggtgttaggtctcagctcagcactctgcttcactgtgttatgcgcacgcaaacaggaaagtttgtgtgtagatgaagacatgaactgtgggcataaaatggttgagccagttgtcttcctgtgtgaaatccgaatgatgtactattttccgtgcgttgggatagtctgtttattagggttattgagatggaggtcacgcaaggaactgactgttctcatgtctacctgactttttttttgttttggtctagtatgtttagtaatttctgacagttgcataatggcagcacacaacacagcacagcttagttttgttgggccgtctgacctgcttcagccattcagcctgcagctgtgatgttggaggtgggctgggttgttaaactttgcctgaatgtccaggttgtgacatctgtccggaaagattctcctttccttcctgcccagcattgatctagaagcagaagaagaatcttggtgcctttcaaagattagggtgtggtttgttttctctccctcttcctctccctctcttccttttttttttcttttccttttcctcttttcctcttttcctttttttttttttttttttggagacatgatctctttgtgtagttctggctgtcctgaaactcactctgtgggtcagtctgcttggcactcacaaagatcccttgcctcctgagttacgggattaaaggcgtgcaccatcgtatccagtattttttttaaaaaccttaaaaagacaactaaaaagaaactcttgcttttggaaagtagaatttatggatagaatgctaactgttatttgtacataaataaagccctttctaaagtgcatgcctacatatctcttatttaaaagtcctgaacaaaagtacatgtctgtttcttagacgagagcttctacacacattgtaagtaggaggtatagttaaagggaaatatgtgtttcatacttcttggtagtttttatattatgattacattaagaatgttgagcttagccaggtggtggtggtatgcctttaattccagccctggggaggcagaggctggaggaggtctgagtttgaggcttcctgttctacaagtcgagttccaggacagctggggctactcagtgaaaccctgtggggtgtgtgtggggggtgggatggtggagaacatctagagctggagccagagttacacaataggaaccttgtctcgaaacccctcccccattttaagcgtgtatattgtcttatagggcatttagactatacatttttaggattatatttgtacaaagtaatgcttaatcttgtttttct

SEQ ID NO: 35135 - DNA, 1121 bp, Mus musculus
tccgagtgccccacccctctccaggtgctggcatttataccatctgaaaagttcccagaattccaaatgtcatcacacacagtcacaggaactctctgtagctggaaaaaccatgcccctgctagagcacgaggcaaatcatagtcagctgctgtgaagcttgcttttaccccacactgttggggaaccttctgagctccgtgcaaaatgggagactcccttcttagtggggcttccctgttctgctgctggagagtttgtgtctggggaaagtgcaccatcactgcctggcctttcactcttgatgagtaagttgaagtgtcaaggcttctagagatggagagttgtaagcataagaaagcaaacacgaataggtcagaaatgtctgctagaaactacctcaaatgctcttttgtgttctattttaaaagatttattttatatatgtatatctgtacaccaccttctgtgccagaagagggtgctgggacccctggaactagagtatagactggtggactgccatgtgggtgctgggattgaaactgggtgttctgtaggaacagcaagtgcttttaacggaaggtatcgggtgtttctgattgccattactaacgtgactaaggacactggtctgtgaggagagagcatttttcatgacatgttgtgcttttgtttgttttactgtgagtgtgtttttaaactggtagtgttgggcaccaagctttccaccttgctaacttgggcgcctgctgctttgctttgagagcagtcagtttggagaaatcgaacagaagaactgaaatgtagtcagtgaagaacatttcacataaagtacttctttcaaaaaaatttatttttgcatttgtttaaagattttttttttgcctgcatatatgcctgtgtgccacacgcacgtagtacccacagaagacagaagaggacatcagctccctggaactggggattcagacaaaccctccatctgctgggtaggcagccagtgctctaactactgagccaactctcccaggtcccctagaaaaagtgatctggtaagtattggcacgtagctttgagctctgtcctcgacagcacaggggtgtggccgggcgtgtagc

SEQ ID NO: 35136 - DNA, 1194 bp, Mus musculus
cttcttgctcacattgttctaatctcttcttgatgcttccttcatcctcagacaaaacctgcttgtccgagtctttgtgtgtctaaatcctacatgcttttttctgtaatcagaattatgtttgtttgcatgtatcagaataataaaattagtagtttaaacaaaatagaagttagtaacttttctctcttggcaaaaaaagcacaaatgaaagctagccgagggttgggagaatggctctaagttttccagtatttatgtcctttgttgctgctccaccattcttagcacctcacttcttaatgtaatatggctgctccagtttcagacatcataagctcattaaaccatggggggaaattggtgttctctccctcatgagaggctttttaaatcttacctctgatacttatctcttagtggttgtttgtttttgttttaatgtgtatggttttttgtttacatatatatctgtgaacatgtgtactcgtggtgccctggaaggccagaagagtgcatcagatcccctgttacagacagctgtgagccaccatgtgggtgctgggagttgaatccaggacctctggaccagccattgcttttaaacacccagccatctctccagtcccacaactgtttctatataacaatatttaacagtaggtataaattttttccccagagttttaaaaattgtagttaatcatagtattttctggagctactttgttatactttctggtaggctaaatagtgttctctatttctatccagacagatttctctttctttgatttgctcagcaaggtctcttatcccagcctggccttaaattcaatgtgtagtccaggatgagtttggactgtgagtattatcctactgcacctacctcctgaatatggcttccttcagtcataccccatctgtactagggttgaaacccagggcctagtgcatggtgggtggtgctctgccactgagttacatctccagccctgccagcttgttagatttgctcctgtttgttgtgtaagggttgtactttatgacttatttcccgcacctgttagctctcctgcaccaaatattctgaggctgatgataaacctacctttatagagatttttgattttatggaaacagttgaaggacgttgtgtttattctggagacttttagttaccgtcattgcatg

SEQ ID NO: 35137 - DNA, 1194 bp, Mus musculus
gaacagttgtttccagtgagctactgaaaatgcatttttaaagaaaaagtactgattatctctaaaggaagatgttaactggaaatccacccctccccccagaatcctttcgattgaccaacctggaggacacccctcgtactgttacctttaaacaacatttattctttatcagttggaaacctgagtttacatacagctgaaaggtggcagggaggagtgaaaggaaggataaaggggtgtgtcttcagctgactgcttttagtttaaatctttagtgctgcatttaagtggcatacaaaatacaatcccatatgtatgaactgttgtgaacaaggcacaaagaactgaagaaaatcactgaatacatatcatagcagctttggagccaatcatgttgatattgtcaaactggatcacaaaaataaactggcaacattaaagtaactggccaagtaacttccttctctgtgtccctacggcatagcgatgtgaaagctgctgtttgctaggccgtgtagatgcccgtttgcactgtagcttactgagcatcttaagtggctgctgtgtgctgtctcctgacctaagtgaaagtcttactaggactataaactacgcttctctttcatcagctctgtttacaagtcaaccagatcagttctaaccggattatatacagttatccacaggttcatcagcgcgagtagcagacgctggggaagtagagttagacagagtggctgttgatgtcattgctgatcgggattattacattgataagtcatctgtgtggatatcacatcatggtatagagttgtgtaaagttacttggttttagttcccaaatctgattcttgccatgcatatattcaaccttgacaagttttctttttaatttattaggtgttagtttcagtcactatctggaaaggactgtcagaatatttatgactaagatcttgaaactgtttatcctataagttattcaaaataggcatataaataaatcattataattcagggggcttaggtgttgcaacctctataaatgttctcagataccactggatactttaaaaatatcatattataaacacattaagaagacgtatgtaagaagtataggagattattaaactttatagaggatttggatcagtgagatccaggttcagtatgtcttcattatgaaat

SEQ ID NO: 35138 - DNA, 1120 bp, Mus musculus
aggctatgagaatacttcaggcctcagtatcttgtttatggtgagaaaatttttctgacaattgtaggaaaagaggaactgctgccatcctgagaattccacatggaatcagtctctctctctctccctctctctctccctctctctctctctctctctcacacacacacacacacacacacacacacacacacagtcaccagtagagagttcttcaggaggcgtggtcaagggtcctctgggtaacatcaacctgttaggatgaagagcaaatgtccgtgtgtgacgctgcatggtcctgttgaaagtagtgcagaaatagtatccataacgcatgtgcttcacgccagcaactcttcctctgttacctcacttcctcacagcgtccacaggaggcagctcccacaatcagcggggatgataagttgggacagtgctatggtcagtgactcactgggggtgacactgccctttagcagtaagggcagaagctgacctgtctctcctgatgctgtagggtgctctgggctactaagggtgctcttcatctttattggcatgtgggaagagacaaacgatgagcaccgacttactccttgggaggccagtgcactgtgcttacagcaccagctatgactaggcttgcctttgctggtgagccagtactccttgacagggtgtgcactctcaagttagaggctatctgaactagaagggcaggaagcagtgaaaacctcagatgtgaagaggcaaggcaggccactctccacaaccctgaggtttccctgggaagagcccctggctgaactacacagcctgcagagagctctctagtcttagtctgaggcacctagggacctaggacactaagtccctccctccccagggctgtctgccattggtgagtcagagtaagcttggaagtgccacagcatgctgtaggggaggagctaggagctgtgctgtgggcatgcatgcttgaggccacaagcattctgtggtaagtgctttgtagtttgttctcaggctgtgctgtgagggccgccttaacccttgccccttcccttttagagctgccttaagttcgccagaacttgtcctcagtgaggggtatcttgcc

SEQ ID NO: 35139 - DNA, 1364 bp, Mus musculus
acatatctgaaaacagctaacatttccttggcattgtgatattgtttggaatagttggggaaattttaggtttgttttttgaaggttgaaattaccgtgtataatttaatgcttggaaagtgaatacagccccgtgcattttccagagtcagtagtttcaaataacttattgttactatgtgtaataaaatcttagcctctctaagtcatgtgagacatttttcccacaaaaggtgatttctcctttaaatgtggatatgtgttgtggttgtgatttatgatccacaattatgttcttttgttggttcctgaaataacaataattttcttgtgtttttggaaagttccagttgttgcagcagtattgtacagatgggctcatggcatttaacatactgtggttttatcttaactctttagcacttattgtgaaatgcacctgcctttgaaatacagtaaatgggacgttgcagttttcgaatctttttcttccttggatctggagaaagaattttcttgacctacacagttcatctctgcacagtggttagttgaggaagcagaagtgatgaaaggtgagaggtacagccaagcctctctggaattaaactgagcccattctagagccgcacgggaggtcttctagaaggctaataattcacctcatagcaacaaaagccttggaaacatgagtttttcactgggtattacctaatgctaaaaggaaagccaaaacaatatcagaatgacattttatgctctaaatttatagctgtctaatgtgcttagtgtgtatctgtcattagtgctgtattctcctagctattgtagaaaattgttgaaataaagataaggatataaagaaacgttgtctttgtctataaacccacttcacattttaaaacaacaaaacaaattgttactttggagattaattgttataagtataatctcaggtcttagaaattgtgttagagaacagcaatatgaaaactgcaaacacttaagcaaaagcagatcagccagacagctgagcgatgtggccacttgcatatcctgggagtctctggcagaaaaacagagcctaggaactcaagacttccaaaagtttaaacaagatttgtgtccaaagttcagcttttaatgcagtaggagaagagacaaacatgcagaataggataaaagtcaaggagcgtgcgtgtgacatcctgcggccgaggaaggaacaatctgattgacatagtctcatctgtagccataatatggaaccataagtattactttctaccatagactgtcccactcacatcaggaagagttcattcatcagactcatttatcaaggagtttcctttccagggcac

SEQ ID NO: 35140 - DNA, 1147 bp, Mus musculus
gggtcccctgcatgccaggcaagcactctaccaactgagcaacaccctcagccccagatactagttgagctttccagcagccaaggaaaaggaaatactccctgtaacccccccccaaccccccccccccgcccagcagtattcttatctaggagaggaactgtgaagaactaagtccacttcacacccctgtgccatgaaacctcagttttacacccctgtcccacaaaaagcccactccaaactcttgtcccgtgacaagctcccttcacacacctgttccatgaaatctcacttcacacccctatcccaaaaaagctcacttcacactcctgtcccaagaaaagcctgcttcacgcccctgccccaactcctggcactgcaactggagagtcttagaagcctctaggtgctgtctagcaatgccttgacttggggaatgtttactttccaggattcaagaaagattttcaaatggatgtttttaagatcctagctgccatcctgcacctgggcaatgtgcaggtcaccacggtgggcaacgagaggtcttcagtcagtgtaagattcatgttcgctttgcgcttcctgggtgtgaaggtcagtggggcacagctcatggctcactggccaccacggttgagaccagccatgcttggacctgctagacagactggtttagcaggaacgaggaagaaagctttccaggggttgtcttattcccttgtcacagtacatgtgtgccatgagtgtgtgtgtgcatgagtgtgtgcatgagtgtgtgtgtgtgtgcgtgtgcgcgcgcgtatgtgcacacacgtgtgtgttgggggctctgctatatgttcttttattcaacaacatctatggagcctatcatgtgccagggatagctgtaagctctgtgaaacatcatcagaccaaacaggaagtcctgacctcacaggaggtggggtctggagaaagtaggaagtttacctaccataggctgagggtaggcagtgggtctcactcctctccacagctctcctgctctccagggtaccaggtgggctggggtctacttcttgccctcctccaactcaaaactgcccctccctccacccgtgtccaggccttgcagactttgccggtcctcagatgactg

SEQ ID NO: 35141 - DNA, 1261 bp, Mus musculus
gccttgactacagagtgagaacccatctcagagatagatagatagatagatagatagatagatagatagatagatagatagatagataaatagataaatataaataaataagagcattttatttatctattttatgccatttatcttttttctgaaatttttaaaacttgttattagccaacatagttattataatctttcatttaatttttaaatacagctatttcttttaaaactacatttatctctggggtcagaactcagtggtagagcagttggccctgggtttggccccagcaccacacatgcacacgtgtgcaacttaagtttttttttcctctttctaatcagtgttctaatatgctttttaaattttttttcacgaaaaaaaaaaaaaaaaacaacaacagaagatatggggaagctcttccttttgagaaatccacttttcccaggttttgtgagaactagttattccttccctcaaactgttttccttcccttcagagaactgagtcctctgatgagcactcctgacccagagctgagacccatcactctgtgcacccctagcaacctgaccaccctccagtctgatggtcacaggcagtagctgtgacaccacagaatggtcctctctggggcgaccggttgattgttcagtaccacctactaaacgtgtagtcatcctactgacatgatggctttccaaactgttcccaagtgctgaaaatagaactttataatacttaaataaaataaattattgagcaaattggatgcaccatttttttcctaccattgtagattacatgccttctcaccgcacagctctgtgtctctccttgagggtcagacagaaaggtgttagaattccacaagtcacagtctgtcacctgaggtatggaaaccctgctgactgtgtctggggccccctggccccctggcaggatggggttggctgagtttctgctccgtgtccactccagtcctccttcaccctgtgaggagtcactatgctaaggttctggttttctggcttgaattcatgcccactttatagcatttacctgggtcgtgcaccagtaaccttggccatcctgtaagttcctagagggctggactccatcgtattctacattttatctgtaatgctaggtggtgggatagaattggccagatcccatggcgatgacaagggttcgagtgtaggagaccttgtttggagacaggagacttgaggatagcaataagttgatac

SEQ ID NO: 35142 - DNA, 2050 bp, Mus musculus
agccagtggaggaagggaagcgtggggagagaggccgtgaggcagggcttctgagcggcggtggggagttcctcctgagcaagcagctggagtccataggcaccccgcagttccacagcccagtggggtccccactcaagtccatccaggccaccttgacaccttccgctatgaaatcttcccctcaaatccctcacaagacatacagcagcattctgaaacatctgaactaaacctcagcagacatttctctttgttcttcatgaaatgcgttgtgtctttttttatcactaatgttttaagtctttttttttttacttgaatcagaaggtgtcattaatttgcaaggatttttcttggttctcagtttgtaaaacagacttttttttctacatgtgagttagttttcatttgaactggcatgtcgtttgcacacacacacatacatacacacacgcacacacacgcaaagaatagagcaaaacaatgcagtgcaggaggagacaagatgcgctaggatgattagacattctcatagaccagtgacctgctttacgggaaacaaaaccttgccttgaaacttacacagtgagactgtacataattgcatgaaaagatctatttttttcctgaaacatttttcattcattagtattttcaagtttttcatactgtacacatttcttaagacacatgataccagcagcaactgaaaacgaatgccgaatttggtacacatgtgttatctacctcaaggtaacaaaagtatgtggcgaagcctaacccacccatagtgctccacggcatatgcacttctatctagccagcgtttatcgtagtgaactattgagactcgtccaccatttatacatgtcctggtgttcattctttatagtgaagtgttaaatacatcacatcttatttatttttagcaaatcagtatattttctgtatttaattataaaagttaacttagttttaagtttatttgcaactgcccttctttccatttggcactatggtttgttgcctgccgagctgatccgagacgtcagctcgtcctgaggctgtccatgtacgttaagtaaagtgctcactgtgtataggaatctgtattttggaggtgcttgatctatctacaaagaaaaaattaggaatttattataaaatgctcctagaagtcttaatggtgtttattttttaaaaacttgtaatgttagacttgtgtgcatggaagtaattaaggtacatcactattgtagtttaaacattgtacatgataagccttccccctccccaccccctgtttttactgtatgtttttattgaatgatctattccccatccctaggcaagcatgaataaaattaggttaaatgtagcatgtcactgctcagtcttttagagtttgttttgtctgttttattttgctgaatcctgtctgtatctttggttatcctctttgaaggaaaaagaaaaataaagatggccagcaggcacggctcctgtttgactctttagaaggaaagttcccaccgggtatgtccagtgatggtgtactctgtgcgcacacacacacacacacaccccgggatgctctggttgtgccccagcatgtatagcagatatgctgagtcaagagcttactcatccctagtgcaagtaagggtgctctgtctgtcgaagccttcatacagtcaaatgggataaacctttatgcacttcaaagctgttaaaacctggggaagctttgaaacttgcagagaaacctctatctcttcctcagtagatcacctggaggctgggcctggcccagcattcaacaggtggcagggggatcaggagtggaaggccaacctggcctccatgagcacagctgtaaaaaaaaaaaaaaaaaaaaaaacatggagggaagccaagggtttctttcttcctgggaaacttgctcctgaaatcatttaataatgtcaacttagcatcaggagtagctggactttcattaaagattagacattttaaagccgtctaaggaggaggacagataactact

SEQ ID NO: 35143 - DNA, 2278 bp, Mus musculus
gtgctcgggtttctggccagctgttgtgtaagcaccggtgtcagaaggtgtatagctcttgctcaggagccacttgattttcaagtaaatgacagtgacaggtgaccaagcattctaataacagtcaacatgagtgagaaatcctcaattcgttttgatgaaattttatctgtattatacagaagtttgttacaagcatgttaacattttataaccaaatatggatgagtaaccgactttctcccccacagtgcgcaagaggcgaattgaaggagaccaccagtaagcgcagtgacctttggaagcctgcagatcaccagaggctcgtgttggtggcagcagatgtaaaaattacctgggtagaagggaaagactggaaatcttttttaactatatgcattattttcctagcttattatatttgatttgtaaaatcagtactaggtagtattttgtatttgtagcatttctactgagaccagtttaatttagcttaattgaatggtttatgatgatttttaggtaaaaatgcagttgtggaaagtttcagaagtcgtgtatgtaagaataatttgaatgaacatcttgaggaccaatattttttaaatcaaaagggacattgctgactcaatattaatgttgctccttatacattaagggtaaggtgcatggtggtttccttttttaaaaatccatgaatttaggcaaaagtatgctttttccttattagggaaataaaatgtcggaattttgaaaggtggctcagaatccattatatctacataagccaaagtaggcctgcaggggacacaacagccatctgtgtgcaggtttctgcacacatctaatgagtctcagctgcacggggctgggtgtgtatgtctcctatagtccttagctctgtcccactgcataccttgttaaacgtatagttataagtatttttctctgctgtgggcattacagttttgtaaaagctaatggataaaaagcatccgagtagagaggttcttttccccataaaaggctcttggccaatactcagttattgagagtaaaacagaaaaaagaaaggcgctgttagatgtaggagagttcaaacctgaaatttgcaaggtggccatctcacggatgagcagtgtccgtcaggaactgacgtgagctagctatggtgggtcactcctacagtctgagcagctgagaaggtaggattgccagacattcaaagtcagtctgaactacataggaacctccaggttagcctgggctacatatgtgagaacctatgtcaggaaaaggaaagaacaaacttgttgtctgatgaggagcgctatatgtgattccataggtgcaatgtagtactgcctaaacagttaatcccctccaccgtgttccagccaatcacaaagactgctgttcttcagaaacctcattttagtagatgtttccttcatcttgttttttttttaactgcatataataaaaagtaatttctgtatcataggttatctctatcaccttagcgttagttagaatgagggtttgatctgtacagtggggttgggtgaggctgcccaccgatgccctgctagaggactttcgtctgtatctatgctctgccccatgcagctcctacaggagtggcagaggcacacacagcagacagtggagaggaagaaggcccagggaagcacgaacaagtcgacggttgcttaaaccatgccagtgctggcctgtgaagtattatacaactgaagaaaagacttcatcagtaacgagagtgtgaagtcatctgattgaatagatatcttttaagaattataatggagaacagtgtttaccttgatctttacaagtctggcacctcattttggtagcagtatttttaaattcctctgagatttttatgacatggtaataaattaggactttgtaatagttttaattttaagctagagatttttctaaaccttcaagttttatgcatgattatctaagagaatattcttcacatttttaaattgcccttttaaaaagccttaaattgcccattttgtaaaactatatattcatatttgtctcaaattataattttcagtatgtctacatgaaattgtatacattaaattcaccattagtagctaatattcatgccttgaaaatagatttggtgctctacacttacagccaaaacctactataagtaggtttaaagaatacataaaatacattttcctacggtgcctgtcatttcaaagaccaaataaacattttgtgt

SEQ ID NO: 35144 - DNA, 1903 bp, Mus musculus
gaaagctctctggggctgcagctacctatcaccagcgactcagccctcgtcagttctttattttggccaagaaaagcattggagcctggcctcacagggatggtgtctcatcagtccttgtatccatggtaccatctaataaggtgccttgtacatagtagatgcttaattaatgttgcttgtacagcattgtcctccagccctacaagaattatactctgtttacaaccatgtgagatatacagacacacacacacacacacacacacacacacacacacacttaatcatactgctttggatgccagctgtatgtgaccttgggcaaggttttccatctatcttatgttcttttcatctataaaacagtgtattctctaaagtcccttctagatcccaaacattacaagcctgtgattctgaacacgggtgggtaatgtacccacaccagctccagctctctccaggagccggcagctgtctgttccttttcagcagcgtttgataacttcagagtagctgtagaggagcagcctcatcagaaacgctgcttcagggctggaaaggtagctcagtggtagaacgttgcctggcatgtgggttcagttctcagcactacaaaattaaacaaacaaacaaacaaactttaaaagtcctgggatgcttccctcaaaagcagaaaggatatttttaacatatctaatatttttctccttagaatcagagggaaagaaggggaagaaatacaaagaaaggaaagtgaccaggatggggttttttttgtaggcttgtatttcatgtctgtgtatttgcatgatttcattccagaagacaatcaaaggtgcactgtgtgttgcaagaaactggcccaggatttaaatttctgtggacaccatctagatgtgggtaggcagaaattggccaagcagagaaaggcgatggataaaaagtacacttcctgagtaattttactttagtaccaaatgtcagccgtgacaatctttatttaaattattctaagccaggtatggtagtgtccacatgtaatcccagcacttgggaggtgcaggagcagtgtcagaagttcaaggtcatcttctgaagcatagcaagttcaagaccagcctgggatacaagagacttagtcttaaattttgaaataaatatataagtaaaagtaatttgtatctctgctactttctttttaagaccaaaactatgtacatggaaaagcatatttatattttaagtaagcctttatcttaatcgtgtttcatgttttttcagaaaacaagcaacatttttcattgcacataaacatgtaaaattcttgcatgccactggtcataatggcttaccagttctctgcctgtcaagtgtgactttatgtgtattgttacctatattgtgttggagagactaagggacataatattcttgtaaacttgtcagcattgttggtaacattgtttatgtgagcagatgctgaagagccacagggctttatttttcatttgatattttttgagcaaagctaggtgattggttaattcactaggaatctaaagactaacttgccttttaaatttgaagttgaacatcttgtgaaaagtaactgtgagataaaaaaatgtatagagtgtaaactaattttatcctcataataaggaaacccattgtcccacccccacccccccaaaaaaagggtgcgatttttgggccctttggaattagcacccagagctaatgttaagctaaatagaaactgttttaattaaccaagattttcctgctttcaaagatgttatgtgttcacttgtgtctggaatgatagttgtaaattaaaatgtaaaaaggggggtggagtcaataaacttaactttaaatgtaaacgcctggttcc

SEQ ID NO: 35145 - DNA, 5134 bp, Mus musculus
gctggagagctggctcagcagttaagagtgcttgctgctttcccagaagaccagagttcagcttcagcacctgtgtcaagcagctaacttgtatagctccatcctcgggggactctgatgcctccagcctctgagggcatccacacataggtatacataccccctatatacatacacatgattaaaaatagatttaaaagttatggtaccttaatcaaagtttctgatacataatgaatttgacaaattttaaaagcaattgttgattcatctttagcataaccagatcaccagctaaattgtgggcattgtggttaattatataggttttttgggggttttttggtttttttgttttttgttttttgttttgtttttttgtcacatgcaattgcttctttgccttttggcttaaaatcaagcattgatttttgtcatatatcacagtaaatccagctatttgcaaacattaggttaaaaggaattgtcagttgctaagatgtttgtcacctcgaagacagagcctgtgaagacatgactgaagtgaccatgaagtgactgatttcctagtacaacaactggacagcataatgcaaatttaaggtaccaagtgatggaatgttttggcccaaaataatcacttttctctcctgtcatagacatcagccactgtcaggtacctgtgttagctgcccttctcactgctgtgactaaatacctgacaaaaggaatataaggaaaagggggattcatcttggctcacagttttaggttgccaccaactgtggcagagaaggatagcagcaggaggatgagacagttgtcacatcactgtcacagacaggaagcaaagagagatgaatgctggggctccgcccactttcctttcccccctttttatttagtctggagttccagcctatgggatggtgctccccacattcagggtgagttctctcttcttggttaaacttctctggtaacaccgtaggtgattccaaatcccatcaagttgacaatgaagatcctgtctagcatctcttgtccttccttttcctctcctttcatgacaaagcatccttcttgtttcccttctctctatgtcgctaagtcagtggttctcaacctgtgggtcacaatccctttggaggttgaataactctttcatggaggtcacttaagattattggaaaacacagatatttacattacaactcaaaacagtagtaaaattacagtcatgaagtagcaatgagataaatgtatggttgggggtcaccacaacatgaggaactgtattaaaagcagtaagaaggttgagaaccactgctctaagtcctataaaggtgatgggaaactatcagacaagaaagaacttggagtcaggaaccttgggaaaaaaaactggacacttagagggagaaactgaacacttactgtgctataaataaccacagctaaagcaaaaattctcagacacacctcattttcttggctcatttttatactcttcaggacataataaatagggtattctgacattttttgagtcacccccaagtgctttaacttaatactttatctccctgtcaatctaaaaatgtatttgttttgttttatcccttaatctgatctttccttccttctcacccacttgggtgtggtattgaagccagtttgtataggtttgctggtttgttcagttttcaagaattctttaaattcttgctcaaaattgccctgctaaaaattaaggtgtggtagcatgccctagtgatcctagcacttggagtggacgcaagatcagtgttggctacacagaaagtctgaagccagcctgctacctgagacccctccctcaacttgaacatgaagtggcttgtacttacagtgaaatcgatgatagtaaaggcaaaactatgctcttgagattctttacgtctgttgtgcctgtatggcatacagaccgctgtgctatagcacaggtcgcccctgctctgccagcattaacttcttggccatggtgagaagagtccttgggaattatcaatgtgtaagaaaatggctccattctttcctctagattgttggctgataagcagtcatccattctacctgggtgaaatgtatagggtgtattttaatcagaatttttggttactctgttgccaaaggaaggatgctaagtgtctttcctctctctcagccacagacttctttaagagcagagtccctaacaagcttccttttcctgttttcattcactctcttgcctccattcctaagaagccctggccctgcaaattattgtctgcagccccatattgtagagagtgggttacaattgttgacacaccctggcaaaaagcaagaaaaaaagtcatatttagatcatagatattcctttttataaggagttattaatactaataagattgtagaacattatttttaaattcatactggttttatcttataaaatgagtttataagattattactaatcagctgttttatcatcgtggatttttaactagcatgtaaagtgacatttccatcagcatttatattttgaagggaactactagaagataaaatatacatcttagggcatctatcaaatccatttaattagatgaagacttcacctcccacctgcccaaaatggaccattaatttcatcccgatgagacataatgtgtgtgaattatttttataagtatctgttttgctagctagtgtgttgatgtattttctaatgcctgtatagctgtttggagggagctcgtgtttgcctaagcctgctcccttcccctttacagttgtacaggtccataagtgaaaactcactcacctggacttgacttgaaggtttctgtggctgatgtcttgtcatgacacctgtaaatggatggcttttaggagattatttgtcaagtttagagatgctaactagtccagcagtacaaatgcatctctctgtctgcttgatgtgggcagcagaatttccttcatctttatcagcatgatcaaatcccttgatttctctctctctctctttctctctgtctctctgtctctctgtctctctgtctctctctctcgtgtttgtgttgtgtgtgtgctcgtgtgcgagtgtgtttgtcagatatctaagtaggtatttggctacatctggacaactgattgaaggggaggctctctccccagttccacttcccctccccctttagagcagctgcagacccgggttcatgggaaatgaccctggagtctgcagtttctgtcacctaccatcacatttcacagttgtgtagagatgactcttgaggaaatcactggattattccccatcagatcttcctctatacctaacgtgagactcatttcatacttaggagcatcaattagcgcccttcttccatctctgtaggacacactgtatatagacattttgtacataatgatcaccaaatactgttgtgaggtatttggctgcatgtggaccatgagttgacgggaccatgcttcccttgcccctcccagggttgttgggggcccaggttagagaatcacatgcctggaggggcaggtgctgctcacccatctttctgcacacagctcatctttcagtagaagttcattcccatgttaaagctcaaaaaatatcacagtgcctgtactcttggcaccagttttctcaaaggaagactggtataccaaaccatgaacagctgcttctcttccatgtggagatgtggcccctggtgggcactagcactatggaagccactgccttctgaaaaactgccacaagacatttctcatgagcaaagcgtagacttggtgtgaaagcgtcagcaggctctcgtgctcagacagtcgtggagagccggtaaaagtgtttgaacagacgtcctttttcattgctgaaaagtattctgctctctcctcgatactttgaaggaggcaagaaacataagaattctggactgagaagtctacacgtgtcttagggttggggtgacagaatgcctttttggaaggtagctacgggggttggggggtgtaatgacttacttctcagttcccatgccctgctactctgttctcacttaaaagactgaaagacacctaaaggaaaggtataaaaacgtggtaaatgtcagggtgatcccactgggtaaatcacagagcagccttgtggaactagctggccagagaatagagcccagaacctcagttttcattctttccttgttcccccagttctagatctgacttgacgcagtgactcaagatccttacacaggggatgggctggggacttaatatttaaattagcttaatgcagagctcagttctgctcactcctaactgcttgtccttcagcctgacagcaacaactgaaccatcagtagatatgtgcgcaaagggttccaaattttatgtccgtatcctgggttctgttctagaaacagtacttgaattggaggtcaggcctatctaggacacactgttggcttggagagggtgaaagagagggcatgaagtcatgggcagaaaagaggaaccagctaaccaggcttagttggctgggtcttgtggcagtcattcggagcgtgctggctcagctggttggtatggtgaacaggtgacataccaacagatttggaggcttaatcccaatcccattaccaacacttagcaggtgtacgatcatgggcaattcatttaattgcctgccaattatagactatatgggggaccaacaccggaaatggaatcaagtgacctaaacacttgactccacactctcttagctgggtgactttgggggagccacttgctctccccagcctaaagccccccagctattaaaggggaacaatatcttcactaactacctcacagaattgtagtgagaaaatagaatcgtatgactggatgaaaacagcatagaaactagaaagcactgcacagaagtagatggctttagtcagctcgctaatgtttcccagagtctgttttattctgaccaatggttcatcttttggagtaggacaagaagcatgggtacggtgtaagggactagaattattatactttacatagagatgagaggtggatgaca

SEQ ID NO: 35146 - DNA, 1103 bp, Mus musculus
cttttgtctggtttctgtgcatcttagctactaggctagtatgtgtatacttatgaatctgtgatatccaaaagaggccattattttttctgttctctcccatgtgacacacgttcttctggaattgcttgcttctgctaaacacatacttagtgtgatgtagacttctgttcaaatgctttcgaacctgtgatttgtctaaagcggattgtgctacttttaactttattatcctttcctattaaagtataaatcagattgtccttacttttataaaggcttctgatctttttattttattttttaaaatgttattcattttatgtgcaggggtgttttgcctgcatgtatgtctgtgtaccacatgtgtgcctggtgcctgtggaggtcagaagagggcaaatccctgggactggagtcaaagtctgttgtgagccatcaccacatgggtgctgagaataaaaacctggtccagggtagagcaaccagtgctcttaactgctaaagtgtcttgccagccccaacttctgattctaatgtaaattcagatgtaaagaattaggtacttaatctctggtcataattagtctataatgtgatttctcaacttcaacactatttttaatacattttaaaaattttttagtgttttgaagccagggtctcatgtagtctaggttggccttgaactccccatgtaggtaaggatgaccttgaagtgcagatctttctgctttcacctgctggagtaaggtgtgcattccgtgtgacattctgttcatacagatggaaagattccgtgtttcaggaggctgtcctgagcattgtagggtatttcacagtacccagctcttcccaccagacacgaacccttctattcttgtctgcacatggctggatgttcttctaaaggcaacatcacgcctgttttttgtttcttccttatttgtttttggcctttcaagacaggatttctcttagccttgactgtcctggaactcactttgaagaccaggctagcctccaactcacagaggttcacctgcctctgtctccagagtgctgggactaaaggtgtgcgtgtgtcaccactgcctggctcc

SEQ ID NO: 35147 - DNA, 1127 bp, Mus musculus
tggtgacgaatgagtttaaaagccctgctacagcttccagtacgtcagtgacaacccgcgcgcgcacacacacacacacacacacacacacaaacacacacacaaagcacagcatatgcacatgtatgcatgcacatgcacacatgcatgaacatccagttgctattgcttgccttagtgagacttaatagactcttaagactccatagttcacagccaactatgagatcctctgactatttccttcaatgggaaattgagtaatgcctacactgatagatgtggcaggcatttccttccctgtgctgccagtaagaaaggctgaagtatgtgagtgctgaacttcaagaaccatagcaagaatgtgtgcagctaatacatacttgctgccatggtatgcttaatattggatgcaactatagttgtgtatttagacaataaaaggcaatcataggtcaaaatttacatttttttttcaatagagcatgacagttctttgaccctggaaagttttactgactgaatggcaacctcagctattcttcacatatggaaaagaacagggcatctacccagcccagctaggactcttgaatactttgaaaagaccctcagtctgaagataggaaatattttaacggtagtcatgtttccaagtctgtctctctgcacagttatcctcttttacaaaagcttatgatatggcaaatagatttcaatcttattccctacaacgttaaagaatttcctaatatgtaaatatgtctaatcactcaaatgttgacagaatgaagcattcttaagaggctgtagttactcagcactgtgggattcagaaatggtatggaaaggaatatgtttttttttttttttcttgaaaacagccttgctttctttactcattgctgcaaaactggaacagaaaggaaaacaaaaacagttgctaactggaagtgcgccacagagattctaagcccttccttggcatggcctggaaggcagttgcatattgagtacagatggtttttattaactaggtatatagagaagtattacagctatttttgtacttcgaaagatggatattcaatgacatggatattgttttatgagtagtagataactta

SEQ ID NO: 35148 - DNA, 1706 bp, Mus musculus
caggtcatgctgatctcatttttagaggcacatgttcactggtcactaaatatctacttctaaaatgcctatttcttttcttcaggagaactaatgactgttgccaggtggatgagagagttcattgcaaaccatcctgactacaagcaagacagtgtaataactgatgaaatcaactatagcctcatttggaagtgcaaccaaattgcagatgagctgtgtgaatgtccagagttacttggatcaggatttagaaaagcgaagtacagtggaggtaaaagcgacccttcagcctagccttcagccagcagagagagagagggtgatcgctgtttaggatggcgtgtgcagccctgactcctggcccgctgggacgctgggaagaccaagatgacctgcagtgtttctgcgccagttgcctgcaagtggctactagaagctcccttcagtaggtaaatctgagtttgtacatgtatatactaaagtatttttatgattaacagtgtattttaataacattgtatctaaagtcatagtgaactggcttgtacattttgaattcttactctggagcaactactgtctaagcagttttgtaaatgtaattgtacaataataccggcattccagagtttcaaatgtttactgtaaatcttcctttaatactacctgggacctgattcactgaaatttacttaaaaaaaaaaaaaaggctttctcacacctgtttcttgagtctcctcttactatgtaggtaaagtcactggactgcattgatgccctccgtgggtgaggcaccttacctgtgatatttcctttgcaaagcagccccactctcttgccactgaattctgctagctcttgaaaagaaactactttaggaattgtctaaatatacagactcagagaatatttcatctgaaaaggaaaatcacttccttctacatacactgagagctttgtcaaatggtgtccgctcttccattaccacctgctgtctgacccctgtgctgatgaataatcaactcagtgcagcagccacggtttcctgcccttctctagtttgcaggagcagattgacaggctgtcttctaacagccattcatttcattccagactttccccagggagtagtctccacccgcttgctttctctataaaactcacaaatcaatcatgaaatgcactaatttttgtgaatcaggaccctaaatgtttaattgtaaataatttgtttcatagattgcttttagctttgtgttatctttttaattgttaactaaatttacttctaaaataactactgtagattaagccaagctttacagatataaatatttacactgtaatggtaattttgaaagattgcaataaagccgcttcatcttaaagctttcaatactagaattggctctatatctcatttacttcagaaagtatttttttctacagttctcttatgtaaattaggttgtaaaaagaataaaatgtttgtggtctgagaaaataaaaaatgggattcctattcaaaggtagtacgtgtatgagtggctttcgggggtttggattggggggacttttgtttcaggttttgtttttatttctaactatgtcacctgggtactggtttgtcctcactatgtaaatcagcctggtcttgaactcatagagaccctcctgcctctattcacttagtactgttaaac

SEQ ID NO: 35149 - DNA, 1193 bp, Mus musculus
tcctaggcccttgcagtgctctaacccctaagggcacctgcatgggcagcccttcgtcagaaggcacaggaggcaagcgcagttcatgtccatcccattctgggaggttggtgacagcataaatgctttgttgactgtaactaagcagagctttagaggaagtgaacagggactaatgacccttgtggtcagggcttaagaggggaactttctatttcttacctttagatagtctgaacataaggcttgtctgtttgaacaatggcgctggtggagcatctcaggcagaacgcttgcttaaggttgcccaaggccccaattctgttctcagtactgcgaaaacaaaaagtgcagacacaggactctgctggtctaagaagccagtgttgagaagcctcctgactggcctagggaagcccgagttgctgtcctgatgtggacttggccccagtgggttttctctacatggtgtgaggtctgcgaggtgtatgctgcactgggtaggaaaggcacccaggttccataaggagcatcctctatgccctgagaatggacgtgtcagtcgttagtggtttgaggacacgaggtcattctgctctgttagagctggtgcgctgggctggtgtttcagccggaggcacctgctgccccttctgttctcttgggatccctccggcttctccgcactgaatcttccttctaggtgagcatagtcactaggtttgtctgacacgactgagacgacttgaaagtacctttgttcctaaaataaaaccactagtcatatgacggcttatatattagcaaggaatctgataataaaaccatcgtgaccttgggccacaatctgtagaagagatgaatacataaatactattattatgtttgctttttaaaaactacaacattgcaaaccggctttgaaaaatagcctgcacgttttggttctgggagccctgcagtcacctccacacactggaagtagttataagatacagatgtttggtcgaactttaacaaagaagtgtgttttcatattgcttgcttaaggttacacgggctcgaatggaaaccttttaagtcattttctgctgagggattgtataattctgttatgcctctcctctcttttaattttaacttggactataatacagcctttgtacgctttgtacaaattagcttagagaaca

SEQ ID NO: 35150 - DNA, 1204 bp, Mus musculus
agtctgatcatggccgagccaatagtggtccattctttttactcactggcctctattgctggctccccagtcagacccagtgtccctcacctggctgaagggcacactgcttgtgcctgcacgtgccgggcactcactgagctggaaggcttttgaatgcaaactaccatctcttaagttttccaattccacattaattcagtaagcataataaacttagtgggtagtttgactttctattttctttcagattctttgaaagcatgtttatattattttacttagcgtaaacacaagtaataaattattctaaacctgtatcaaaagagctttgctttatttgatgtatatttgtatgtggtttgcttttattgtattgcccagactaaaggcaacatgagtgtcaggtggctttggaagtggtctcccttatgtgttgacgactaaatgttttccttctgttggttttcagatacaagagtcaaaggatggttcctcctggacaattacatccctacgtttgtctgttctgttatttacttactcattgtatggctgggaccaaaatacatgaagaaccggcagccgttctcttgccgaggcatcctgcagttgtataaccttggactcaccctgctgtctctctacatgttctatgaggtaggtcagtggctctagggcttccttccacggagctgtgctgctgtggccgcctgaggtgtgtccctacgtgaagaaaggcatctgtttcactcgggagaaagagggacagcgagtccgttaatgcattttaagtaggttttgaagtggatctttataaaccagatgtctgtacagatgtcccctggaatacctcaaaggagaagctttggttgctgagtttttgtcgctcgtgttttgtgtggcacactgagaactaagctaaatagcttcaaaaacattcttattcgcgtaacagataggctggaaaacaaaggaaggttgaagagcggatctgggtacattttattattaataaatgcttgcttctcgtgtggaggaggaagtgggtgggacagtgggaaattctgtggcaattcagcttttgttttgatctggtaacttgtcagatctcacaagttctgtttttaaagtgtcgctgtccatattcattgcgcatggcactcttgtgtgggacactgtgttgtgtataagctgattttag

SEQ ID NO: 35151 - DNA, 2411 bp, Mus musculus
ctcaaaaagtcgcaagggtgattgaacataaagtggttatttgagcacaggaaatacgtggtgagactgatcagaccaggaaaccaggcctagtgagatacagaccggtacagttcatctggttagcaggcactgattcgccttgtacatttcagacttacaacaagaaaggggcctctcggaggaaagaccacctgaagggccaccagaacgggtctgtggccgccgtcaacggacacaccaacagcttcccttccctggaaaacagcgtgaagcccaggaagcagcgaaaggattgacaagccgagccgaagcctccagaccgcggcgtgtgattgtaagcacagcgtgacttgtgccctgacgctcatagcagctgctgtcactagtctggccctactatctgcagtgtgactcatgtaggaccttcttcatcagttcaaaacccctagaatatgtatacagattatacaaagtaggcatacgattttctcacatttctgggctctcatcgacccccgcgctagactgtggaaagggaatgttcttgtagtatacaacactgctgttgccttattagttgtaacacgataggtgctgaattgtggttcacaatttaaaacactgtaatccaaactttttttttttaactgtagaccatgcatgtgattgtaaatttgtacaatgttgttaacagtagaaaaacacacatgccttaagacttaaaaaagcagggcccagagcttgttagtttaattagggtatgtttcaactttgtattattcatttgtattagctctgtttagaaaaatcaaatgtatgatttatgaaacaagtgtgtgatgtgtaacttcaagtgacttggagatgcgaaatctgatggcacccttggttttataacgatggctttaaataagcaggttcaagtctagtggaacagtcagtttaactttttaacagatcttatttttttattttgagtgccactattaatgtgtttaaagaggtggggaaagggtccaaagcgtctggagacacttacgtacctgtccctggtcccccagaggctagggtgactataagagtaggtcacttttcacttctgaagtgcttagtgtttttatacaggagataaaaaggccattcgacttcccaccacttggagagagagaactacctttcaggaaaggtgacgagacatttattatctgacagacacacacacacacacacacagtgataagggactggttacctgggtccacatttttttttattcttttctgtagtgctactttgacatacacttccttttaaaatgtgcctaatttaccaagagaccaggaagcaccataagcattttgaggtaaaatttaagagctggagcgcgcaggaactgggtgtttgggagcaaccgcttttttcagtgtgaatcatggtggcatctgtaatttttttctgattagcacctaaagatcggtttaaagtgcttggactgcttatcctaaaatcgtgtctagtgcgctcgaggcatcggtcatacaaatggggactcttttcatgtgtgtcatttttaaagtgttgaaagcttagcctttgaataccttctgcattggtaaaaaatccatggaaccactcatggcacatcttaggagatgattgacaatgtataaactaattgtgggtttgatatttatgtaaataccagtttaccatgctttaattttgcacattcatattacaaggagccagttggtcctaattagccttgtgggttttctgtttggaaggagttgcggcatctgtttacatttcccttgtcagatctagaatgtgtgtatgtgtgtgtcttctccctaggtacccgtctgcaggtgtctttacatatctcaatacaaaaattataacatttgatagtgtgctgtcaaagtgtgcttagctcatctggatatacccacactgttaaataatgtctaaacattaatcattaaaacctttttgattacccgtgctgtgtcttctgttgtttgatgtgctgacagttctgaaagactgcaggatggtcaactctgtcaccttgtaggagcttagggagtggacatgagtaatgtagcgtggaaagtggttgtatcagttgggggctctctagagaaacagaactcatagaatgagtgtgggggtggggggaggatttattagaatggcttacaggttgtggtccagctagtccaacaaggctatctacagacagaggatccaaggatccagtagctgtttagtccacgaggctaaatgtctcagctgctcttcaggaaacacgggttccagagcagtcgcgtcgaatgccagcgaaggatttgcttgagtggactcactagcaagagtgagaacaagcaggcaaagagaagagg

SEQ ID NO: 35152 - DNA, 1240 bp, Mus musculus
acttatttttttcactaactcataaactcaccacaaataaactaattaaatcccaacacatgagcctaaaaatcctaagtctttggataatgaccaaaatgttttcatttggaaaacttggtatggactttgcaacaaggcagggtccacactagcacagcttttaaaagtaataagaaagatggctttttagattgtctttctaagtcagttttgaaggtgctgtgggaccagtgtttaagctgtctgtttcaatgatctgacgcactcaatctactccctccctctcggtttcagcatcgaagagaacgaggacgccagcaagatggccgatctcctgtcgtacttccagcagcagctcacgttgcaggagtctgtgctcaaactctgtcagcctgagcttgagaccagtcagactcacatatcaggtgtggctccttggctgttgtcactcagaaacccttggacctcggggtgaagtcaggcgattggtgacctagatggtggtgatctagttatgatagaaacagctggcgatgtaagcctgtgctattcagaatctgaaacaacagaccagggcatgcaggtgtttgggacgccatacttttttcactgaagcccttgggaagctggaggaactcggtgccactgtgcgcatcagccagagtgtgcagtggtcctgatgaggctgaatgctcaggagttagcatgttcatatagtaagtactgcttgtttatgggaggactatttacatttttcttaaataaaaatataagaatcccatcatttttcatattgattttagtatatcttggtgataaaataactatccaggggaaacggttctttagcattaactctgtgcggaaaagcgaagcctcccctgtgtagtgggagtcgtcgtttgctgctggcgagttaatgtgctctgcctgcgtctctgcgctgtgtctctgaggctgtggtttacagctttctcagatgcacagtgccctcggaggaagggaagtcactgaagatgattttctgttgcagtcctgcctatggaggtgctgatgtacatcttccgatgggtggtatcaagtgacttggacctcagatcgttagagcagttgtcactggtgtgcagaggattctatatctgtgccaggtactggtttttggaaatgactcaggcagtgaagtaaaagatgatagccttttgtcaagtttgaccaaaccaaacaaaaccaaacaaaa

SEQ ID NO: 35153 - DNA, 1175 bp, Mus musculus
gtttctctgtatagccctgactgtcagggaactcactttgtagaccaggctggccttgaactcagaaacccacctgcctctgcctcccaagtgctgggattaaaggtgtgcgccaccactgcccggcttttttatgtctcttaattattttctgtattataaacttaatacaataaaaattgttgtcttttgacatggtattagtctcaagctacttctgctgacttgatcgggatgatcccccagccccaggacagtttggtttgcagttatctcagcccacaagtgtatttgaaagtgcttccgtgtgtataaaagtgtgcagactagctttggaaggattttatataaggaggtgaacgaaaccctgagagaggtgcgaaggggtgacggtcacctacggatgttgtcaagagagtgtttgagctgcagagagcagtgcagagggagtgtgtggttggatctcttcactctccctgcaggtttcttccaccgggacttaaaacccgagaacctcctctgcatgggaccagaacttgtgaaaatcgccgactttggattggctcgagaaatccgatcaagacctccgtacacagactatgtgtctactagatggtaaatgctttttctctctgaattatctaattatgcttttttttccaaaagatacagttataatgtatcttatatgtaatgacagcaagtgtaatggcacacacctctaatcccagcacccaggaggcaggaagatttttttatgagttcattgccagcctggtctatatagtgagttccagcctggccagggctatctagaaaaaaaaaaagaaatcaaaacaacagaaacattaaaacattatgatgagaacagtattaatcacaaacattaatttctcactaaaaggaacaagtagttcaaaccctgcagatattttgttattaagtgaagtgtaagcttgttaaaaacaattttcaaagaaaaaccattgtgctctctgtagtcttagtaatttcttaagtttttagacttgttatttcgtgtgtgtgtgtgtgtgtgtgtgtatgtgtgtgtgtgtgtgtgttcgtgcacgtgtgtgtgtgtgtgtgtgtgtgtgtgtgtgtgtgtgtgtgtgtgtgcatatgcaccatatgcacgcctggtgcctggagtggtc

SEQ ID NO: 35154 - DNA, 1216 bp, Mus musculus
tggagttttcctcctggtcctgcacgtgcagggagctgtgctaaaatgaaatgcagggcttctcgaaggagcaagctctggtgaggtgtttatcggtttgtttctcagacttgccctagcctttaaataccacatggcagcctgctttgtttattcttacatagctacaaagacccaggtagatttgagtctcttggctttattttttcatctaagcaagtgtataaaccattggtgttctatgaacattaaccaatcggcttaattaataagaagtttagtttctgagtatgaaagatggggaggagatacctaatacaagctgggtcagagtctctgtcccacaggggtgctgtgtcccgcaggagtgccatatggctgcagtaaaaaatccacataaccaactgagagctgccacgagatctggtgttccatgttgacctagttcatgggaagaatggacaatggttccatgctgactgcgacccccagggcagactgattgaattttcaccctagaattttcttctcatttcttttcctttttaaattttattgtgcatgggtgttttgtctgtgtgcatatctgtgcatcgcgtgtgcagcatccaaggatgctcggaaaaggaagtcagatcctctgggcttggagttactgagtgttgtgagttgccacgtgggttttgggatgaagcccagtcctctgcgcttttcacggttgagccacctctagctcagacctgtaacttcctactaggcacctagaaactgctgctgctggtccccaagcgcgctcaggagattgccgcccacttctaaaacagaagccaggctgacttcttttctcacaagcaaatgttgctgtaatctgcgacggagaagggacatttttaggttgctaggtttccatgtttagtgacttgcacatgtgctctccttttgaccttggaactaagcctttgttggagctgagctgtgaaccggtacctgtggcctaactcaagcaattgtattaggagaagtgttcttccattttctagaagattttgtacttctttttccgtctaaactgtcacccatgatggctgctttctgctcagtccagctgagctgtgcgctggcttctgggttgaggagctgcatatgggtgcacattctctgatccttctgggtggggttcaacccccaggtcatcataggaaaagcccacttggcg

SEQ ID NO: 35155 - DNA, 1128 bp, Mus musculus
caagaatcagcaacattcctacaattaagaagttcctgcaacccggaagtcagaggaagcctcctccagatggcccctatgttgaggtggtcaggactgtcctgaagttctagtgcagcgtgctttaaggtggcacccacaaggttccaattgcagtgtcaccacaggccagctgcagagcattccagaagcaaggtatatagatcccaggagtcaagctcttcaaacaacaaaaccactctgcccacaatgacaaatgccaattaaatacagtggaaaactattctcgttggagaggtgtttgttttgttttcagcttgttggctgtggatgacagtctacaaatgtcacaaaaccagagtcgcttatgaagaagtggtaggcagacagacagacagacaggcaggcagacagatgtattcaggacattgagctaaagtgtgtctgtataaaggtcaggaccataactaggttgcagtggtgacttagtagcagaggatggtttcagtatctacactggcttctgagaacttgcgatgctgaagtgggagcagaaggaacgtctgggacactactctgagaccctattaaagaaaaacaccttgcacatcagacagtcctcttccggcaacaagagccacggaagctcaggttttactttgcctagacattcctagagaccagcgggaccaacacatagccagtgaatagttccttattcaggctcagcagaagcctcctcagccttgaggtgctttctttaaatgttcctattatgtccccaagccataggttaaagctggaccccacgcagggttcatttgatgggaaaagaagaggtggggatgttactgtgacttttggtggcttctggtctagagaaagctcctgctagtagtttggaaaatgtgattgccagctccaaactcctcctaggacaacctgtctgttcttaaaaattacatttatttgtttgttgtatgtgtgcgtgcacgtgcgcatgtgcccgcacacatgcatacacacacatgacacagagtgcatatggaagtcgaggacaacttttggaagtcaccctgagagttggactctggttgatggttttgtgggcaaggatctcaacctgcc

SEQ ID NO: 35156 - DNA, 1524 bp, Mus musculus
ccagggccttgaaggaagatagtgggtacactttaaagacacctagagctttaggtggaaagaataaaattccaattttccttttcatttttattaaatgacaagaatcattgttgagttcttgggagttgctttggcatctgacaaaatgagatcccagtatctgattctttcgggatgggaaaagctatagtcttttagaagtctttgaactttccagcgtggattctccacttttttggggttcagaccccgtcagttcccagaggaaggtcaccagcactgacttctattcccaagacccccccccacccccacccccacccccagattcgaatacacatacaggcgacaaacctagttagcttgaatcaggcaggcggcctgccttagtctccccaggggcatagcctgcgggagccgcctgggattgggccccataggaggcgggccctagtgggcgtggtctagtaaaacaccgcccacacaggtactaaaacttcctgaacctggagctgtgggccgtgcgtggtggataagcttgatctcgtcttccctgaagtctggttccttggcaggatgatggtgaccctcgtgacccgtaaagatatccccccgtgggtgaaagttcctgaagacctgaaagatccagaagtattccaggtccagtcgctggtgctgaaatatctgtttggtgagtagctactcttgacctcgctgccaaggcccaaagctccgggtcttggaactatgctcattgcctttccccggacaggcccacagggatctcgaatgtctcacatcgagcaggtgagccaggccatgtttgagctgaagaacctggaatctcccgaagaacttatcgaggtcttcatttacggctctcaaaacaacaagattcgggctaaatggatgcttcagtccatggctgagaggtaccacctgcgccagcaaaaaggtgagagtctctaacaggtgccctgaaccaaggtgcggtggagtagcctcctgcctccaccgagtttacctcccttttcacatctccactgcttgcatccctctgaggatgccttacttttgggcatcacctgggactcctccttggtctctaggccgtctctgacaaccttttgggagttcgggggcccagacgtaagtcttaaggtgagaaggggtagggacttatccctctgggcagggttatctgaggtaaccctgccccaccccactcccatctccaggtttctaggagaacgttagaactggcccagtggagccctggttctaattagaggtccacaaaaacatgcttaaagagctggtgaatcatgcggccttcctcctgttccatgacacttaatcctgtttggtgtttctcacgcaggagtgctgaagctggaggaatccatgaagaccctggagctaggccagtgtatcgagtgaagccagtttccagtccttgtgtctccgacctggatgcaggttaagctgtggccagtgtttggttctggcgggatttttagc

SEQ ID NO: 35157 - DNA, 8765 bp, Mus musculus
ggagttaagtgctcacgccactgagttcttgtggacaggggattttgagctagagttcgatgtaacccaggctggctttgtactgctggtactcccgcctcttcctctcagctgctagggtgctaggcatacattagtagcacagagaatacgttgtgtgttcttggatgacctttgtggatgtgtcactttgtggatgtgtccctttttattgcttattatttattttattattttattttgagacatgttctctctatatagttctgactggttatacagaccaagctggccttgaactcacagagattcttttgcctctgccgctgcctctgccacacacacacctttttttttttttttaaagaaagtgtatgttagaaccctgattttgggctggagagatggctcagtgggtaagagcacccgactgttcttctgaaggtccggaattcaaatcccagcaaccacatggtggctcacaaccatccgatcgttacgagatctgactccctcttctggagtgtctgaagacagctacagtgtacttacatataatcaataaataagtctttaaaaaaaaaaaaaaagaaccctgatgttgagtgttcttttttttttcaaatacacaccagaagagggtgtcagatcccattacagatggttgtgagccaccatgtggttactgagaattgaactcaggacctctggaagaacagccagtgctcttaaccactgagccatttctccagcccttgcctctggctcttaaatactaggagtaaagttgtgtgcccccacacctggccggatgctgctgcatttgctcactatacttagaaaacatttgagagtcccttttaatgtaaagtttagtatattacaaggaattttgttctgagtttggtttacaggacatgggtccttatgttaataaaactatttacactggcagtgctctggatgttcttaagtatgaagaagtggacatggagtcgctcgtcggcgtgcttcccgagcccttggagaagtatactgcatgtagagagctcgccagaagactgaaaatagaaggtaaggagagctgtctgcctaggtgatgccatccttttccgcgtgtgcagatgatggacgagcagtagaccacccagggcagtgtttgctgagcatgcctgaggatgatacaggctctgcatgaccatagctttgtcctcaagcatgcagcataggctgatagtgggaatggtgggattatacaggaaaagactctccttgaggagcagccagggcggtaagattggcacttccgcccagcgtcagtgctcccttcagttccacagctggctggaatttggctgaggacagagtgatgtgtgctgcctgccattccttgggtcattgtataaaagggtagcaataaagaaaaacctagaagaatcctaaaaacattttcccaaatgacccagtactaaaacattaaatttgccgggcgtggtggtgcacgcctttaatcccagcactcgggaggcagaggcaggcagatttctgagtttggggccatcctggtctacaaagtgagttccaggacagccaaggctatacagagaaaccctatcttgaaaaaaaaacaaaaaaacaaaaaaaaacaaacaaacaataaaaaccacacattaaatttaacttataaaataacggaaatagaactggaaagatggttcagtggctaaaagtgtgtgatggtcttccacaggctcagggttcagttcccaacaaccacctgtaactgcagctttaggggatccaagttttctggcctccacaggctcctacagttgtgtgcacagacaccgcagacacacatgattcaagacaacttgcttaaaactcaagtcatccagtacagaatgacagcatggaagaaggattcagacttatgtcatcattatggttcctctgttgaacacttcagatagtagggtgtagcactggaaacagctgcttaggtggcagactttgacctcgctgtgcagctttactttgttcagttagcattgttcatcatcatccctgctgacaggaaagaattcagccatggagtagctgttccttgctccagtgcttagggggtgggggctgtgattagaatgtaaagtaactaatgcgtaaaagggccagtgcttataaacactctggccaccgcttgatacttacaagaaaccacatggggttaaagtacaatctgtatgggtgattgaattttttattttgtttttatgtacatgtatgtgtttgtgtgtgcacacatatgcaggtgctcgtgggcggcagaagagggtttccgatcctcttgagttagaggtacagactctagtgagctgcctgacatgggtgagacactagaacagcaagagtgggaagagctcgctcttttcctttggtttttttgagacagggtttctctgtgtagccctggctgtcctggagctcactctgtagaccaggctgtcctggagctcactctgtagaccaggctggcctggaactcactctgtagaccaggctgtcctggagctcagtctgtagaccaggctggcctcaaactgcagcaagcattcataaccactctccagtgttttttgtgtttatttgttggtggtggtggtggtggtggtggtggtggtggtggtggtggtggtggtggtggtggtggtggtggtgttttgttttgtttttgaagacatgaccggatgtagcccaggccagccccatcctaagcagctgaggatgaccttttactcttaagcccttttgccttttactctctaagtgctgggattgcagtgtatgccacctacctatttttgtggagttctggaatgtaatgattaatattgatcatcaacctgacaggatttagagtcacaaggatttaggactgaaaacatgccaggtaagtcctctgccaactgacttacatgtcagccagcccctagacaagtttcttgggggcagaactcagtgttatgtcttattatctttcctattttgcaatgtatatttgagaaatgaaataaatatgcccttggccatatgcaaggtctcaggtaccctgttaataacacagttactctccccttgctgtgatttctctcccatccctgacaaagaaggatgggtttataaatacagaggccatggtcgttggtcatagggatgagtgggttttggctcgtgacttgaggagagagcatcttcctgtggttggcggaacatgaggcactgacttatagctcatccacaggcaggaggccgagacactggtgcccggctccctctcccgctttgtgaagtctgagcctaacctggggatgaagccacctcgtcattctttacttaaaccatttcagaaatatcctgacagacatactcaaatttccacaatgccttttttttttttaagatttatttatttattttatgtaagtacactgtagttgtcttcagacacaccagaagagggagtcagatcttgttacggatggttgtaagccaccatgtggttgctgggatttgaactcaggacctttggaagagcagtcagtgctcttaaccactgagccatctcaccagcccgcctttatctcttgtcaaatcaagattcagtattaaccatcgaatcccattaaaccctgaggcctatttatggatcataaacttgtgccaggtatggcgaagcattcccatgtaaccatagcacttgggaggctggatgataggaaactcaggtgtttttttttttgtttttgtttttttttaagatttatttatttattatatgtaagtacactgtagctgtcttcagacactccagaagagggtgtcagatcttgttacggatggttgtgagccaccatgtggttgctgggatttgaactcaggaccttcagaagagcagttggtgctcttaaccactgagccatctcaccagcccaggaaactcagttttaaagaaaacaaaaacttagcatttagccacgtgtggtggcatatgcctttaattccaacatttgagaggcagaggcagaggcaggtgactctctgtgagtttgagaccagcttgttctacatactgagttccagaatagctggggttacttagtgagaccctgtctcaaggcagctctttaaaagaaccatttgatgggggcctgtagcgttttagaggttagtccatgatcatcatggcaggaagcagtcaggcatgggctggaacagcagctgagagctttatgtcctgacgtacaagcagcagtcagaatcactgggcctggagtgggcttgggcaacacactttcgccaacaaggctacacctcctaatcttttttttttttttaaagatttattgattatatgtaagtacactgtagctgtcttcagacacaccagaagagggagtcagatctcattacagatggttgtgagccaccatgtggttgctgggatttgaactctggaccttcggaagagcagtcgggtgctcttacccactgagccatctcaccagccccctcctaatctttctcaaagagtttcactcactggcggccaggtattcaaatatatgagcctataggagccattgtcattcaagccatcacatggcctaaagtgtatgacagagtatgtgtgggggtatgctcattccatggcccttgtttggaagtcacgggacaacttacaggaatcagttcttcctcccactgtaaattctgagtagtggactcaggtcttcaggtgtagcagcagtttgtataccctatcccctttttttgaaatgggtctgatatagtccaggctgatctggaacttttaggatagcctttataggataaccttgagctttcaattgccacacttagtaagaacctatccaaactgtgcgtaatgcacgctgggtaataggtaaaagtgttgtgacccacatgacctagccctcgggaggcaggtgcagggggatctctctgagtttgaggcctgcctggtttacagagagttccaggacagctggggctacacagtgaaaccctgtctcgaaaaaaaggaggggagggaggagagcgagaaggaaggagaagagagaacttatcctgtgttggacaagatgaaaggactgccttcacttagtttgttaaaagttttgttttgttttgttctttacttcttgattatgtcggaggcagtggtgcagcgtgtgtgcctgaagatctggagttaacaggtggttgtgagccatctgacatgggtgctaggagtcagactcagttcctctgaaagaagagtgtggactcttaaaccctgagtcttcttcccagccactcaactcatattttaaggtagactttgctgggcctgttctcacagtcctcttgtcccagcttgggaagctgaggcaggagtgtaaaaggtctacctgtccaactcagtaagataatgactaaaactctgaaagaggctgggctgggccctaactcagtggtaacagtagtatgtgtctccttgcctagcacgcagcaggcctgaatgccctgggcttgattacgagtaccaccaaaacaagtttgtttgtttttttaaactttggctttaatttccttttttttttttttccttggttttttgagacagggtttctctgtgcagtcctggctgtcctggaactccctttgtagaccaggctggccttgaactcagaaatccgcctgcctctgcctcccaagtgctgggattacaggcatgcgccaccactgcctggctggctttaattttctaagaatagaatgcatgataaaacaattgccaagctttctttataacattacataacattacttcttaataaaaaccttatctatattgcataaattatgtttactaagaaaccccatttctaaaaattactgctggggatgcagcctggggggtgcatagctgagtagtagagctacttgtctggcatgtgtaggccatgggattaatccctaggaccaccctaaaatacacacatgcacatacagcttcatgtagaaaacatacagcttcgtgtagaaataacttggagaaacagcccatctttaggacttaactttttttttttttggttttttgagacagggtttctctgtgtagcccaagctgtcctggaactcactctgtagaccaggctggcctcgaactcagaaatccgcctgcctctgcctcccaagtaggacttaacatttaatgttaaaaataagatttgcacagacaagaaattccgagtgagctgggcacggtggctgacttgtgtagtgttaccactttgcagtgcgggctggataacaatcggcagtttaaggtcatccttggctgtataatattcatctgcatgataaccttcaacttccttttcctcaaaaaggaaaggtcatcctcagggtgttcagggtcagcctcaatatgtggcaagtttgaggctagcctgggctacatgggattctgtctcaaaacaaaacaagaaaacagattacctacctcacctgtctccaagtgtcatgttgaatgatgatgtatgcagaagccatttgtaaatagtaaagggctgtacaaatacagttactagtgtaatgtgtgtatcataatacagttctcattttattcaccagccagttatgagtcagtattgtcatatcagctacaagaaataaaggaggttcagcaagatgaagctttgcagcttccacacgagctcgactacctaaccatcagggatgtgtcattgtcccaggaagtccgggagaagctacacttgagtcgcccacagacggtaagccaacaagcagcaggaagaagcgaggtctaagcagagccaaaaagggctcttgctttaattataggaaagagcggacgctgcggttatgagcacttgctgctcctgaaaagggcctgggttcggttcccagccagccacccacatggtggctcccaatgatctatgactccaggtccagggaaaagaaacttagcctcttattttctttccgtaggacagatgttgatctgtctctgagagatgagaaagctgagcttagttgaaataactgaaaattaagaattgatttgtcggggctggtgagatggctcagctggtaagagcacccgaaggtccagagttcaaatcctagcaaccacatggtggctcacaaccatccgtaacgagatctagcgccctcttctggagtgtctgaagacagctacagtgtacttacatagaataaataaataaatcttaaaaaaaaaaaaaaaaaaaaagaattgatttgtcaagccaggcgtggtggtgcacacctttaatcccagcactcgggaggcagaggcaggcggatttctgagtttgaggccagcctggactacaaagtgagttccaggacagccagggctatacagagaaaccctgtctcaaaaaaccaaaaaaaaaaaaaagaattgatttgtcacaaaaagtgtgtgtgttgggggttggggggagaggtattgattgatttgctgaagagatggcttactggttaagagcactggctgctcttccagggaacctaagctcaattcctaccacatgaaggctcacagccatctgtgatccaaatcccacttctgcccttggtgggcatcaggcacacaaatgatacacaggcttacatgagggcaaaacacctcctcatatcaataataaaataataatgatgatggtgataattaggaaatgggtttcctctcaagttaccttttcacatacacactgtggcatgcatacacacataagcaataaaaaagtaaaataaattttaaaaaggatgattgcagttattctctattctctaatcccaaccatgtcctaaagaattagttcagactagtgtgtgtgtttgtgtgtgtgtgtgtgtgtatgtgtatgtatgtgtgtgtgtgtatgtatgtatgtgtgtggtgtgtgtgtgtatgtatgtggtgtgtgtgtgtgtgtgtgtgtgtgtgtgtgtgtgtataggtgtgtggtgtgtgtgcatgtgtgtggtgtgtgtgtggtgtgtgtatgtatgtgtggtgtgtgtaagtgtgtgtgtgtgtgtgtgagacgtaatcattttaggttaaactagaatacattttagtggtttcagatcattccctggctccctctcgggattccatagttatattccataagcttctaggagaggaagagagccagagttctcccaccctgtgatttactctcaactgtgtatgtgcttcaaaatgttcttattacctggtccctcctattgtgcaagcactgaggcaaagcagtttaatgtaagcactccattgtattccttatatttaaagaaataagatactcacccccacacccccgtctgtctcttgtaatgattacattacaagctagaggtgctttgtgtcccccttgccctggatgggattttgtcaggcttgaacttgagcaggtcttgtctgttctgttttgaaacgctttaagtcatcctgtgctttgaagggaggagtgttgatacagatgtctcatttatggctgagcgctccaaagtcacatagttcccatatattgacagctgtgaatctgtgttaattgtcatctataccatgtattttcaaggaaggaaggaaggaagtgagggaggaaggggaagatgttttgttttagatgtat

SEQ ID NO: 35158 - DNA, 2900 bp, Mus musculus
gaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaaaaatgggaaaggaaaagactcacatcaacatcgtcgtaatcggacacgtagattccggcaagtccaccacaaccggccacctgatctacaaatgtggtggaatcgacaagcgaaccatcgaaaagtttgagaaggaggctgctgaggcaagtataaggcaaaaggagggatgggaattctttaagcagggagtagaacctaggtcttgggtgtactaattagaagtcactttgcagatgggaaagggctccttcaagtacgcctgggtcttagacaaactgaaagctgagcgtgagcgtggtatcactattgacatctccctgtggaaattcgagaccagcaaatactatgtgaccatcattgatgccccaggacacagagacttcatcaaaaacatgattacaggcacatcccaggtgtgtaaaatttacccattcctgactcaggatattttttagtggggtgctttctctgagataatggtatatgattgtcttgtttcttacaggctgactgtgctgtcctgattgttgctgctggtgttggtgaatttgaagctggtatctccaagaacgggcagacccgcgagcatgctcttctggcttacaccctgggtgtgaaacagctgattgttggtgtcaacaaaatggattccaccgagccaccatacagtcagaagagatacgaggaaatcgttaaggaagtcagcacctacattaagaaaattggctacaaccctgacacagtagcatttgtgccaatttctggttggaatggtgacaacatgctggagccaagtgctaatgtaagtgacttttaaggtagttgaatggagaaagccgcaataagtaaggaggttataattgactgcctgtgttttagatgccttggttcaagggatggaaagtcacccgcaaagatggcagtgccagtggcaccacgctgctggaagctttggattgtatcctaccaccaactcgtccaactgacaagcccctgcgactgcccctccaggatgtctataaaattggaggtaagtagaatattaagtagaatgttgacgtgaatttgaagtcttatgttttgtgtattaaatacttatacaaaacaatactattttaggcattggcactgtccctgtgggccgagtggagactggtgttctcaagcctggcatggtggttacctttgctccagtcaatgtaacaactgaagtcaagtctgttgaaatgcaccatgaagctttgagtgaagctcttcctggggacaatgtgggcttcaatgtaaagaacgtgtcggtcaaagatgttagacgaggcaatgttgctggtgacagcaaaaacgacccaccaatggaagcagctggcttcactgctcaggtgacacatttttaagataggtggctagattggttgtgtgtgcagaatcacaaggcaagacttaaatacacgctgtttttcttaggtgattatcctgaaccatccaggccaaatcagtgctggctacgctcctgttctggattgtcacacagcccacatagcatgcaagtttgctgagcttaaagaaaagatcgatcgtcgttctggtaagaagctggaagatggccccaagttcctgaagtctggcgatgctgccattgttgatatggtccctggcaagcccatgtgtgttgagagcttctctgactaccctccacttggtaagcctgatctgagtctgctacactgaacatcaagtttgtaataggaaatgttgcttgcatagcaaagatactgataaatggcatttttctatataggtcgctttgctgttcgtgacatgaggcagacagttgctgtgggtgtcatcaaagctgtggacaagaaggctgctggagctggcaaagtcaccaagtctgcccagaaagctcagaaggctaaatgaatattacccctaacacctgccaccccagtcttaatcagtggtggaagaacggtctcagaactgtttgtctcaattggccatttaagtttaatagtaaaagactggttaatgataacaatgcatcgtaaaaccttcagaaggaaagaatgttgtggaccattttttttgtgtgtggcagttttaagttattagttttcaaaatcagtactttttaatggaaacaacttgaccaaaaatctgtcacagaattttgagaccattaaaacaagtttaatgagaaatctgtgttggtcaatgctgaaagttaactgactgtatacaacaaaggtactggggtccccatggtatgttcttagggattgagttctggttgtctgggtctgcccagaactgagctataaacagggctgatttgggttaacttca

SEQ ID NO: 35159 - DNA, 1185 bp, Mus musculus
tggttgtgggccttcatgtggttgttgggaattgaagttttgtttttttgtttttttaaggacctctgctcactctgacccaaagatttgtttattattatacataagcacgctgtagctgacttcagatgcaccagaagagggcgtcagatctcattatgagatggttgtgaaccaccatgtagttgctgggatttgaactaaggaccttctgaaagagcagtcggtgctcttacccgctggataggttttgtttgtttgtttgtttgtttgtttgtttggtttggtttttcaagacagggtttctctgtgtagccctggctatcctagaactcattttgtagaccaggctggcctcgaactcagaaatccacctgcctctgcctgagtgctgggattaaaggcatgcgccaccacgcccagctttggatagttttatatcaacttgacacaaactatagtcatccgagaagagggaccctcaattgagaaaaagcctcctgaagatcaggctgtagccagacctgtagggcatcttcttaattagcgacctatgaaagagggcccatcgagggtgggcacacttctgggctggtgctcctgggttctcgttgttgttgctgttgtcataggttttctctgtgtagccctagctgtcatggatctcactctgaatactaggatggcctaagctgaaagatcagcctacttctgcctcctagcagagtgctgtgattaaaggcatgcgccagcacctgtcattgttgtctttcttttttattattcttctttttttcttttttttttttttcagtataaaatgaagtttatttggggtatgggaagggagattaagaaaggagtagagcagagaaagaggagatagagaaggacagagagggggagagggggggggaagagagggggagctgggggagaggggggagagggaggggttgagggggagaggctgaccagaaacacctgggcaggtaggggaggggaatggggggagtggcctgagaggtcagagagaaaagggtcagagagaggccattgtcttcctttaccctagaatttatgatcttcctgcttccctctcccaagcactaatattacaaacctgtgtcaccatacctggctctgtacactgtcttgtctatgattattacttacacaaggtgt

SEQ ID NO: 35160 - DNA, 1157 bp, Mus musculus
tctggaccgttcttcaggctacagacgggcagacgctcttccacaagaaaagctatcgtttaacagattctattggcatttctccctgttccttaaacggcccctccccccttaagataaggcttcaatgtgtagcctaggctattggcatcaggacattccaaacctatgacatcacataggccacagctggacctgcgacctccagaccggttgccaagacaacaggcaccatcttcccagcattcacttggctcaccttccacctttgtgttattttctacttaaataaggagaacgccccttcctcgcgctctctccccttcttttctttccgctgccaccttgcccttttcccctctcaatagacctcccgtggaactttttggccttgtgtggagctgccgctgccgataccagcattggtgctgtgactttggtggtcgttacacaggggagctgtagaacccgggcggccgccggcgccaccgccaccggtgcgaccataacactgccaccgcctgcagccactgctacaccatgtggactccatctgctagcacctgccataatctcccgcgtggatttccattgcttcgagactcacaggtttctaccacgtgggatgtgcctccgtggactaccacgtggaactggcctctggccagccaaccaaagggttccacacttcctgctaccggactgcagaatcctgcaaacacacaccggcatactggttggtaaggagtttctccagttagtgggaggaaccctctatgcccagatagcgcccagccagcctcttttgggctaagggttggctttcaatgccctggtccttatgaccggcctcctgactgacctacgagttaggatataggcccgtgggtgaacccccttctcgaaggcaattcataaatcccttgagctcttgcagcggccagaaaattcctagtactaggttggattgctttctgacgtttccgggaaacgtcaccgccgtggtccctagaaattctcctgacgacctgaatttctagcttggccgtactatcaaccagtgttgctgggcagtcctctgggacgccggtacggattgctcagtaactaccctcccacccaatggctgcctcttggaaaatttcaaatctctgaaa

SEQ ID NO: 35161 - DNA, 1235 bp, Mus musculus
atttgctatgtacacaaggctggcctggaatccacagaaatggccctttgtgccttcctagtgttggggtttaaaatgtgggtcaaccttagaccggagaaaaaaactatttcgacgactgtctgattaaagcaagctgtgtttagactgtgcactttccctaagttcgggtctcagaacatcccctcactggcttttgaggtctcttatatgtggaagggttagggttgatagagaagagctgttgagataattggctgttagcccctggacatagaagttggggtggggacatggtggtggaggagaggggctactcaggacctaaggcagtctgtggggtgtggaagggcactcatcaaggtatctggaaaaacatttccgtaaggcaaaagggcaatcatagcttacagattcaggggtttagcaaggcaaagggatttacaaagggtatatacatcatggggttacaagttaagcacaggttgaaaaacatggtttgtagaatacattattaggcttaggaaacaaatttattcttgtaaggtatggagacttaataacaacgtggctctttaacaacattgtggctccaggtttggtttcaaagtcaccacacttggccagaattgcggttaggagctaacattgccttttagaacaaaaactgagaagcaagggtcaggaaagtctttttgcctcgtgaccctgctgcctccagcggccagaggcgggagcgcgggcgggtgacgccaggggctccccagcccgcagtgactttccatcgagcccttttaaatgcctttcttttgcacgtggtttctgtgagtcatctcctttctccagacaaagaaatctaggttttgctaatcgggtttcctgagtccgctaaggcatgagtcaaactcgtgcttcccgagtgctgtaagctcttcttgctcctcccccaggggaaacgcccgctgccgtggggcaaatccgagtttctggggggccggggggggggtgtcaaaaaattcacgcggaaggtgagtgcggcatggaacctgtcgtaagtcccaagcgtcagaagagaagagcgtttgtgtgttttaaaaatagttctcttaaaaatctttggacaggctcggtggctccaagggtaaaggagcttctatcaagcctgaagacctgggttcagtcccttgggaaggcggaaaccgaaaaccggtttcaataagctgtcttctgacctt

SEQ ID NO: 35162 - DNA, 2301 bp, Mus musculus
tatggatgacttatgaaaatatatgatggatataaaaattagccatattgattatatcaatattgtaactgctaaaatgacattctaatgtctgctttttattgggacaggccatgtgatgcatagagcctctttcctatgaaatgcgtctactgcttaaactgttgatgctgtgttgataacatattgacatgatgctgtatatgtgtgcctactgtgtgatgaaagggattatgagatgtatgagtgtaatgacttgctaacctttgaaaatttggttacagttcagatagaagaaagactataaataaaacacttcatcattttcatgtgtcgtgtgtaaaggcttaaagtccctccttgttgaggtggttcatatgttcagttgctctattatgattctccgataatgacgttgacttcacactttagcttgtacaacatagaaattaatatctaaagaggtcagtgggtcttggctagaattttaaatttcttctcatttgagtaaaatgttgcattctgaagtcccatgctacctgaagttgcatttggagtcccaagctactggaatgtttatatgtgaccgtttcccaggaggcttacactgcagaaggaagaatgaatctaggtgaggtgggcagctgcttggcagtcctctcctgtgccccaactgtaaaccagatagaaatgttcaggggaggatactttcattattgtggtttgtagtgttaagatgattgcttctgccttggaaatacctcaagctgttcttatttaacaggtaagtgactgagtataatattccagaaaaatttgaaatcctaatttcttccatatttcattaaattttttgcatacaggtctaacaaatatggatatgtatacacatcctctttaatgaaggtattattttggttacttttcctaagatataccttaaaagatgttctatacatttcctacttaaattctgggggatttggagtatgtacatgataaaaaagattataatatatcgattgaagttactttattttctaactagaattattttaatagtcctttattgaataagtgctgtaatttgtttgctatgagacttattcctgatgtgaatgtaaattatttttccacatgcatgaaaaaatgtatgtactaatcagagttgtctccactgcattgaaattacttgttttgaactaaagtaactcatatttatgtagtagaatgcttatgttttcagactttgtaatgatttcctttggatgtattttaaatcaatcggtctgggtaacatatcagtttagattaatatgtgcttaaaagaagaaaaaaattcaatggttcatagtagaaatgtgccacacttaaataagctctgtatgacatgaaattctgttaaaacattgtaattcatggtgacttttaacttataaaaatactacttgcacgggttacttgatttatggatatatgaaaacttctcaggacgaaagttcttctttctctagaactattcttctgtcggtcatgcagaatgctgttattctgaaaagtgtccctgttgcatatgatggtcactttatttggggggattcttcataagatgtgagatgttgatgccagtctttcccaagtaagtgctcgtaaaaaaggactactaactagcctgcatctgtctctaactgggaccaaggggtctgctgaaggaaactgaagagctctaacattttcacagcttggagaagatagaatctttaaaagtacaactgaagcttgatctattttacaagtgcattgatggcccctgtccttctctggttcctgtcatttgaaaccaactcctgttgtaaataggaagaatatgggacattcatatttaagaaaatttgatgtcattaggtgactaagtagaaggcttagaaaaatgtattcatttgcaagtattttggcacaagaaattttccaactgaatagtaagcaaaagctaagttgtttcattgaaatcataaggcagtttaagataaactggagaagataactgttctaatagaggataatcgaattgattgtcaagtggatgttatttattggatagtgacagagtttatttgtaaccttaattatattaaaagttattctgttaggatgttttgtattaataaacgtgaacaaaattaatcgtgctgtttatgtgtcttactaaaataacagtgcccattttttcatgttaacggttaatattcagttctatccagtcttagtccacgttttaacttgtccatgtgtacatttgaa

SEQ ID NO: 35163 - DNA, 1218 bp, Mus musculus
cgccgggtctaacctgcaccccgagggcagcggctagcctgggagcttttaaccacagggcagtgttaaccaccacctctccccctgcctccttggatcggccagtttcaaccaagcttaggtctgaaactttccacgaacgcttaagaaagacgcggacgaagtctgctcctcacccactaggcacccatcgagaatatggaggtgggagcgagcccaagccttcggcgcgcccctcgcaggccgccctgggcctcggctcgctgcgctaccaccgcgccgcctcgcgccggcctgcccgagccttggcccgggcggacccgaagtcggcgcgcctgcagcgcgttcccagcgggccatcggccgtccgggcccccgtggcccccgcggccccaagcccacccggagcagagagctgagtatcacggcccgggggtgggagacaccccggtgtcggcgaatttcgcccccgactctcccccgagggagacccgagcgtacctttcaggaaaagagccccagcgctgccaccgctcttgcccgccgccatcttcctccttccacgccgcctccttcttactccatggccgacaccggcgcggtgctggcggggaatgggggccgcgcgtcgggagggtagcagccgcagggtggcgggcctcgggctcgacctccgcgaggggcgctccccgccggccgggccccccacacaaaagcgggcctgacgggaggcggcgaggcccacggcctgggctgcttctcctcaggcgcctaccggggaccgtgagcggcggcggcggcgcttcccgggcccggctcccctcggcacacgactccccatccaccgggccgcgccggcctctgaggagctccctccgctcccctccgccccgctccgccgctggctccggaggacggagaacggagcgaacgctcacacgccttctacgtcccgggccgtaaaatggccgcagcggcttgagccgagcgagggctccgcgaccgtgaggcgcccgcgacccctcgctgctccagcagtggccgccgccgcccgcccaccccgcccaggcgtcagagcatcagcccaggcctcggcgactgtccatgtggacgggggtgggtctccgccaccgccgcgcgtcggtcgccacagcagccccgccgccgctcctcccccaccggcctccgggcccgccccgccgccgccgccgccccaga

SEQ ID NO: 35164 - DNA, 1150 bp, Mus musculus
tataagagcaaacacactttttgtttgtttgtttgtttatttatttatttatttattttaattaatttttttaaagttctgtgacctgggttttaaaggattttgaagtccaaagtctagtcattgaaagttcctctcggttttattccttcaaaaagcaaagtgatttgtattttacaaaatgggtgtagatgaagaacagtgtatttgaaagactactatggcagagtcccaccatttactaatgatttattattaaggacaggaaggcggataaatgaatccctatgtgatggcctctgcctgcagtcttagcactccggatccagctgaggcagaaaaaatgccatggatttgaggacatctgggctagtgagtttaaggctagtcagggttactggccctaggttctatccccagcacctctccacccctagcaaacaggcttaggtttgttcagtagcacagctatgtgaactaagtgtgagaatatcccagagcagagctgtgctgtgctgtgctgcacgggcacttaactgtgagtgtgcttcagaggccccgagcacagtggtgaggcctaaagagaaaaggattgtcttttctgatttctcttaaatgttgttgttttcttaagtcttaatttgaaatctaaaaaatgttgccagtttggtagttcacagaatagtttttggagagtattggggcttttattttattttactttattttttaagtcagacctacatgatcgtaattagtagtttttaaggaagtttattactttttaaaaaaaatctgaaaagggcatgaaggaggattgttaaatattacatcagttttatatcattggggcagatgattgactttctcattcttactgctattctaaaagttctttctgtattaaagatagactcacgcactacagtgctaaggaaggtaatagaaaaatgaactgcaggtctgtgtctgttttcattgcagcttcactctatttaagcagacttaaaacctagcacattttatagtttttgttttatttataatttcattttctgatcaaaaaaattttttagctttctttaaaggattgattaaaaacaaaaaacaaaaaacctgccgggcagtggtggcccacacctttaatccc

SEQ ID NO: 35165 - DNA, 1158 bp, Mus musculus
ttcatgtcacttaagctggtgtactgcttcggacagctctcttgcccctttccctcttccgggcatctattttggccttggagagtggtagagctgctttgtaaactttgtaattccagagcccttgtacttagacacagtttgtttcacactgcaggaaacctttaaaacactccctttgtgtgctgtttactcctgatcagatgtcagcagctgggctaatatttacaactttaatattaggaatttagagacaaagatacatcaaggagttatgttgacacccaaaggagtctttgtattttagaatacaagtaggaagtaaaactattcttcacactcccctttgttttaaaataccctgatctttgaaatttcaggatttttccccttagattcatgctcagaagccttgggtactattgtcagaattgctcctttcaaagtgtcttagtactgaagtacttatttattatgatggcattgtggaaatgattgttttgtgttaaggaaattaagtggccttgtctctactaataattgaaaatgtgaatgaggttttcttatggaggctgtcttactgcttagacttaccctctgttggtcctgtgattgatggcagaggtgtagttactgaaataaacaacctgttcttcctctttcatcgctcacttttgattggtgtctttatttgtgcaggatactgagtaagttttatttcctagtcaaaatgaatatagtccttggggggtggatctagtggcctaatgaatttagtggcgtgtcagcttagcattgttctctgaagcgcttgtatgtgacctctggatctgtgaataagcactagatgaaaaatcagtccaaaagtgggatttatgataatgacatcttaatattttaaagaatttatagggaatgaacaatagcaaagcattgttgaacgtgtgggttttgactgataacgctgtcatctccaacccttcccttcctaattatgtcaccgtgctggcctacagtgtagacgttcagatcgtctcctgagttaactttgccaagcaggagacctgtcctcattcaggcaggcttggggttctgcatgtcatagcacccagagcctcccaggggaactttagagcatcatttttggagacacagcag

SEQ ID NO: 35166 - DNA, 1128 bp, Mus musculus
ttttgctcttagttcctaactctggaccctaatttaaaatgtaattttcttctagcatacgaggtatttgtagatatatgggctcttggtatcagtttctgtttggtagagacatcagacccgtgtctcatgtgtttggtatagttttacaaggtccacctatgaatatggtcctcccaatagccaagttcccaaattccccattaaattttcttgttttacaacacaatatcttcttttaaacttttagacaaatgtacatactctatacatattttttaatcatctagagactatcacagtgttggattatgcctgtgctttctaaccatagagttgacaatggagtcattgacaactttgcattgattcatgattgtcacatggatctttaggtattagcgcagagacagctaatcagtcaaggtctacaaactgcactgatttggatttgacaaatctccctgtcagaatgagttctgatatattactttctgtaacactacttccatctagatttttaccagttagatctgtgtagtataggtgatagctgctgcctcagaaagatttcagtgttaatatatgtttcttcaattaatcataaaacgtactagaaacacttttcatttctattccccagtagggaactaactgattatgttttcaaatatcagtagctataattaggcagtatttactcatattcataaattgataatttagtcaatttatttatggcataaatgagttatccattcaattataaaaggcaggttttacccttgggaatgcttagggacatcaacagacacatgacctttagccttatattgctccctggaagaatcaatgggtggcatgtcgtcccttatcaaaatctatatacctgtcaattttttcctcagtaatatccagatcttcattttcaaaacaagcccactattaaataatcccaggggttttgactagttaagtcctagggcacagagtttcctatctactcctttgtctgcacgtgtcatgctccttttaaaaattattgttatattgaatgaaataaggcagaaatgttttactaacctgcataataacttccactttagtatattacaagttgaactgcat

SEQ ID NO: 35167 - DNA, 1135 bp, Mus musculus
gatgaagtacaaaatgaaatagacagacttaatgaacaagccagtgaggaaattttgaaagtagaacaaaaatataacaaactccgccaaccattttttcagaagaggtcagaattgatcgccaaaatcccaaatttttgggtaacaacatttgtcaaccatccacaagtgtctgcactgcttggggaggaggacgaggaggctctgcattatttgaccagagttgaagtgacagaatttgaagacattaaatcaggttacagaatagatttttattttgatgaaaatccttactttgaaaataaagttctctccaaagaatttcatctgaacgagagtggtgacccgtcttcaaagtccaccgaaatcaaatggaaatctggaaaggatttgacaaaacgctcaagtcaaacgcaaaataaggccagcaggaagaggcagcacgaagagccagagagcttctttacctggtttactgaccattctgacgcaggtgctgatgagttaggagaggtcatcaaagatgacatctggccaaatcccttgcagtactacctggttcccgacatggatgatgaagaaggagaggcagaagatgatgatgacgacgacgaagaggaggaggggctggaagatattgatgaagaaggagatgaggatgaaggtgaagaagatgacgatgaggatgaaggggaggaaggagaggaggacgaaggcgaggatgattagcacagaagactgatggattccaaccttcttttttattttctttttattttttaattttctccagtccctgggagcaagttgcagtcctttcctccctgtccctctgtgctcagtcgccctgttttgaggtctcaacatcatggttctcaattaatttggggggaagtatcttgagcaaaatacaacaggaaaagaaaaaaaaaaaaaaaagaaacttcaaggactgagtctgtatcttactcgctattgtgtagtaaggtttggacctcacaataccagcattctaatttttacttggtttttctgttattgtcggttctcatatccatggttgagggagcttgtgatggggctgggagatggctcagtgggcaaagtgcttgcctggatgaggatgtgagttcct

SEQ ID NO: 35168 - DNA, 1110 bp, Mus musculus
tccctaagcctacagaaaatttcagtattcttttcatatttagggttatgcttagctttgggtatattgtattactgatttttaaatgtcccaatattaataggttcttgaaattaaggctatattagaaattaaaaatctgtgatgattcttaatttaattttggattctagattccaatatttatatttaaaaatattggatatttaatgaacagagttcatggtgataactttggaaaatgtacagtatagtctcattctcattatcaaagcaaaaataaaattaaatagccaagccaaatgcggcggttcaacaagtgcatttctgaccgtctgcaggcagtgtccgtctgctgacatgactggtaaaggctgagacttcttcttcttaatataatgagcttgtctgaaaagagcagggagtaaaaaaggtagttgggaagtgtgtggcggtgacatacaatgtcatcattctggcacttcaggtgaaaggaattagaagacagggaagtggaagacagtgaaggagaaggctgataaaagactcctggctagcctactgcctggatcccgagtacaaatcagaagcaggagaggctgacctgatccccgaggaagggcccgcatctcagaggccctcatgggtgccgtggctcgacatcagtttggcatcaacctttaaggtcaacattctttttctgtcctccacggagtcctcatttatacatctgccttttggttctagtgtttaatttttttcaactgccctgaatctatatttccctgctactttttgggagtcatctataaatctttccttgtttcatccataactgtttcattgtctcctcatttaacaatgtggagatcagggtaaggaacttatatagaattaaataaacaattccaaatgctgtgggctcctctggaatcctcaacaatgatttgtttgtttgtttgtttgtttgttttaacactaaggcatttccttaaattagcatcagttagaaacttgttggaaaagaaaaattctcagatcctacctgaaaactgaataagactctcgggagacccagcaactgtaacttaacgctcttttaggtggtca

SEQ ID NO: 35169 - DNA, 1745 bp, Mus musculus
tggagacaggaacatccaagagttcaaagttaacctttaatggcaaaccaagttcaagactagggctataaaagcagcaataccaaaaagcctcagtttatatttctaatattcaaccatattgttatactatcctgacttcacgaagcccaagtttagtagaagtttcagtgttgtcacaggagtagtttaaagactcagtctaattgcagtctcccagcctttggaagtagagatgtagcatccaaaggtctcacccctcacagtctctctagagaggtctttgtcttctgcataaacagataattaagggccttatttccattgttgttttgcagtgtttcactacaactaaaggttggtgggttactaaagaattgtcatactctaattagatagctatggaacatttgtcagatagttaggccacatcggagatacatgattgattgactggaagcagtttcacttgaaaatgacttacgtaggacagtgaacagcaaacattctcatacataatcattaacagaactgcctcttggctgtagtgtagtagactaactggaaccttcaagggttattgagataaagttcagccctgcatgatgttagcagcgttcacacagttagtttcagttgacagtgttttattttgacattccattttgtatcatcatagctatctataagcttctctccaatgtaagttaaaagtatgtggtttcaagctttctatctaagaaaacaaactgattttaatattttgtttgcgtgaagtttatttttgagtaggttgaaaggaccaagatacttgagttactaaagggctattaccaatgttcatcctatatgcaggaggtgtacagtattttaaaagtgaatagggtggagattgcttttatttagaatgcattagccccatattatccagaagatactgctaacagtagtagcttaattaggcagtaagttgtcttaggttaaaaattgggaaaagtacaccttttgtttccatccaaaaaaatgatttttagatgacttcaactaaaattaatgcatctactaagaaactattttgtttttaattataattatcaaaatgatccaaatgaaaagacattctcaactatgtacagtactccaggaggaggtctaattgagtcagaagactgtaagtaccactttgagcgctctggagatcaacccacacaagtacagtgagtagattatctgagctataaatatattttttagtttcaatagctctgttttgaaatacttttttaatgcagataaaaaaaatcaggaaattaaccttatatggcacaaaccaaatacatagtagtatatggatgagtttctacatttaaagaactaagaagataggttcaggattgtattatagtacatgcacttacatgcagatacacatgctgattactttcaaggatgtgtgtgttggtttatcacaacaataaatttaaaagtaagatacaatgttacatttttagaccatattgaaacagcaagaagagacaggtcttaaaaagttattaagaaaactacttaatcccaccatgggatatttagaggtctaaatatagctcaattttaaaaagcaactgacctaaagggttaatgttgtaactgacacatttcaaattaaaattatgtttattttgtacagaaagcaatgttaaacacaagcagatctgttgtatgtaataagtgacagagtttttaaa

SEQ ID NO: 35170 - DNA, 1112 bp, Mus musculus
ttacccaggtataaattcttttttcaggattttttagatagtagtagaataaaaataattttaaaatgtcatactttatagtttaattttaaggaaaagattggttattttcaattattaaaagttaaaaataggccaaatcactttttatgcaatcatgttttatacagtggtctcattgcacattgtgttttttctgcactttttacggtatccttatcaagctggtatctcaatatacactctaaagagaatctctcatttaatgattgtgccttgtattctattattttttgcatcattagtaaaattaagttgtctattgtaaatgataactatatgacttaggggaatgtatttctatatgtactgctgtgggaaaaggaaagcagttatttatttgtttatggtacattagttattttatatcttgaaaaccaacataaatgccatttctattgtttaaaattacttttttttttttggtaagttttaagaatgtagtattttctgagaactgatatggtacaaagatgtaaccaaatctttcagatactacatttttaaaaaggaaggatggggaaaatatatatcagcatgaccctgatgtagagaataaagtctttaattgaaccttggcaaaatatgtaattagattataattgtttccttgtttccaatacggataaatgttaactgtcagtcttgaagaagaatgaaaagtaatgcatttgggctttttagatcatttataatgaaatttgtacagaaaccctccagtgaaactaagtgaaccattttccagaccttgactggattgctgtgattttacagttaaaaaataatttcaaaatttttaggttttttgtacatttatttttttctaacaaatatattgaactatataattaaaattaagtagttactcttcataatgcagaaacggatgatgttatagaaaaatgagtcgatttcaccattactgaaaatgatagtgtgtacattggaaatttaagtcattaaagtaattagttacttttgaagggaatctatttgagaaatgtaatttcctgatgttatctgcattgtagtagaaaattagactaaaatcc

SEQ ID NO: 35171 - DNA, 1099 bp, Mus musculus
tctgtcttaagaatttttccccaggggacaataagataggtgagcaggtaactgtgcctatccttccggcaacctcattcctatcctaagaacccgtgttaggctaggagagagctccctcctcctcatccacgtgaacacctaacaaataagtcaatcagcaaataattttgaaaataaaaaatgtttaggtaatcgcagaaatttgtcaaatttctttctattactctgtcattacatagaagtatgctagtcccgttaccaactagttggaggactagacaataacaaaaagcccgttatatattaagtgtactgtttttcttttccaggagagtgtaagaacaatgttcttataccaggaaccattcaagtaaatggccatggaggacaaccatcaaaactcgtgaagagaggacctgggaggaagcccaaggtagaagttaacaccagcagtggtgaagtgacacacaagaaaagaggtagaaagcccaagaatctgcagtgtgcaaagcaggaaaactctgagcaaaataacatgcatcccatcagggctgacgtgcttccttcttcaacatgcaacttcctttctgaaactaatgctgtcaaggaggatttgttacagaaaaagagtcgtggaggcagaaaacccaaaaggaagatgaaaactcacaacctagattcagaactcatagttcctacaaatgttaaagtgttaaggagaagtaaccggaaaaaaacagatgatcctatagatgaggaagaggagtttgaagaactcaaaggctctgagcctcacatgagaactagaaatcagggtcgaaggacagctttctataatgaggatgactcggaggaagaacagagacagctgttgttcgaggacacctccttgacatttggaacttctagtagaggacgagtccgaaagttgactgaaaaagcaaaggctaatttaattggttggtaacttgaagcaaaatattgcattttaaaaaatctgtaacgcaggtacagttaaggagtaagtagaactaaggtctctgcttccttgctgctatgacggattagggaatgttacaatttgacttgggaaaat

SEQ ID NO: 35172 - DNA, 1228 bp, Mus musculus
tttatatatgtttactggtttcaaaaaccaagtctttttctctgaatagtgattttttagctgttgtcataattttagctgaaggtcagtgattgtaaacttgttcattacactttcagcttttaatagtttccccagattaccatgtaccattgcaaaataacatattaggaaccatatttgttttacaattaaattacatattattattgctgtaattcatgttcctttataagattggaggtagtggtgattgtagatggtaggtgtagaccattgatgactgtgatttactacctatatctatgtctcttgtttgtagctacacaatccttaattagtgcatgatttaataaaataaagaatttcagaacaagaacagtactattagttttcaatgtctaaactgtagttgttgatatgtggaggtgacactttttttatattaacattttgaattattacttatgggattaattctatcaatgtttctattctaatttcaagggttctgatgattgtcttgtgaaaatctgggccacagacgatggaagattgctagctactttaagaggacatgctgctgaaatatcagacatggctgtaaactatgagaatactatgatagcagctggaagttgtgataaaatgattcgtgtctggtgtcttcgaacctgtgcacctttggctgttcttcagggacatagtgcatctattacatcactacaggtagctgttgtaaattgtattaaaccttttatattttaagaatttaattatgtgttaggatgtcacttttgtggtgtaatagctaaggtttaaaacagaagagtacttttttaagaactgtatgaactcgcagtgccatggccattgtgcctttgttagcgtagtgtttgtggtcactgttagcttctgtgagtttggttttattatttggactgcctctgttcttgtaaagaatgtttcccctatgattgcttttcagttctcaccattgtgcagtggctcaaagagatacctgtcttctacaggggcggacggcactatttgcttttggctttgggatgctggaacccttaaaataaagtcagttgcgtttttactttataaaatacatgcttaatggttgaaagtgtaaaaaacatcaaatcaacaaagagaaacatttaatttttttcttgtataaataatgaaaataagcttagaattttaaaatctgatcttt

SEQ ID NO: 35173 - DNA, 1201 bp, Mus musculus
ggatttttgttttttgattttccttaaaaaacattctgtgagacatggtatttgagtattattagttgatgaagaaaaatcaccactatccaaatttaactgcttttgtaaggaaatctttaaaaagtatagaatgcactctggctaaagagtaaagatgtttgagttttaattctagtttcatgctgtattttgactttggacatactatttagctgcatttgattatttatgagaacaatgaggaaagtacagttatttcaaggaacttaattatttgtattgtttattttgaaaactttaaactaggagccatatagaagtcatcctttttttttccttttcctttttctttttttaaaaccagcatgtgataaatgaaaaaaaaaaatgagttctagaagtctgaatttaagaaacctattttgttctggagtccatttatattcccccattttcttggtagcggatactctgttttcaaggaagctgaatgggaaatacagacttgaacgacttgttccaactgcagtttatcagcacatgaagatgcataagcgaattcttggacacttatcatcggtgtactgtgtaacttttgatcgaactggcaggcggatatttactgtaagtcatttttaaagtcttacctttactgatagaattgaagaaacagtgtctgtatgagaacttgaagtaaaaattttttcttttaatgataaaatttaaatttgggtaattttaaaagcatgctctaacaagtttctgcttaaatttgaactttttccaagttctaaatttagtcctgttatagtgtaatcacagtaacattatgtcctatgtcctgcacacacaaattcctcactattatatcaaattggctggtggggctttcataaaatgcgatgtagttttcagtctagactgaacatgggcaaattgtagaacagtatttattatctgcagagaaccacttgctagcctcagagagttctctttaaacagtgatgggaatcttgtgcatagctgacagtcttttctcaggattttgtcacccttgacactgaattctttaaaatacctgatgattttaaagagttgctttgagagttgcttgcatttggtttctcctaacctacagggaaaaggagcaggacttttcagctttaagtgagaaaaatattttgaaagtattttgaat

SEQ ID NO: 35174 - DNA, 1221 bp, Mus musculus
cttgacttatgaagctttttgtgtaattcttgggattatcattacttcctgtctgaaatttcagctgctttgcttctcttttttagttaatattaatcttttacagtatttactaaatctgttggttttaagtagaacaactaaacaacaaatctgcacatgtgaggagttcctggtcgctcttgagtatcctagtccttttactcacatacgtaaagtaaggaggaaagtcaggagtatttccatctctgttccccattacctctcttcatgattattaaatgattttgggattgtccttctaatactgttggagctgctgttcattatgtgatttgtcttgttctactctaggtggtgctgtagatacgaaccaaatcatgttaatgttttccacatgctgtctggccttaatgtctttcttaacagtaacctcagaataatttgtatgtgtatagtgatttagttgtttccttttaaatctttcttaatagaactatctctgacacttaactcactgagccaacccttccgagagtttttataaataaaacttaaatggaaggccttttagtttatcttctggcttacaaactagactctgtgatgggtaaaattcttttgttgttgcttttgtttttgagacatggtgtcctaatggagccctacgctagccttacacttgaactcctctgccttagtctcatgaacactgagattacaggtacagtccactttgcccaacaatatataaatcctttatatcagtttttagtccatttaaaattggcagtgggcattttctggagaataatatactttcatattctttaagatgtgtactttgtatgctttttataattaaagttaaatttcttgactctgaaatcttattttctatcaagctttaaatttaagctaaaaaaatgaatgcaattggttatataatagtgtgggatatttccttttagtcttgtttcctaatgttatactccggcaccatattgttgggatcattaaaatttacttttaagttttcttactgatgaggcctctagtctgttatgataaagatgacaaaaatatataccaagagtattgtgtagtgtctagaatgttggagagcactcagtacatattggccactatcacccattatttaaagatctgctgtgctgacatttttcagcattactgaacttcatctgctagtattttact

SEQ ID NO: 35175 - DNA, 1177 bp, Mus musculus
ctaaatatggcacaattaaacaaatagtgccgtaccataaagccacattgctaagaatgcttttttgttttgaaatgaacccaaaggagagttgttgcgtactatttttctgttttacagctaggtctcaccaaactagcacattggaagtttcacttcactggaatcttcctcgtttcttttccctctatttttgatccaacatcagtgagcccaagtattgtttttctactaatggctaagtggaaattgagggtctgcagtaggattagagacctcaggtggcagacagcagtgggacttaggagctgtgtccttgtctgaggtgacagagccaagccactcttgaatggtgatggcaataaagttgggacttccttccttgtgagaatatccccgggcactgaagtatacactggacagttactcctgaggagtaatcactactcctcagttgcaggcctgcagccactcactgctgttctgctggccacttgcgtggatcacggtagagcacaggagacacggttgccttcatggcatccctccccgtggctgtaggaggctcgggcgctctgtccttcctctcctcttctgtacactcagtattctggtgaccaggtggaagattctctaccaaatacaggcaggagaagaaatgacaggccaacacagaataattttcaactcaattatgtttccggagtgatatgtttggaaattttaatacatatttttaagatttgaacttgtgctccaactcaggagacagcagtgtgatactcttgggtttacaggacagatgctgatgcagcctcacaaagaaggttcccgcctggctgaggagatgcaatagtttcctgttgaaaggcacaggtctccttccactcagttcaggacagctgcaggggcatttactgacttggtctggtctgttggagcagtactcaatcagctgaggagaaacactgtatgttacatgggtgactggagcagtgtgtccatttgttcatagtgtgcatcttacgcaaggcatacatactgattgggggaaagggttgccatggtacttgataagaccttccctggtcggtcctgattcacagccgtattgctgtcatcctcctggattgggttgttgtcatatttttggtaacagactcttcttaaagtgcta

SEQ ID NO: 35176 - DNA, 1219 bp, Mus musculus
agccaagtaggtcagaatcctaactctttcaagagacagatggggtggccacggctcaacagctccccagcaaactgaaagtggctgattttcttcggattattccttcctccttaacaaagaggaatatccttgaacatcaactgaatgaataccattggggacgtcattggaccaacattcgtttaaatgggtctccatgtcatcttaaccactcactattcagtgttgctacagctcagttctgaggcctgaccctcacctcatcagcccaccctaacaggctgccacataggaggaccctggcaagtgacaaggcaatgtcaacaattagaacgctcttccttacgaagaggggaaatcagtcgctatgtaatgtccatcaggctagtactgcaccaagaaacgcccctccaccccaaagtgtttctcctcttccatgcagcagtcctttgaacaatgaagtgacatttttttcttagtctgatcatttctttaaaaaaaagcattacactttccgatccgccatcgtgggtggagccgccgccacgatgcagatctttgtgaagacccttacggggaaaaccatcacgctcgaggttgaaccctcggacactatagaaaatgtaaaggccaagatccaggataaggaaggaattcctcctgatcagcagaggctgatctttgctggtaagcagctggaagatggccggactttgtctgactacaacattcaaaaggagtccacccttcatctggtgttgagacttcggggtggtgctaagaaaaggaagaagaagtcttacaccactcccaagaagaacaagcataagaggaagaaggttaagttggctgtgctgaaatactataaggtggatgaaaatggcaaaattagccgacttcgtcgagagtgtccttctgatgagtgtggtgctggagttttcatgggaagccactttgacaggcattactgtggcaagtgttgtctgacttactgcttcaacaaaccagaagacaagtagttgtgtatgcgttaataaaaagaaggaactcgtaaaaaaaaaagcattacattattacattattattacatgtatgtgttacacgtgtacaagcacatgtgccacgagcacatgtgggggtcagaggacaacctgtataagtcggttctcccctttggccacatgggtccctaggattgaactcaggtcatcagatt

SEQ ID NO: 35177 - DNA, 2943 bp, Mus musculus
gatatattttaagaagtgcaccggttacatatagtaagttaatagagtttgctctgtcagtatgcaaaggcgttttcagctcttgtagtttgcttacacacacatgcacatatatttttaaatgcagctccccaaagtaacagctgcttgttctattttgtgaagggattatatttttggaggaagaaaatgcttggttagatatattttgtgaaccgttggcgccagccctgcgaggacatttgcatagcacacacaggttctgcattcagctccagcatactgggaaggaaaaagagacaccacgatggctgcctagtgtcacttcccatgtcacgcacctttgtctctgacagttgacagtcttaggcttttcagaataacacagacacacattcttgcttgatgtaggagcacgtgtgagatttcagagcagcccagacaggaaggggctgtctagagcatggtcctcaatggttcttaagaagcaaagtccctgctccctctgggtgaacactggcaaacactgaggttactctcctgtatcctggcatatttagagttaatctcacacatagaaataatcttgaataggataaagggctgactgaaatctccacctagcctgcacgatgctaggcctttcactctgattctgaaaaggaaatgtttgagaaattgaaagatccatcaagcagccctctctgccacctgcaccccaagctttgctaaaggtgggctgttctgcagtcttttttaaatgctgaagctgagagcttgttgcagtcctgttgcaacaaggagaaaggcgaacacctttctttatgaatggaccaaatgattgatgcacaattttcttcccagggaaagcttgtcaggttgtgggcattagtgggctagttggtgttaagcccgatccacgtaaaattccatttgataaatcccagggagtttccagagttttgtgtgttgtgttgtgttttgttttgctttgtttccacctccagctggatattgtgcttgaatttgtgagtcttctgacaagacacatttctctttaaaatagagtgatttttaaattgtcttgtgaaatcaacccaggttaccttgagccgtttacttacatcaagtctactcttgccagtgtgtgccaacaaccagtttggcaaagtgaaatcttagcatgttttggatggtaggagcactaaccttacagtgttgaggagacaaagaaagctaccaagatttgtcacatatctttttaattgtccataccatacctactatgactgtgttagacacaccaccgaatagatggtgttcttagcatcactatcatagtttcacatcatttccttgccatggttcttctagggagcactggggagtcagccaagaaaaatgagattagaggtagtgacttgttttagtgtccagaagcccagtatggagtggaccacagtccccggacaagtgtgtgtagagcatgctggctcttgtatgattcccagtctgcctgtctgcctgacttctcttcctttccctctttctctttgttgttgtttgagacagtcttgctacggagacccaggactcacttctgcttctgcctcccaaatgctaggatcacatacttactgaaatcgtgttcttccaatttcctttaattagcttgcttttagattggctcgccgccatctctaaagcctaggaaagaagtgcagacttggctgtaatgccagcagctttcaggccatagtgtcgacttcctgcctgcttgtggacaaaggaagtatgctgctgatgcccagacagtgccatttgaatattaggtgaccgtgaaacaccatactgccaagtgtctgcaaaccagaagacagtttagttcaggaaatattttgccaaattcaggggctttattaaaatcaaagaggagaaagaggaaatattttgtccttagatgctaatatgttttaggctttctttttctgttttataaagttaacccagtatttacatttccatattgtgtgaattgaaccatctaaatatatttttcttttgttattgaaaggtaccaaaggctttttatgttttgtttggtttgtttgattttattgtagggtttgtttttttttttctagaaataccttttatatagactagtccccaagtgtctgggtctacttcagtctgtgtaattggtttttacctcagttcatttgtatttgtctctcaaggcattggtgaaatctcagattttatattctgctttaaaggggaataaattccagaaaacatgcattataaagctggagttgtttcttcccattctctctccttttccaacttttatcctggagttagcttggatccttcctgttgctctaggaagctgagtgtctgctcccatccgtgaaagggttagtgagttgctacagagctcccacagtgacacatgagaagaatgcatgtggttttgtctggacgcactgggaggagaacagagccctctctggccacccaggactgaggtggggatactcagcggttggcctaggtgtgtcatgtcctcttccaggcacactgaagccactagcggtttgtcccatactggctgcagaaaacaccagaggtggtcacaactcctctcacttgggcttcctgtgatccacatttggaagcagaagaaaacatttctgaaggcgagggctaaggctgaactcaccaagaaacagttgcagaactcaaaggccaagacagatggagggtgtgggagggctcagacacaacaagctctaagatggcagaaatatgaccgctcacaaaaccaaatcggccaagagccctgcctgcgtgtgacccagattccaaagggagggcttcctagttctagacatgtgggccagattagcattggctgtcttttctgccagcatgaat

SEQ ID NO: 35178 - DNA, 1984 bp, Mus musculus
tttacatgatcacagaaacataatttcatgaaaaaaaatttttttttcctaaatcactagttttcgattggttgcaaatcagttacctgacattttcttgttcagagacagaacaagaaaatacagttgaatttggacccatttactgacccttgtggtcaaacctttccacctctagtccgaatattcccttttggatgtaattaaatttgaaagctctgcaaaatctctgtagaatctagaggcctgttgaggacaatgttgatgttgttgttgatgatgatgatggtgttggtgaagataagaaagaataacagtaaaatcctgtcttgtgacccataggccaccacgatttacggcacaaatcactgtgggaaacaatatatctctctctatttttttgtaatgaggaaggtagcctttgaatactcctattattagcagaaatgaattatgagaattaagattattgtacgattgaaacatgaaagaaatcatgtctttgttagcaacatctaaggtagtcacatttacatgcacttagaactccgaggggggatggatttttttatcagggctttccttgttttgatttgtggctattgctgatttttttcgtacgtggacatacacctacctcttctgttggaaagaacatttaaaatgaaataaattttacttaaaaaaaaaatcaaggagtcctctaatgtaaattttaattttaactttccaatttactttttatttttttttatttttatttacaaatagctcaaccaaacatttctgtgatgttatccatctctttcaatgtgtctaattctgagcaatgcttgtgtccccttgtgactatgttgcaaaaaaaaaaaaatcttccttattaactagaaaagaagtgtaaacgcattttggtgcaatatcttgactccttggtgctaatgattgcaaaattcagtgcttgccgctacaaggtgttacttactaatacaagatgagaaaaattgagaccaagccagatctctcaagtccaatgtggtgtttacaaactatgtatctcatgtcattgaaacgggtgaccggaagactgcagaagagacgttgttccactttttttttttttttacacagattaatttgttatgggcgtcacagagagatcatatggaaagaggaaatgtgacaaaaattagcatgaatatttctaaatcttccaacttgtcaaatctgcatgtgtgggatgtctgctgtttgtacagactttcagaacattttgtaaattataaagtatttattgtgcgttgagattccattccccctcaaaggcatgcagtcaccaacattacgggaacagcagcacagggaatagtgctgtttaagaggagctacactttgtttcttgccagtgtgtaatgactagagatgtgtaaatctttgcgaacattctgtactggctccccagaccccttcactccctgctctccgatttcagcacaataaatacactacagctgtgggaaaagtgactctgtccgtcgttgatttgtttctgccttaatctatttccggatgcctacttcttacatagaaaagcaatggaagtcgatcttaggtctcagagtttctggttcacagtctgttatttttgtatgttttcatttgtttatttttgagacagagtcctgctatgtagttcaggctggctatgcactcactacccactgtcctctgcgtccagagtgctgagattataggagcatagtagaactaaaagcttgtttttaatggtagcactttattattatcattattattattattattattagtagtagtagtagtagttcagtttgctttcagacatgcaacatattctaaataattctgaggagactcttagagtaccataccttaatcactcagttcttataatgagtttatggaatatgactttaagtgcttaaatgacagcctctcctaatagttt

SEQ ID NO: 35179 - DNA, 1267 bp, Mus musculus
gtttcctcgtcatatttgatatgttgatatatatatacatatatatatccccacttatgtatatatatgaattttttagtaagttattttaaagaaaagtaagtgggcttgcagtgggcttgaaggtctgtgtgtgctatgctgattgtgctatagtataattctcttgtggaaaggttgagctgcatttctttatatttagaatatatcaccatcttcactaataatacactgaactaaaaagttgaaaaaacaggtttgtgtttttaatttcagactttgtatgaacgttataattgtggtgaaggtcaagattcttcgtcatccaagacttttgacaaaaagagagaaagaaagtgatgcacagctacgtacaaaccaagaacactagattgtttcctctgccatactcttgaatctctgaggaaatctaccagttggaaacaacctcacctggattttatcagttaaaaaaacaaacaaacaaaacttcagtagattatcctcaaaaggaagctgtaaagttaaccactcatagcactgtgtatattaaattatagagttgtgcttttcttttatgcttttctgtaaatctgctaatgttttacgtttagaacagtgaatgatagctggaatgttgaagagctctgtaaataaagcgtcaccacagttccagaactgtacagtggtcagtttcttcaatcaaatgtgttcttggcatgatagcaaaatttttagaaaaacgggattaagaatagaccgtagtaaataaagtttaacaattaaatttccaaaggatttaggactgtaaacaggctcacacctttagtcccagcacttgggaggcagaggcaggcagatttctgagttcgaggccagcctggtctacagagtgagttccaggacagccagggctacacagagaaaccctgtcttggcggggaggggccggggagggggggagatccaaaggatgtaggaggcagagacaggtggatctctgtgattctgaagccagcctggtctacagaactagttctaggatagccaaggctatacagacactttctccccaccaccatcctgccctcaaaaaaattgtaaataaatttcctaattgtgtacagccatgataccatctatagtatttggtctgcaagtggctttttcagttctccctttgactcttcaaagtacatatggggtttggtgttctaaatattgtgctggagtttgtgatttaatgtctatagttaatacatgccat

SEQ ID NO: 35180 - DNA, 1222 bp, Mus musculus
gtaagaccattaggtgatttttgctgcacctcgactttaaattcctagtggatttgaaggccgaaatctctacttactattttttgatatgatctaaatcaggataagcaaaatcaattttaaagatttaaatatatttactatttcaaaataagagtgaaggcctttcccgaattctagattttttcggaaactcgaaaccaacgcctgtctttgcaatgaccatattgcacttacagactatgagaaacacagcctaaaacgaaaacgctactgaaaaatgcaccgcaaaaatgacactgcgaaagaacacaggcagtcgcgttgtgacaccccaagtcctgcagctgattttggggtgggacccagggaccacatctcaggctgcaggggccttggtatggcttccgtctgggcgggccgccaggtcatagcgtctccatccccgcccccgaacttccgtctccgattggtctctttcacggacccgcccctcgaggctgcccaatgaggaagcctgcgtcttagctcctccctccctgccggcagcgtgggctgcggtgcctgagaactggggatggcggcggtggctgcgcgcgcgggtgggctgctgtggctccgggctgcgggagcagagcggcggcggtgcggactgcgctgcgctgcgctggtgcaaggcttcctgcaacccgggggcgaggacacggcccagaagcggcgggtggcccacttcactttccatccggacccagagtccctgcagtatggtgagatttggggatcttgctgcatcccggctctatccttgccttgccctagactctagactctactctagagcctccttggttcgggtcagtttgcgttcctgttactcgtccttggtgattcttcccttcagatgcagcccctggaacttcaagataggtgagagggcactctgccttctgctagggcctgagggtgtagaggagttgtccaaagagcgctcccccgcccccttcccctgagttctatccatgctttccccatatcaggtcttaggtgttagcttgtcctagactgagtcactaacttgaggcaactgtctgtaaaacacttgccttttaattttcatttgaaaatgtaaacctagggagtaaatactagaatttgattttctcaaggtcacgagacaggttctgcctaaagatgggaaagaatccagacttctatttcagcc

SEQ ID NO: 35181 - DNA, 1652 bp, Mus musculus
agtgttgtgtctgtgtgacatttcagttgctccagaggaaaccagaagaccactactgtatcctgataatctgttctacttaaaaatgaggcaaatcttttcttttctcccaggtcgaggagcatgcaatacaagacttgctggttttctatgaggcatttggcaaccccgaggagtttgtcgtcgttgaaagggcaccacaggggcctctggcagtgcctatgtggaacaagcatggctgctagctccctggagagggtgctgctccccgaatgtggttgctccacccacatgaagaaaacgcatgtgcaagcgttcttacagatttgttagcacattgttgtagtcagagcaagaatggatatgatttttttttcctgtagtttataatgtttgtatgactaatgagaaatttatcagaattgtgattttagaactttcatgtgaaaatgtgtcaggaaaaatgttaggctaaggttggttggattgtttcttctaaattacctaagaaaaatgtgagtgaaagatgaagcttaggaataattcatgaaacatacatttttcacttgagactgtggggtgattattctagaagagcttgccgcataagatgttatgttaaataagacgttgatgaacttaaggcaggagcctcaatcattacttctgatcactgatggccagaatgttgtgtttgcctgaggagatgtgtctctgttgttgctttgtcactgggctgctaacttcttaggcctctttacagttgctggacagtttatggccatagcgtctgtgggatatttggattcgtagattttcttttgttgggctgggaaggtagcaagagaggacagacctttgaattcctaattgtgaaagaatcggtttcttaaggtttctacaaacaagcgtaagattactgaagagtttaccacagtggttgtttataattactttttagtctgtgtaatcagaatttctgtgagcctgcattatatgtatacatggacattttgattattcctttatagtatgctgtttggtttgattttgaatgtttaaaattaaaggaaaaaaaatttaaaatgtgtgtttcagtctgtagagcaaatgagaatgtgaatgcttaagttctgggaaagaatccatggcgataggttggcagcttgacttgagctgatgggaaattgttgaaagtaacaaactcagtgtttcagttcagttccacccacaagcagcagacgtgcaataaaagtaaagtcaatccacttcctctagcgtgtgtttgatttcatgtgtagcactagacacctggagggaagaatttctagctatctgtaattatttccccaatgggccacactgatggtcagttgtatatttttactctgctaaaaattccacttatagaatataaatttttttctatatatttgagtaatttgagaagaaatgaatttcacgacgtctctgtgatatcagtaaagaagctttccaaagtccttgacttgttggaagggttgatactctgaagacactgtaaatggcggttttcttcttgtcctccattctgcctgtgaagtgccctctggaatccctgtggcagttggatgacaggagtgtaagctggggctgacagcatggggctcttg

SEQ ID NO: 35182 - DNA, 1143 bp, Mus musculus
gtagactgattgatatatatatatttttttttcacttgtgtgagtaactatgactttagttttatttgcttagtttcttttttttttctccacttctaaaattaattatgtaagaaaggaaaaacttgggaactattcttatttttattgtttttagtatgttgtttaaccttatgcaaaaacaaatagaaacacactaaaggttgacagaatatttaacattttttgggtgatattcttgtattttacaaaatgccagaattgaatgtttctaagtttagtttaagtaaaccgtttcttttcaagggcgtcagcttctgatatatttccttgttctcttcatagtagtaattatctttgcttcatttccagcctttatgagattccagttgtgtcttcatcatctttttttgaagaatttggcaagctcctgagggagacagatgaaatggacagcttccacgatgtgacctttcaagttggcaatagacacttccccgcacataaatacattttggccgtgcgctctgacttcttccagaagttgtttctttcagatggctcttctttagagctgacggatgtttaccagaaagacgaagatgctgctggctgccatctctttgtggtggagaaagtccatcctgacttgttcgaatacctcttacagttcatgtacacagatacctgtgacttgttaactcatggcttcaaaccaagaatgatcgtgaagagaaaggcagaagactgtgagggctccccagattctcatctgcacactgtgaattgccatgtggatgataaacagaagtcagcatttgaggtgtacagaagcaaccaggcccacacacttagtgaacggcagaagagcaaacccaaatcttctaagaagggaaaaggtgttggggacgacgaccctgtaaggatgttgcaaagtgttgctaagaagtttggcctcagtaatttgagtagcaggtacagttcctcatcctgagctccctcctgagcccgcctcagccctcctgagccctctcagccctcccttgaagcattgttgtctcttgtgtttcctttcactctcctggcttcccttttcctctctctgcctctggggtagtagtacatggatgggacctttccctc

SEQ ID NO: 35183 - DNA, 1099 bp, Mus musculus
aaaattttttttataggtgccatatctacctggaaccattttatactttgttttatagactgaatttgactatttattagtcatatttttattgcatgttctcattactcttcttgaggatagggacattttgccctgactcagtagtagcacagtgtggtcatttgggctccgtgcctgcagagaatggagggagcgtgtggtgacacttgggttcatacagggttaatataggtaggcatgccgttctgaaagttaacttgggctgcagtgtggaaggtgtgtttgtcggaagaagatatggctgatactgaaaattctctgtgtatgtagtaagtacacagagcgtaatgctgtgttgaagatggagaggttctaaattcttcagaagaacttcatgtgtatgaaagatacttttatgtttttaaataatttttattccagttactctaatttcattgcagccttgattaatgatagttcgtttattttctttttagcagacattttaccaaacctccatcattcctcatcagatgtgtcttgtgtccctgatacaaatagtgtgtatgaaagaattcgacttgagaaacttccttttgcccatagagctgttagtgtcagcacagatccaagtgggtgcaactttgcaatcctacagtcagaccctaaaacaaggtataattgtctttaatatattctatttttagaaggaataatcattagaccttcttttgttttcagtagctcctgatgcatattcaattgaggagctgttagtaagatctgtagagacgttcagcaaatgagtatgttacagggcaatcactgggatagtgtgtcttcccctagtgtgtacctgaaaacactgaagatggtgcatatgcccacacagcatctgtctttagcccatgctgtacttgagagtcccgggctctgaaggatgtagtataaatactttttaggtagtgtgtaaaagtttctgacttttgaatatgataattgacaaaaaagaggtggtatggtcacagaaaatatattaggagatatattaggggagagagaagaggaacattagtggcattggtggagagggagg

SEQ ID NO: 35184 - DNA, 1166 bp, Mus musculus
tgggtgtcttctcagggcacaggcctgtcatgtgtgtatgcagtatctatgtgtgtcttctcagggaacatgtctcccaggcatgcatgcagtgtcagactatgtcttgtcagggtacagagaccagccatacctgcatgcagtgactcagggcataggcccttcatgtgtccatgcagtgttcatgaagaggatggttactaagtctctgtcacattagagtggctgattttcgagtagggagcaaagggagacttctctgcctgtttatattttgtaaaacattgtctatatgaggcatatattactttcataattgggggaaattgacattgcaagcatgtggctaatgagcttccttcatctttcatgctgatttaattaagaaaatgttgccttttgtatagtgaaataaaaagatgctgttttcttctttccactaggaaactcctcagggtgctccccctgcccagtgagaactggagcgctctggtcggagagtggtgctgccatcccgacccctttgctaataggcctcttcatccgagagaaaatgactgttttattggggactctttcttcttagtgaatttgaaaagtgatttggagcaggtaagagttgcactgaaaaaaaaaaaatcttttcaaaatacatgcttaagaggctgatttagataccagtttccctgcttttaattcagggtttgttgaagagcttgttcttaaaaagcccaaattcattatttttaactgcttccttccattctccagctcttcggataaagtaagaactttaaactcaagcagctagtagaatctggaagaacattcctgcatggatttgagtgtgctatcatttcccataccaaatgccctgctttctggacattataatcatctgtgcattttaatctcaaaagtcttagtaaaagtgcaggagtattagctcaggatatccactttgcgattatcttactgtgtttgcccaaggcctagactttttttttttttttaaagatttatttatttattacatgtaagtacactatagctgtcttcagacactccagaagagggagtcagatcttgttacagatggttgtgagccaccatgtggttgctgggatttgaactctggacctttggaagagcagtcgggtgctctt

SEQ ID NO: 35185 - DNA, 1131 bp, Mus musculus
attctaaggtaagattacatacaatgtgtattgcagcattaattgcaaagatgttcctaaattatacttaaaatagtaggtcagttttttaaactaaataaaaccaaatttcaagctgagtttttctattatctaatcacagtgattatcattttagtgacaaataatttggttagcttttttgttttttctttttaaaatcatggttctaactcctccttgggcagggtgttcacatctaatagcccagacttgccttgaactcctgatcatcctgcctcagcttacagaacgctaaatatgcactactgtgctcactgacagctattaacattgttaaaggcatccctacaattaccgaactaaatgtgttatctagctattaatgtcgatatgttttattttacttgtaaaatgcttacattgttttagaacttgagacaacaaatcctggaattactgggacccatttcaatgaatcatggtgttcatttcatggctgccattgcatttgtatggaatgaaagaagacagaacaaaaccccttccagaacaaaggtattatattcataattaaacatgcaatacttttttttccacttagtaaaaccatgcctatttatttcattttctacgtgctgattttttaattctttataggttatactgcagaacaaaggtattatattcataattaaacatgcaatacttttttttccacttagtaaaaccatgcctatttatttcattttctacgtgctgattttttaattctttataggttatactggagaaataaaatcttgtctacagctctacataatgactttttgtctaaaatttttattaaaatgtgatatcaagtatgaaagattccatttaagactggaagaatggctcagttctggagcactggccttgcatgcacaaggccatatgttcaacctcagcactgaaaaaaaaaggtgtgagtgagtgagatagaaaaattagctatgacatctggcctgtcactgtagtcgaaggaggattataatattgcatatttttaatctagtgatgggtagaaagcaaagattagagaaagtttttatctttgtttttttattatctgatgtcttttaagttgtt

SEQ ID NO: 35186 - DNA, 1752 bp, Mus musculus
aaacaaagaagaatttgtctcctcccagatgtacagcactaattatgaccagatcctacctgattgttatccgtggcctgcagaagtccagaaaatacagaccaaagtcaaccagtaacgcaacagctaggatttttaactttattagtaaaatcttgaagttttcatgatctttaagggtcagaatcttttatgatgattcatagtgtgcttagaataaggtgattttagtttaataacaaactcatgggagtctattaggataaattaggataaatttcacaccagacggttttgtttcacttactgtggatatttatgttttctcttgtgattattctctttatgaattctgtttaaaagctactgtacctgctgctgagaaagtcctcactgatatgtaggaagctaatggaagacccacactagtaataaattaatatagcataacttgattacatttaatgcctacagttctttcttgactattttgctaaaatctcttaaacagaaaagataaacacaaacttgggtatagctgaacttttactaaacagaagcactactttgttgcctagagaaaaatcttctcaggacttttattccaggcctccgttagctttgttctctttgtacacctgactcaacacctctgagaaagctcactgctgtttacagtaccctgcgtagccttagctcatcagcgtcttctgtcgttgttatgttatatcccatagagtagagctctcgttcccaaacactccatagaaacaccctttctcatctctgagcaacccctggccctgctgagatactcgggtgtttttgttagtgtagcctgggcagtgagaagggctgcaggagggtccttgagacggggccctgggaacccacctctgagacaagggagtcagatgccagacagtggttcccagacaagctcaggctccatgaagatcacctgctctaatgtccctgtgcttagttcggaggactgagagctcatggcatgagtaaatacatctctaatgcctacctttctatcagatattaaaatatgttaattaccaaaaccattctctgagaaaaaaaaaccaagcctttcccaggtggtattaatttactggacacgttgataatggcatgactagaaacagccttaactcctaagctcaggttcaagaacattctgtgtatctagagactcctgactttgaagttgctttaaagcctgtgtgggtttgcggcgggcagctctgtacagtgagctccttgaaggtgagggtgcagaagctttcaggtgtgagctaaaagggtacagacttcctaatgacaacttgtgactaacggtttcttcagtgtagttatttgagaaagattcagaatttctatcttttcttgtatgtttccatgttgtcaggtagttgtaaatgaatgtatttacctatgcaaaagatttattaaagcctagagaatatgaataataccgtaaatgtcatttttttcttaaaatatcatcgctgcacttgataacgatagtgttgagttttaggagatcatatgaaaagctattaatatttttaaataatttttttgttttgtttttaaattttatgtgtatgtgtgtctgcatgtgctttttttgccctggttttctctggtgcccacagaggtcggaagagggtgtcagatcccctggagctagaagtacaggtggttgtaaaccccccaatgtgggtgctgggaactgaa

SEQ ID NO: 35187 - DNA, 1179 bp, Mus musculus
agggaagtttctttggtaagtggtaagaactacactgacctgtggatagaaggacaaatatttactacacttacctatgggcagaaggataaatatttactacactgacctgtgggtagaaggaagggtaaatatttagagtgcatttaggaattatggtttataaattgcagttgttcttctataagatctaagaccccactattccctggcttcatttctagtattagatatgatttccttccagttaagtgggccttaaatctaattacagagctgttggttactcatcaggtttgtgggacaaggtaccctagggatattgtaccatgatggccaccgttacggtttataaccgttacagctgggtaagactgttgcttgcctccctcccttagaagcttgcatagcgccttcccatacctctcaagccacatctcatttgagtctaccgggttttatgtctgaagtgcatggtgtcaggaacattcttaataaagatgccatacgtagaagaataaagacatggtgcatttgggctttggggaggaattagcacaaccaggattgcgtaaggatggtaggagataacctgagccggagagttgaatcaggtccctgggagtcctgcagtttgtttcctgacctagttcagagttacaagtgcagcaggtgtcagctgacctacttctactcacatttaaaaatagagaactattcatttgtatattttctaacattaaggattgcatctttcatttttgtgtgcacataatgtgctctatgtacgtgtgtgtttgtgtatgtggattcgcatgcacatgtgtgcacatgcatggggaggccagaggaagactaggtgtgtttattgatcatttcaagcttatgtttttgacacagggtctctcactagcaccagagcttactgattgtctggccagctggggacccacctgtctcccgtgccctagcgcagggcagacttctgtgtagtactgggcatcatagttcagggcctgctgtttgcacagcagacactttattggctgagtgctctatctcccaggcctctcgtttttgtgcttttaggtccattttaggtcattgctcctgtccattctccactcccgtcctagtgtctgcggctaaggaagcagatggttagtgcacagttggccg

SEQ ID NO: 35188 - DNA, 1150 bp, Mus musculus
gacaaaaggctcttattttatcatagttttgttttgtgaaataaaggcttttgctacacacattacaaagaactctggagttaatctcatgtctgctgcatgttgcacaaaagtcacttctccagctcttccccttcctcaccaagctgtgaagcaagaatactcttaagtcatttccctggcactgaacatttgcacagctgctgtcacttcctgtgcagcagagcatagctatacagccgttatgttgcttgatgtattgtaactagtctaggggtaatttaaagtgtcttgggatatgaacatgcacaggacacatatatactgccattttatgagggtcacaaggatctgtagactttggtgtccatgggtaggtctagatccaagccctctcagtacgagctcgataactagctgtagtccaaacgtaccctcctcatttcatgagcacttgtcaatttgtataataaaggtttagaagcctatactttaaaaccaaatggctgcccttcctgttggcaccagcactggggcaccttgggctcggagtcagcagacacccccaaggtcccctagaggactctccactcggtcttaggaccaccagtgagtggaacacaacttctgttccaatcaaattgcgcgggacctaagacagcattagggaagcaggaaacctggcctgaccagggtcacaagtcccttcaggttggcgccagcatcggggcaccttgggcgtggagtcggcggacacccccaaggtcccctagaggactctccacgagatcttaggaccaccggtgagtagaacacaacttctgttcaaatccaatcgcacaggacctgagacagcattagaggagcaggaaacctggactgaccagagtcacaagtcccttccagtcggtgccagcacttcgtcatctgggcacagagtcggtggaaacccccaaggtccctagaggacagcatctgagacagacctcatttcaggctccagacatccgggcaccttccctgccagaggagaggtgtccaccctgccctggaggggtttgctggaacacctgggggagccatcttggttcccggatccctctgagactagtctgtgcaggtgagagtgtggactacaaaagctaacagc

SEQ ID NO: 35189 - DNA, 1182 bp, Mus musculus
ttacatcatatatatgtgtgtacatatataaaactgtcttgagaagttgaagtttaaagtagtgttgttttaatgatgtttaatgattgttttcctccagaggtgtttatttttccatctgtttctgtcatttagtgtttccaatgctgtgaataattttaagatacttgctttgtgacgtgaaaattactaaccatggctcactatttcaaagtagaccttgatgaagaatttgaacggtttatgaaggaggtaagctcaagctgtatttattgtaatatttattgtaaattcatcttgtaagatccatccttgagtgctttcttctgaaaacataaaccaccccatcagctcatcccttctacctgcacctacagaattatccagccgtcctcagttcgactcatttcaaatgctgctgcctgttagctcaatgccatcttctcacccagtctacccagcggtcccagtgaatgcagcattccctccaaggtgcatgtgtgcacgcgctcacatgcaaacacaaacacatgcacacacacacacacacacacacagagagagagagagggagagggaaagggacggagagagagagaaagagaaccatgttgaacaaatattttgctcaatttctggttataagggagtggttcaacctaatttttttttaaagttaattttcttcagttacaattcataaaccattcagttcacccacttaaagtttgtatgacaactgttttagaattatataaccttcaccatagtcagttgcagaatgcctgtatcattcctaaaaggaaacccttatcctttaaccattactcttggctctttgtccttccagccttgggttatcccttactgctttgtctccaagtttggctgttgcagatattcatagaaatggaaccatttaggatgtgtggtctctgaagtctggcttcttttacttagcatggtgttttcagagagtggtttgccattttgtggatataatgcttatatgttgtcagttgacagcatttgggatccttccattttggacagtcatgaataatgttgctcttaataatcacgcaagtgtgagtgtggatgtatgtgaatctcttctcaatatttgcctacacatgaaattggctagtcgtatgctctgttattcccaccaaccatgtattc

SEQ ID NO: 35190 - DNA, 1209 bp, Mus musculus
tggagctcagcaaaccaatacatccctctttacatgtcctttcacttgcttgctttagcgaaacatcctttcatctctgccagcttcagcaaaatgttccctcacctgtttgcttttaacaaaacatcctttcacctttgtccaactcaggaaaacatttcttctcgtgtttgccccagcaaaacaccatccgacacaactgactttctaaagaacccttaagtttccacttcatgcctggatctaaacgtgggtttatataaggctggggatggagctcagatgataaagtgcttgtctagcattcgtgagtcctgagttcagtccctcgcacagagcaaaaagccaaggtcaggtttaaaccttgctagttggactccacacctcagtacttcataatactgccttggaagttattcaatgtgagcactctaaagcctaatgtgtcagcattctattcctgcctccattgtctcccacctctataaacctaacactgactgcctagtctctctgaacctccatttatgcaatttgatcatcacataggattatcgtaaaataaaaatgagtattgcaaattgtatcattcctgactatatagaactttgtgggtggtataaaataaattttatacttctattttgcaaaaaaaataaataaataaataaataaaataaaaatgagatagcctatccagacaaatcacaatttaaaagtaaatcagggtcagtactgtgatgatatcagccctttgcagctaaatctgcagcgtcagttcaaccccagcctagcatggtggcacactcctttaatttcagcatttgggaggcagatgcagggggatttctgagttggaggccagcctggtcttcagggggagttccaagtcagccaaggttacacagggaaaccctgcctcaaaaagtcaaaacagcaacaaaaatcaattcatcctcaaacaaaaccttggtttttttttttcaattttaactttaagattataatatagtcacatcatttttccctttcttttctctaaaccctcccatatacctacccttgctcttgttcaaattcatggcaactttttacattaattgttattacatgtatatgtatccctagatataacttgctcagactgtagactgttcacttgtgtgtacaagagttcaggactgactattggcatttgataaccaattg

SEQ ID NO: 35191 - DNA, 1050 bp, Mus musculus
tactgattattgttaaacttttactgattgatgcatatctgacaaagtatatacattttctcatgatagattaggaataccacaaatggattgatggggcgatatgtgctatataattgtatataagatatttgaaaagatgtatttagtattagaatgaacaacaaactacatgggaaaattatctttagtacacttttttgaaatttttggtcagaaacaccaaaaacatactgttttgatgtcattatttgatggggagaaattaaaatatagaagggcttcatgcattaggaaaaggtagtcctagagtaaatggttgctcaggttcctaaaaattccaataataccctccgtgactgttttctccccacatataaatacaataaacaggaattcagtggtgggtatcaagttaatgaataaacaacttactttaagaatacactaacagacttcttgggatgtttttatggtgtagtatttactagtaatcttaccactcagtagggcatgccactaaagatgccatttatgaaccatggctcacacaggcatttttaaaaaactgagccaatatatagatggacttttggggtctgtcactttttaaaagttcttaagacataaaccatattagcaccacagtctgccttcaataatgtacctggaatgtttttcaggaccagaagcattcagttggacaaacttttttaaatgcaaatcagtattactctgggtcaaagatttaagtttttaacagtagtctggtaaacatttagaagtctgacaatgagaaacaaaagcttgtacccaagtagaatttaattaaattagtttttagcttatgtaaattcttttacatttatttatccatagaatttatatttatttcgttccttttgtctcactgaaagctgtctgcaggctctttgatttggattagatgtgtgaagtactgtctttcgccaaaaacctcaaatttcctgtttttttcccaaagtagtgggtttgtgcttgtttggagatcagttcaaaaactatctgtac

SEQ ID NO: 35192 - DNA, 2832 bp, Mus musculus
tgtgttccaaaaaaatccttcataacttctagcatggtatcttaataaagaataaagttgttctctttaaaaaatctgctctaagtagatttttcccctcttttttaattaaggatctcagcagtggtattctgaaatattctcttgaatttgtgcatttaaattttattgcagtgatacagatgccactgttggtacccttaaatttttatttctgctcaccaaggttaatcatgattgtctatatcttttttatagtaatcacttttgaattgtgttcagatgcagtttcaggtgtaatcatcagagctggttagtcaggcattccagatagtggttcttttcagaaccttttttaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaaaaagtgcatccgaacttgtactaaatactgcagtgtccctttataaaaagtcagactaaaactgacaattgtacagcaaagcctgacatttggatattttgaagttttttcataaatcatagaaattagtatatggctgtagtttagctttttaggtaaaaggtatgtttcattagtgcatttgttattgctgatcactataaaaatgtgaatcagctttccatttcttatgcaggtcatgataacttgtagaatagagtacaatcatttgtgctatgtttttaattttctaaagcaccttgatgacagtgagtgttcagtggtgaagcatcctctattgaatcaccctcaaaaaatttttttgccaagtcctaagttgatagcttaaagtcaaaagtaaaattatagtttaagtaggacttggtgtaaagaaacaccctcccccttccccaaagggatactgcagttctatcacacacccagtaggcaccacgatgacgatcagagctagacctgactaaggttttatacacaccagttccccagtaaatgcaaatttaacaagaaaattagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtatagaaaatcttctggtttaaaaacttagaattgcacacatttcagtatgttcatttgtacttacataattttagaatagtggttgccaatagcctgtatgtttcccattaattgttttttttttttcctttctttttttttgttaccttaataaaccattttagtatgttgtatgtcagttactggtatagctggggcatagagtgtaatttaaaatttgtcaataagtattcattggaatatatgtaaatgtgccttgccggttactgaaacttacctacaaaatgagtatggggtgacaaatttgttcctggtgcttaatgaaactttcttccactgattttatatattaccctgtgctttttaaaagtacatctctcaaatattagtgtaagtttgagggctacacaaaacatgtacatttcattctaacatactgagtatactaggtcgtggaaagtgggtcagttaattgtagccttcagcaaaatcaaatctcagtgtaatccttggtgctggcacttcccatgtccaaggagtaaaatgatcctatttaagaggtcattgccatgcctattggcacttaactgtcataccatttttaacggacactgtcaaggtcttttagttaattcctggttttatttgttgggatatttgaacaggtttgttaaacctaactgcattgtcaaagaaagacgaacacttttgtgagtccacaaatgtgttctttaagaaaacattaaagtttggagctctttgggtttcaaagacttggcttttttaatttggggacgtgggatgaaaccttatgattcaaaggaaattgtgaagaattgatggttatatttaagggtaatgtaaacagtgataatgaaatgtagactcaagtgaaaatacttgacagtgttcattttaatgactttgaatttaagccattataattacttttaaaattaaatataatttgcactgttctgataatgggtgcagtttttgagcaatataatcagagctaaatatgcatgtagtgattagtgatgtgaacaattaagttctgagaagaaatactaaccgtggtattttaaaacttaaatttctgtagaaaaatcagtatcaaacacttaccagaagtcaagaaaaacaggcaatgcatataaacataattttgaatgttgtgtggcctataaagcaataatgcaatttatatggaatgtcatggatatgagaaatggaaatgcgaaaataactaatcctttagtaaaaatgtcaacatgttaaaaggggggatgttaactaatgtaggttattgcgtttgtgatttgtttatgggttcttggctttgacagcttcaaataatggacagatgagaagttaaattttgtatatattgtcaaggaaaggatctttaatagtcaagtcccttcc

SEQ ID NO: 35193 - DNA, 1751 bp, Mus musculus
cccaaagcatctgagagaattgataaatgaaagaaacatgcttaaaacatgaccgttttaaagggtgtgtattgaagcctagattttttcccttgtaagcatgcaaacataccgttgtgaagtaagaatccgggttcctggaaatgtattgtgaagtagtcctggccaaactactctggcctttgcaatttggagtgactgttgtgaatgcatggtgtacaaattgattgtacaaacagttgtgagacataccgggtcagaacagtgatgaaatacatcccgaagatgatgacctgaagataaatgcagcttctgagagaagaccattgtgtttaagtggtagtcttgttaatgcagttcttactcatagcatgtcatggtacctctttctgtagtgaatgctgaccagtgagatgccagcctgcgtgtgaagatcctacagcagaagtgcatgtgagtggtgctctgttttgttttctgctgagcttactgtcgttggtctagtctatgatgatcctatcccgaacctgaattcctgttgaaaaaccataattacggatctggcttctgagatggaccattgcaaaggactattgtgttcttctttaatgttggcaatgacgtaatgcctgtgtttttgtttttatattttagggccagtgacacaagaacttgcgagagatgccagtccgcctgtgaagatcctgcagcaggagtgcatgtgagtggtgctctgttttgttttctgctgagcttactgtcgttggtctagtctatgatgatcctatcccgaacctgaattcctgttgaaaaaccatacttacggatctggcttctgagatggaccattgcaaaggactattgtgttcttctttaatgttggcagtaacataatgcctgtgttcttatttttatattttagagccagtgacacaagacgtgcgaatgaaaactagatgtgaccatccagaaaaagcatagacaaaaaaatgcagtcttagtactgggatgtttgagatggggtctatctacatgtctctagctgtccctatcaggacagcatctggtgtggcctgcagagttgattcctgtacttttttttttttgtgggctgtatgtaaatggattgttttgacaatccattcgacagtgttctcttctgtgaaggtcataggtgagctgattgacagacacagctgtacagactgaatgcaatcctgactataaagctgcagttcatcattatgagctatttccttattctggcagtgattgaaataaaatggggagtattgaaataaaaaacattcaattgcaaatatttattcaattctttttgtgtcagaagattaaccagagtgccctggtacatggttcattccacttctgtgggaattgggtttgcaaagttactgtgcaaagcgcactgtcagctcccaaactagctagcatgatcatacacattatcaggtttccctgagaacttgtcaaaaaattccctccctacccatttcttaattgggggggggggttctagacagggtttcctagccctggctgtcctggaactctagaccatgctggccttgaactcagaaatccacctgcctccccagtgctgggacatttcttaattttgagacagtttctatgttctatgcttggtttgtctttattccacctgcctctgcttaccaagtactaatactaaatgggcttctacattaactgctgcacccttccattctcct

SEQ ID NO: 35194 - DNA, 1171 bp, Mus musculus
tcctgctgagtcttctcaaggctctatttccatcaagctagcaccaaggttcgttacaacatagctgtgtccggtaagtaaatgccagtcaagaaactcttttcagccgggtgtggtggcgcacgtctttaatcccagctctcaggaggcagaggcaggcggatttctgagttcgaggccagcctggtctacaaaatgagttccaggacagccagggctatacagagaaaccctgtttcgaaaaacaaaacaaaacaaaaaaaaacccaactcttttcaactcttttcaattttaggttgtcttcacatttgcctagttcctcttggtcaaatgaatcaaatggcaacccccatcttattcttgggaactaaacaagggtttggatacatggagatgccccatttgaaaacattactgtaacggtgccctatatgaagtgtgtattagccgggcgcggtggcgcacgcctgtagtcccagctactcgggaggctgagacaggaggatcgcttgagtccaggagttctgggctgtagtgcgctatgccgatcaggtgtccgcactaagttcggcatcaatatggtgacttctcaggagtggggaaccaccaggttgcctaaggaggggtggaccggcccaggtcggaaatgtgcattacttaaatttttttcctgtataagcatgggcaaaacccaaaatctttaaatctgcatatttcccatgaaaatgaattgtataaaagaagcagtaatgtagaggaagtgcccatatcgagccctttggatggattaatagaatattaaattttagtgttaatggtgggaaaatataatgactctgtttttttaaaaaagatttatttattttatttactattttatgtagctgtacagatagttgtgagccttcatgtggttgttgggaattgaatttttaggacctctgctcactctggtcaacccctctcgctctggtcagccctgctggctcctgcctaaagatttctttattattataaataagtacactgtagctgacttcagacgatcagaagagggtgtcagatttcattacgagtggttgtaagcaaccatgtggttgctggaatttgaactcaggacctttggaagagcagtcagtattcttaacagctgagccatcttgccagtct

SEQ ID NO: 35195 - DNA, 1181 bp, Mus musculus
agggctacacagagacacattgcaggggttgtctaagaagaaatgtaaggcttgctggccttttacccaggctgacaaagttaaaggcaaggcagtgttgcgaaatgatctgacctctttctgcagtcttttctgcttatttccttgccttctaatgggtctttcaatatatttacttgatatagtccaagttattatgtattttatatattaacaagtactagtctcccaaggagcccagagataagccatgtctctattctctttataaatacaggtacaggatgctgaagaaaaccaaaagcaacctaatataaataatgtaaatagaatataaatagaaaacacaagtgaaaattttctttattgcttgattactttggaagagggcctcactgtgtagacctggagctcacttagatcaagctggccttaggaatttatggcaatcccacttcccaactgtaaattacaggcaggtgtcagcatgctggcaaagaatccttcctgttagaggattatacagattgagtccaaaccaattgaacttcagggaacacacagttgggcctaagggactgcatgaataaagcatagtatagtttcagatgtatttgtgatagattgggatcttggtattagtgggatagaaaaacatggaatacaagataaggctgaatgctaagtacattatagtttttgaagacggattcaaattgcaatgtgttttcagtaagaaaatgtgatgagaagttagtgtgttcattgtgcattgaaggaggaatgtttgtatagggtgggaattaggggtgatatgtgtgtgagtgcgattgccctttcaggccagaagtgccgcagaccctctgggcccctgtgtctgcatagaacgagtctctagagtaggtgggcaaagcttaggatttgacaaacagacgcacacagagaggtgttgaatctgaatgtaatgtctggtcgagcattagactatttataatacagcgaattatcaggagctacaaatcactataagacaaggtacactgaaatttaccagatacaagagaatgaagtttgtagaaactagataaatgtttacaatagagattagcagccctgcctaggatcagcctagtgccaggcaagagtttcacactttagtgttaatagcaccagggggtttt

SEQ ID NO: 35196 - DNA, 1199 bp, Mus musculus
cagacttctccatgaaagcacatctctggattcagctgaaacccatcgtgtttcctggggaaaaaagagcttctccaggggaaaatactactgggaggtggatttgaaggactataggcggtggactgtaggagtctgtaaggatccctggttaagggggagaagctatgtggcgacacccacagatctatttcttgagtgtttgagaaaggacgatcattacattctcatcacccgcataggaggtgaacactatatagagaagccagttggccaagttggcgtgttccttgattgtgagggtggatatgtaagtttcgtggatgtagccaagagttccctcatactcagctactctcctggaactttccattgtgctgtcaggcctttcttctctgctgtctacacataatcataggaatccagtatgctagtgcttttctagtacttctatgataatgtgtcccctctttattgtgatggtttgtgtatgcttggccaggggagtggcactattagaatgtgtggcccggttggagttggtgagtcactgtgggtgtgagctttaagactctcatcttagctgtgtggaagtcagtcttccactagcagcgttcagatgaagatgtagaactctcatctgggtctttaccatgcctacctagatattgccatgatcccactttgataatggattgaacctctaaacctgaaggccagctctaattaaatgttgtcctttataagacttgccttggtcatggtgtctgttaatagcagtaaaaccctaactaagacatgttaaaatgatattaagggatggagagatggctcagaggttaagagcactgactcttggttaagggactgttcttctgaaggtcctgtgttcaaatccccacaaccacatggtggctcacacccatctgtaatgagatctgatgtcctcttctggtgtgtctgaagacagctacagtgtacttacatataataaataaataaatttaaaaaatataaaatgatattaaatgtaaaagatgggtgactgcttcttatctgtggtccacctgttcctcctagaacatttacttttttaaaaatattttatttattatgtgtaagtacattgcagctgtctttagacaccagaagagggcgtcatatctcactatggatggttgtgagtcaccatgtggttg

SEQ ID NO: 35197 - DNA, 1242 bp, Mus musculus
atatgtttacttatggtcttcaattaggtgactgaaacttaagccttagaatggaggacttgtcattgaaaatgaatgcatacatacatacacacatatacatgcatgcattcaaacatacatacatacatacatgtctgttgtcagaagtttagtcttttggtgctctattttagattgggcacttcaaataaggttgtttattcattccaaaaaagatattaggttacatcctttggagtccctgatcgaccccaaccctcttgtaagcaatgactctataccacactgtggcgtaaccattctgcccacaccacagattaaactatcaaagtatcagaaagagcagttttcaacttcttgctctgtggcttgctcaacatctgagatgtactcttcttggataataagtcttgtcaaatcccaacctgactccttcctttgacaggtgggattatggaggccagatgaaactgctgataaaatgaagctaatcacagtccattcattgtcactgccctagggaaaaaatctatttctaatgggccctatgtggatcatatgactgtaagcctaattcaagaatagaagtgaacggattctgtagaactttctaatatccttttcatttctggggaagtagtcaaagaaatccaatcttgctctaagtccaactcagtgttgtcccatactgaaagcacgatccagaccataaaggtcaaagtaagactggaggttttctctggaaagtggcgtcttcaagcaggtagcaccaagtctagtgctgatgaaccacacctttgctgtgcttatgaggtcatggaaacctggtctcaggatccataaaagatgatgtttatagttaagatatttttccttttgacaccaacctgattttcttatatcctcgacaccccctagttcccctaacccctcaagactcataatcaagcaagacaaagtttacttgacaaaaaagtatacaaccctcaatataataagtttccctcagctcctgttgcaatgcagcagccccaaggtaaaggtgactgactggccttctgtctttataaaatgtacatgtttcacacccaaatttaaagtcactgcatgttacaaattcactccatttttgttggcttgcctgccttccttccttccttccttccttccttccttccttccttccttccttccttcctccctcccttcctccctccctccctccctccctccctcccc

SEQ ID NO: 35198 - DNA, 1369 bp, Mus musculus
accttggctgctggattatgccctgcctgacttagggttagcaactgactactgttttcttcctgcctagatggaatctgcctgtgtaactattcacgaggctctgaagactgtgatcgactcccagacacactatcgactgcgggaggctcaggaccgagcccgagctgaagaccttaatagtcgagtgtcctactggtctgtaggcgagactattgccctgtttgtggtcagcttcagccaggtgctactgctgaaaagcttctttacagaaaagcgacctgttaacagagcggtccactcctagcctcgaagtccctcccacagtccctcacccctcccgggtctcaggttcctacagggctggtggtgtgacacagagaagagggagagcagcagggagaccaaaggcgcacatatctgatctttgcactccaacaacggaagctcacagagccccggtaatctgattgtattgtgtgtgtaacattggccaaaagtgtttacaggtcaacctagggtttggtcactacgggaggccagtgatctagcatccaatctgtaggagaactccaagtgcctggacctccagggcagtttagggttctgccactactccatgagacattggtcattaggtggttgtgtcttcttccatcttgagaaagggaccctgagttcttgccttcccttcgtggacctctctattcctgaggaaagctggtctaatctggaaacagtagggtcagacatacaaccaggacccaagtagagagtgagtgagtgcccttggtgatctatgtctcctggaggcagaactgtgctaataaaaaccaagactgagcattctggagtgatgtgtgcctctattttacttaaaggagcttctagcttgatgtggagcatgggtgtatatgtaaacagtgtgagagagaaagtggctggagctgtatgcagtgtggggtagagatgttgagaggagccagggaatcatgccccttccaagggagtgacaacaggaggaccccttcccatgccatccactcagcagcctgcgcatacatgctttcctctgtggcaacaggtaagccctatgtgcatgacccgctccctcatttcctgttaatcagacgccatctctcaatttaggtgacaccattgtatttgtcccaaagtccttctggttaggaaggacttaatgcacacttaggaagtatggtgggtctgggaggaagacagggtgtccatctaaaggagagctagcaaggaatgtggcaatccaagctgacagtatgagaaagagggcagatcagtcctttgagaagctggcttggaaaccttacttccttagctttacaaaggtaagttt

SEQ ID NO: 35199 - DNA, 1140 bp, Mus musculus
atcataaaccaaaagaccttacactgtaaaataccaagaaatgtaaaaggaagtttaactttgggcatatatgcagggacagaaaaagaagacaaatttgaatgaaaattcatctgccttcaatgtagataatgaaatatcacatatagtttcaagatatttaatcagaagacagaaatgattctctccactgttaggtaaaaggtttggaataaaggaacccccttacccgaaaaataaaaggtcccaaatttgatgctcaaggaattccagaaagcagccagcacatgccctggagcagaggtcacacaaagcaggcagtttgacttaaccctttgaggtttggagaaccaatttccccaaaaagcagtttgttgtgctcccccagccccacccccaccccaccccactggactatgaaatccgattcttagaccctacactgtgtcttcctgttccctcatactaaggcaagatttggagacaacctcttagagcaatgaaggtttgtctcactgttttcagttggaagaaaagatatttaaagaataattgaaaggaacaaaatggacgtagatcaataaagttattcccctattccaccagtatcaagaacaaaaccatagtgtggtacacccatatttaatgcagcttaatggggctgatggtccccctttagaaaagtcctctttagagctatgtgcggtggtgactttcagtcccaagacgacttttgaggccaagctgctttatatagcaataccaagttccatagactattttttctacacagtctacatagactgtctattttttttttaaaggcaaatgtgttttataaaaagaaaaaagccaaggattggtttggtggaggctcagtatggtgctggggaagggggtgcctctctgggcccatgctgaggcatcccagccacacaagtatagtatagaatagagtttacatagattatggggaggggaagggggagtagagatagaaaaagggagagacaggagaagtggctgtggagacagggaggggaatgggggagaggggactggaagagggggtaagaggaagaggagagtgagcaaggcaagcagctccttttgtagtgagtcaggcacacagggaacttt

SEQ ID NO: 35200 - DNA, 1184 bp, Mus musculus
gcactgtgaattgaagaaatcagctgtagtggtatgcattattctgattcttgttgggagagaaacattttaatttgaaaaagactgagacttccagaatatggatcatagatactgtgaattacttcttgaacttggtattgaaggaaagattggagtgttcgattatttatggccccttttctacagtggtaagcattccttcagagtccatttgcaatatagaaatgaactactgtttcacattttgcattcctttattgtaggtttagatttgaaatacgttagtagacaaccttgtacttaaatggacagtcttgaaaaagctatagacagtgaatattgttttagggtagttggaggcacctgtctctggtttaatagagaataacttgaggggcatttttgtttgttatataatcttgctggattatatattaatggtttggtttttaggggaggcagtcatctatgatcagcatctataaacgttttcacaatgaattaacaattttctttttaggtacctggcgaagaattctgcaaccttgttcagtgccagtgattatgaagtggcccctcctgagtaccaccggaaagccgtgtgagggcgtgctcgccctctctccctcgtgcttggatctctgtaaacagtttggttcttagtccttctcttgtacaaatgatgtactttgaagaccgttagtgtataacagagttgtttgtttcctctttgattttaaacagagaaaataaaaggagtaactgctccttttttcttccttttttcatttcaaagtttctaccagtgtatcagtgacggacaacagagagacatgctgtagagtgtttgcctagttgacaaagctgcttttgaatgctggtggttctgttcctttgacactacgcacttttataatatgtgttaatgctctatgacaaatgctctgattcctagtgccaaaggttcacttcagtgtatataactgaacactcatccatctgtgctcttttttttttttttaatggtgcttaaagagcccatcctttgcaagtcatccatgtcattccttaggcatcttatctttgctcaactgttaaagaatggtggcttgttttcatgggttttgtatttgtgtctaatgcacgttttaacatgatagacgcaatgcatcgtgtagctg

SEQ ID NO: 35201 - DNA, 1202 bp, Mus musculus
accctgtattaaagtaaaataaggaacagtgaagataaaataaaataaaaattcagagcacaaaccaaatacttgaagcaaaaatgagttttcattttctttctcttttcagacagcactttccataggccagtgtatgtagcaatgatgggttatttaagttttccttggaaatttgtatcatggattagtccaataatttgaattctggccagtctgttttcatccttttttctaggttttgcagtatttccaccatacatatagaaaaggagaattatatatctgtatcatattggtgttgataatgtatattaagataatgatattttgttacagtgtctttattatctcaaagggggttccaaagtaaatactcaaagcatatactttttagacattattttatactgaaacaactgacagtaggtaggacattagtgattaaatctagtttatttgttccaatgactgtaaaatttgcctcatagattgtctggtcattaaagaatgtattgtaattacctttcatgcatggtacatctgcgattgctctgttgcctttcctctgatggcctactggggcagcacttgattggtacactttgccaactgtaaagcttctactttctcaccttgacatggtgattggtgtctccaccatttcttggagcctccctttagctgcttttgttccctgccaggacagacccatgtaaagcactaagatctccgttggtatgttgaacacttgctttagtggagtgggagtccttgtgtcttcaaagtctgatcatctcaaagcctgtttctcctgcaaagtgtggacttatccatctctgtcacagtattaacatgttacaaatacaaggaagataatactgaaaaaaaaagaattattttcatttatacgcttatactttttattttatattcctgaaaactataagaaaccagttcgctggcttaactgactgccaccaggactggaggagtatcctatggcacaaatatagtgtacacacacacacagacacacacacacacacacacacacacacactcacaccctgtattaacagtagtaagagtatttgttatttgttcatgacattctaattctgtagaacctgagctattttgaatgtctgatgtgacttttattcatctctgtatttatccatctttgtaaatgtgtattt

SEQ ID NO: 35202 - DNA, 1129 bp, Mus musculus
agcaaactaacaagcagcctctttagcctcgagaaaagtcagagatgttcctggtcctgtcagtgatctttgtctttgtcaaatgccagagatttgagaaatagttcagccaaaatgtctttggctctaccatggcctgaggcaggaatgctacaagggaagtctagtttctcctctcctgtatgactatcctgcctggaatctctatgtaaggatgtgactacatgcctcatgggagtgtctgccacaagttttatactaaacccctggttccaattttctgggactcattaccacagtagaaggggtttgccctcactttgtttcttaaagtttcaattataaactcatgataaataaatttctcaggatccttctctgctgccacttcacccaagccaactgaatttctttttaaagtgcattctcctgtacttacctggcaggggagataccatgatcacaaaggtggttttcccagggtgaggcttatccattgcactctggatgtgctgaccccagcgatttccccaaatgcgtgaaactcaactgcataatttgtggtagtggggaaaaataaaaaaataaaataaaatgcatactcctcattatctatgaattttgctcttcatttatgagataagaacctggaggccactgacagcatacatgttgtgtgaccatgagaacccatcaccccagctttaactgaattaaagcccttctgaagggagacagatgtcctctgttgaattgcaaacatctcatttttctttattggtataaagggagatctgcctgtctcaaatacatgtagtgaggaacctgttaaaggagaacactaataaagtactgggtggccaagagtaacagcaaagaagacaaaaagagaaagaaagaatggtacacacacacacacacacacacacacacacacagaggaagaaggagagagaaaagtggatgggggaaggtagggagaaggggagaataagcaagcaagagaaatgcatttattgttagtagtttttaaaataaaatttaaataaaatataaaattaatattttaaaagatgtggtcaaacataacacttgtctttgtactcctttatttataactgaacacttc

SEQ ID NO: 35203 - DNA, 1208 bp, Mus musculus
aagtaggcattttgtgaaagctcatctcctataattgaagtactcgattcaggacctgttttccttgagccactaataaactttcttctaccagtaaaataatttctcactacatgagttagtcattgccgtgtaatacagcccattgtacatgcctgtttttcagtagctctttgtgtaactaatcagaggctttcccatgtgataatgaagtgtttaatcaccataatgttatggagaaacagcatttaatgtttggctaaaccttctttctttatcttttcagataaattattagtcataactgtcgcaacaaaagaaaatgatggattccacagatttatgaattcagccaagtatttcaattacactgtgaaggtatgatatgtctttcagtctttggacttgttggaatatgtgcctaaaatatattaactagtggtttatttaaacatgttctataagcaacagaaatgtgtatatatgtaactttcctgacttcctttggagggtcatgtccacatacattgtaatcaaggtttgacggtaactattttcactgactaaagggatggcctgctgtggtgtcagttgaaaacatgatgggacggggctttgggggtgcgctattgacagtgtttttcctgttttgtttggtttgggttcattggttggaacattggcaagtgttttagatgttttgtctacatggcacggttcatggatatgatcagaggtgacttggagcccctgatagagtcttaaactgccttatgtgatatgtgctccttggatctgattattattattatttttttgatagaaagcatatgacaggcatatcttttctagaaagaggagcatagggaagtatctgagagactgaaaaaaaattaaaaacaaaaagaaggaaaacattgctcctaccttgggaaaaactgggctgttttagcctataatatagagaacagtagcctctagatgacaaggtgtggattttcatgcagagtattaatgttgctgaactttgttggaaagagatctagtgataacatgtacgtgcttaaagaggataagtgagaaagtaaatgagaaatatcattagcttgccttgatggaaaacagtatatacatgcaaacaaataaggtatgatttgcctggaattcagagaaagagccaataatggagggttcgatgtgaagagaga

SEQ ID NO: 35204 - DNA, 1157 bp, Mus musculus
tggctgaggctgaggcagatgttggaaagtcagggcctgcttagcccagactagctaaacttcatcccttgccttgggtaattcttatttaacttttgaggctaatacaaatgtaagatttgccaaagaaatgagggttctttacactggatgctttcagtgtgtccttaggtgataggccaggctaggagcctttgagcagaggaatttccttgtagatttcctatcacattagacaggtgaactacaggggtttcttcattttcatttaagtctgaaaacaagaatgagatgagaaatacttcctgagtccacttctataggttaaaatcaacctttgaaatattcggaatgtgttttagtggtagatctcactgtagaattatgaccctcccgtgcgttaatttccattccttcctagcattgtgatttaattataaataagtagtggctttcaaggactggggcacatcttctgttgacatttttatgctgctatcgccattggcattttcctcaggatgagctcttgatttcatttctaggttcttggtcaaggtcaggagtggagaggcggtgatggaatgaacagtatcggagggggccagaaggtgagattactgaaagaagctatggagcactacgccagtcaggaagatctggtcatcttgtttaccgagtggtaaggaaaatgtcctgtgggcttcccagtctgtattatagtacctttaaagactgaattttataattgaagcttaaatgttgaaatattttactaacaatgactcattgtataaagtgtattttcctcacatataactgaagtttttccagtgagcagttcctgcttctgagccccaacttaaaagcaagattgttttatactaatttttttcattagcaggaatttttcttctatgtaaaataaagtgtctatgcgagaaaagtcacaatctgcaccgatcttgtaatattaaagatgatgagttataagcactaatgcgaaaacaaggaatagtctaacatttttgggaaattcattttaatcttggattaaaagcacagtagaggtcatgcttgagtgtgcaattgagggagacaacaaaatgagctctgttcaaacatcaaaaatgcttcataaagttgcaaatataagg

SEQ ID NO: 35205 - DNA, 1171 bp, Mus musculus
gattccatattatagagtatatcaactattaagtgtatactgatagcagcgtgagatatgttagtcaaaaccagtttatcagggataataatgaattggtcactgaaacttcctgtctatgaatgtcactaaaatatttgactgtcaagagagaagccttatcaagtatttatgctggtgtcattcatttaaattaactgtaacatttgcccattggcttataatttttatttggagataagttactatatattatcatgaaaaatatctcatatttttatttcgtttgtcaaatgtagttcctgtgatgtgagttgggaagaggttgcctgctgtgttctctaaacctgttttaatcctgtatggattcttttttttttttagagatttttttcttactcaaattgtgcttaaattctgaaacatgcattttgagacttgtttgtttcttctaaaaacagttttgatgttgtatttgctggtgggcctgaagaagttcttaaaaagttccaaaagacaaatcataaaatcgtctttgcagcggacgggctgctgtggccagataagcggctggcagacaagtaccctgttgtgcacattgggaaacgctacctgaattctggaggtatgaacagtgctgctatagacggaagtctcaaccccataagcatgatcttgctaggaaatattctgaaagctcactcacaggttagcgcttgaaaaccatttcccttggactacctgtgtatctaggcagtgtggatattcaacttaccacattataagtgagaattaagtcttctcattacagttcattgaggtgtttttggcataggatattaagttttaataagtttactttgaaaaagtttcatgtttaatctgtaattgtgttattaaaaatagtcacttgttaatctggtctgtttttaaatatattgtgcttaattacttactgtgactatttttagtcaaaacgttaaatagtgtctgagtgtacagaagtgttgtattccccacatgaaccaccacagattaaaagtgatcacatacactttttttttgtattttttttattaggtattttcctcgtttacattttcaatgctatcccaaaggtcccccatacccacccccccaatcccctacccacccactgcccctttttggc

SEQ ID NO: 35206 - DNA, 1573 bp, Mus musculus
gtgttttcactgctcagcaagtctcctgcattgatcttctagggatttgcactgctgaattttgtagtaaagtactcacctgaaagacagcgctcgctccgtccccaccacgatgcctcaacctttaccatcaacattgctctgaataatgtaggagaggattttcaggtaattatgacaaacatatgaaaaaaaaaagtttaggaactgtggtattatggaaaaggctctgctgatatttgtttttttgttgtttggtttttgtttgtttgttttttgctcgccatttagatggcacagtttgaatgttgctactgattaaaaatgtgcatgtttgtgtttaacttttttagggaggtggatgcaaatttctgaggtataattgctccattgagtccccacgaaaaggctggagcttcatgcatcctgggaggctcacacatttgcacgaaggacttcctgttaaaaatggaacacgatacattgcagtgtcatttatagatccctaagttatttacgtaactcaaactgaatggctctctgagatggatgactggcgtgaacatgtctctgaagttgtacttgagaagacaagaagaataatgtcaacagaacaacatcactttgggccaagcatttgaacactttttatataaaattgtgtgatgtctctttatgtctgctctgagccttaaaacacaggttgaagaagaaaagaaaggaaaaaaaagtgaaagttggtatttatttctgtgctttaattgtctctgaaaataatgacagtttataaaatgtttaggtacaaaggcataaatgataataagtaagcctggtaatatgttcttatttaagaagaacctgagaaggttttatttatcggtgggggaagtatagcaaacggttctaaatgaaaatcagcaaacctgaaagcctgggattctgacgcctactggctctatgtaattattaagtcacattgacctctgtgtagggctgttttccaggaattaggaagaaaacccaaagaaaatattgcacaaaggtttccctcaggaaacctagtgcagatagccatggaagcatagccactggaaaggaacagtgcatgaggcagatgttcgtttctggtggaaattgggcccctgtgttcctccagggcaagtctcaggggaagctcatgtctttctgctttacaaagtgcttcaagcgtcagctccaagtgtccttatgtcagcaggatttgtttccttctagtcccccccccccccattatagaaaatagtaaggaaaaataacagtttcattgagatcagtagtaaattttactatgttttttttaaagcttacgtacttgaattttatatcaggaagatggtttttgagcctgttccttacccttgactatagttggtagttggtctcttttttccccctaggggaggggtttttctttccctcactgcaatctattttctcattcttagtctccttaattacttttcctctaccctacttgttaaaagttcccacagcaaaattttttatttcaatttttaatatttctccaaatgag

SEQ ID NO: 35207 - DNA, 1162 bp, Mus musculus
attttgaagggagtaggaaaaaatcatccaagtcttttgcgtccttagagctacactaaagtatagagtttcaaaacagaacaccattatattttccacctattcataacatggaggttgggactcctaggagagccgtctgtggttccacaaacatcatcatgtttttggggagtgactgtggttgtggttacagagcaagaagtcaagaagccttccaggcagtgatggctacttcaggtataactaccattagagaggatgtggaatttcttttatctttggggaagttttgaaaagatagtcaaggaattaggaatttaaaattacagggaaaaatatgtatgtgaaaagcaataaatattttgttctctttgctatcaagatgttcacactcagatatttattatacagcaacaatttatatttttaatcattgcccattaatagacgcagtgaaatatttttgaatcaaaacatttggggtttgtatgtgcatttaaattgtcttttgtactgtatgttactgtttaatttgaatattttatcagaactgtctccctgtgcctttataatataaagttgtttctgcaacttttaatgatcttaataaagaatactttaagaaccatactttggctactctgtcttcaaccatgcaagtttttcttgactcaaaaaaataataattattattatttcacttttgttacagttttttggaaattgtttcagttggatataagctgagtttaaggaatatgttttgttttgctgtgatagtgatttttttaaatttactaataagtggaaaaaagagcttaggaaatttcaaatatatataaaagaattatatgatgttcacagctattgcagtaccttccagagttaccaagcatgtttcagctttaatatctgctttcctcagcttcccttaggtagttaactgtgtcatttgattcaagagtatacattaggtgtgttctcttccaacaaaacctacagtgtaactagtcaaaaatgaatagtaatggccaaagcagaaagtttttcataaaccttccaacttcaagcattctgaaccacagggtgactaggtggagcaactaccccccaccccccaccccccaccccccaccccgggatagggtttctctgtaga

SEQ ID NO: 35208 - DNA, 1302 bp, Mus musculus
aaggtttgttaattaatgggatgctctgtatgagaacgttaggaagttgtttttcaaataaacatttctgatttttctttcacagataagcctgagaattgggacgtatggtatgaaagcaagtttgacgattgtgacaaggaagcttgcttgtcattttcaaaagaaatcctctgtgctcgtgtcactgtggaccacaattactatgccgtttgtcagaacctcttatccagacatgccacctggcgcggcacttctggaggactcctccatgatccaccaagtgaaattgccaaagatggccgactggaggccttgctggatgagtgcaccaaccccaagaaacgctatggccggttccaggccgcaaaagaactgcgtggctatctggcacagttaagtcacaatgtgaggtagtcagcagtgatctttacattttctttgctgaaaaagcactgacaaaactaaaccaccaaaaaaactgcctagaataaacaaagtgtggaagtatggcctcgagaatgatgaacttctgatagatcttacgttaacacccatcaaataagacattactgtacatcaacgttctcacgacgcttctgcaagtctgttcttcactttggagattgagataccattgactgcttttccccttcccatacctgagtggatgatattgctaagctattggaaaggagtctgatagttacatggcttgtgtatcaaagggtacttggtacttagtttgcatttctaccatgattttgtgaatctcttgcatttactttgaatttcaagttagattggcctgttttataggccacattttccttctgatgtgtaaaatcattttccattttttaaaagttttacgcacccaggttactataggtgttcatttaaaatttaatataagtagttttcattccgtgctatgcggtacatacttaaactgttagggcaggactcccaggtttactgtttttacagagatcttagtatttcaccatgtaaataatttgcctctccccagccttctatgcttttccactgcatgataacatcatttcaggttatttaagagttaactccctcaatgccagtaattacaggtatacactgaacatgatgttcagcatatgctacaaaacgtcactgcatcctttgctaaaaggcttcgagaataatacactagcagtctacacttcgatcgctttgattgaagaaacaataaaagtcaaggtttctaaatgctaactagtccaagatagtaatgcatatgccaaagaaatattagacaca

SEQ ID NO: 35209 - DNA, 1174 bp, Mus musculus
tccagatgcctcctccgcctgagtaacgcccaccctctagtctgcgggctcctccactcacctggagcggagggtgcgcctcggagcgtccccagatccccgaccggcggactgtccggctagcactctcctcggtttctctccggttctcttctgctaggggtccccaagccttcgagggagccgcgagactccgctgccctagccctaggcagagttttccagcagcgggcgccctgcaccccgggaggggaaactttcaccgggcccggagcccagctctgcgctccaccgagcgcggcgcgtcccggctccagcgacgtctccttaggtctctcgggaccgctgcttccctccaggctctggggcacgaagcaggcaggaggcgacagtggggggtggcttacatacgccccagctccaggctgttctgctctccatcgctctctcttggcctccacgtagcgaaccttcccatccctccggcggccgcggatagggtgcagcgcggccccgcagcggcggctgcttcttccatcacccggaggatgtcctggcgggcggctcaggcgagccccggcgctccgtggccgcggactggcccaggactctgtacacctagctgaaggcaaaagagcgggaccccccacccccgcgtcaccagcggcttctgccctacgaggtcccgaggcagaggaagcccccgccgcggccgcactaaagcggcgcccgggaggatgctgctacccgactccccctacgccgggcgcctgcaacgcgctcgggccggcctctgcgcggctcctgccagcccgctcggggttggtgcgcgccgccgtctgtcgccccggctcctccccttcgccgtgctcccctcctcctctgcctgtcccacacccgccctcctcgcagctccagactcccgccgccacctccttaggggctggagatgcgacccggttcaaggaggcgctgctagggcctccagccgttagtagcagaacagagctctaggtgcgcccggggcgcggcgccggcgcctgattcccagctcgcccgcacagccggagacttgggttctctgtagctgcacgactcggctcccaggattcgctctggagaagagttggtgataaaagtttgagcagaaataccccggacgtacgctcctttc

SEQ ID NO: 35210 - DNA, 2204 bp, Mus musculus
cccatttttcattatgagaaaacatgtagaataagctgttaaaattcacagtggaatcaagtggcaccacttgttattccagcattgaggccacatgatggtaagcttacaagttgagaccaccctgggcaatagagagggatcctgtctcagaaacagggtccctgggaacttaatgggatcagaaactggtcttacaagaaggaagctgttctgcatatttttttttaaataatagcttagttttcatatctagagaacacagcataatttttgtgagttaaagtgttcataaatgattggagagttacaagaaagatggctctggctatgtaacacacagccgtggtcctctactatttgtatgaaatgctctgtcaccatcctacaatgttgctaacaaagggatccccttccagcgtggtgccacttgcttctctctgcagagaggcagaagtaacatgttccaacaaaagacctgtgactaaagagggttgtgagggtagttttcctttggcactgtagttccgtttttctgtgagtctgcatctgcatcactacaatcttctaattgtagtgagttagagattaaggaactagggagacagaaagccctgatcccaaaggatccttttatttggttcacaatatttttggctttttttactaaattttgcagaaattgctctatcctgacctaattttctttattgcagaccattcctatgggcttaacctgagaattgtattctaactaaagagtgttggaaggaatacttccttctgacctatgtattttccccattctttaatattcttgagtacttgaaaacaccttaagagaaattttgttcatgatcaaatgtaggtttattagaaatatcctatacacttgccttgatggtggtgtaagttctgagaaattgcatgattgtgttaatagtttatcatggttaaaaatacagagagacaaacctgttgccaaaatgagttaacctatactgatgacaactgtgtgatttctttagccgagaaagttgtttttaaaaataaactaccgcttttctaaagcactgcattttcaaaataagcttttgtttgttgttcccctcttctgactttgagtggacaagcctacaaaaacttgaatgccaggtatttgtgaagacagtataagtttaaagggtcttgtgatgaaaaactcacattaataaaatgtttggggttttcacatttttcacgtgcatgtttttggaatagattttaaggagtgcttatcattttggatttttttctgtttttgttaccaacttcctaagatttagctaatacacgaagacaaatcctagggaagtgtagtggtagactaataagaggtgggaatgtgctgctgttgaaagggagcctgttcaaatgcctctgtttattcagtaccacctcctgcagctctaatgtaaatgtattatgtgtatatgtatagttttgtagataaaatgtcctcgttcactttcgtatataattgtgtttagagtatcagtgttttcattcttttaacttcaggctcttgtatgttgtatctctgatttgaaatagcagagaagacagatttgtagacatggctcagctaaagtactctgcagtgggacagatgccgtggaaggctggtggcgctgccttctggatgacactggcactttatagttttctacggaaagattagtcgcaaacaaggcttgtagaagtcactttgttgttgtttttttaacttttaattacttaaataaaacccattgttttcatagtaaatttagactgcttatgtaattttctgtatactgttttctaatgggaaccctatatggcaatccttctttcagccgttttctcctgtgcgaactagttatggaaagagtgttgtctgttcgttgtagcaacagagccactaagttttatgcagtaaaactcctaccaggtagttttatgatacgtgattccctactaattaggaaatttcatgcccttattttctttgttaaggagatctgttctgtttatctcactgagaaaaacttcaaacccagaatataacagtggccatctcacctccaacctataagtatcagctccttagtatatctgttttgtttgtaaacatatcatgacatcatcacactgaaagctcctggttcctttttaaggttttg

SEQ ID NO: 35211 - DNA, 2236 bp, Mus musculus
tgcttttcaggttgtgtgaatggtttagttggttcttggaatttgatcttctgggttagaggttcaaattttgagtggagataccagttacctggagagcttattataaaaatcacacattctcattggagcaggataaagactcagaaatctgtcttttaaaacaaatagtgtactgatttctcatgaatagtaaatgcaaaataaatccatgtgtgtgtacatagtaaagaataaagttgagtttgctgttttatttagttgtggcttatacaccctcttagagctgttttggtagctggttacttaacgttcttgtttgtttacaggtcgccgtctggttcaaggacacctaaaaggtctaggcgctctcgctctaggtcccctaagaaatcagggaagaaatccagatctcagtcccggtctccacacaggtctcataaaaagtcaaagaaaaacaaacactgacgtatatttctaagatgctgtcacttattggaaatgcaagtttgttttgtgtctgaatggttttttttttcttattaaaaaaaaaaccatacacacaaaaacaaaaaaattctaatgaaagagcattcctgggttttgtttgttgtttgtttgtttgtgaatgcatgtgtaaactcatgagtaactgcatctgtagacctgtcattgttttatattgtataaattacttttgttgtggctgttttctcaagatgaaatttttattgtgctaatgaatttcatcagaaatatgtccaatggatctgctggcagtagtagtattttgttttaggatgttgtgacttagacacataatacagatgtcttccccccttttgtagctttgacaatttgaattagatttcaaataaaatctgaacagaaaactataatgttgtttttttgcccagttggtgacaccaagtcccttaaagacctactaagtgaatttggcaccattgctgtttcttatccctagtgcactttacaagctccagtgttcaagtagctagtgttttataattactaaaatgactttcacaagttaagggacccagtactcctgtaggttttgctcattcatttctgtaaagagtttcatacctagagaacagaaggctcgaatagagcgtatgatgtgtatctgttactgtagtgcctggttaaaacagttctttctcaaagaagcaacatgacttcaaaacactcagcccatcttctgagcaattaacgtatttagggtaaatttaatttttatcttctatcatgaaacaagtttatttataaaaggttttataaaaaatttaccatagaattcttttgtataatagttgcctttttataattgtctgtaggttatctttaaaacactggtatcatgatatttgtacaaatttgtttgaaacagctttttgttttgaaggatttggtttgaagtacagctttaaataaaaattgaaaaattaaacggttttcaggcaattttaacatccaatggtttataaattcaaggcgcaaaaagttgacttaagtcagcgttgaattcttttataaacaggaagaaacttggctgtggtctggggaagaaataggcaaacttgtgactgttgatcacagtcccacagagacggtaatgctgtgtggcctggacctgacgctagtatctgtcagtcttgctttcagggttccatctaggctctttatgcagtgctttatgattttctgtaataatggattgttgggatttagcttttttttttttttttttaaatcttttcaccttgtttacttaatcttgcccagtcacaaaataaggtgtcttctacccatgatttgaggagtagtcctatcagctgtacagtaaggcatgtcttttccttatccagcacaactacagaagcttgagaaatgagcccgtcataattgctttacattgaggttcttagcatgaaagtaccattcagtcctttgtttacctactttattaggaaatgttaattccttaaagttgcagaataattaatgtgaacatttggtgctgattcttaaagatctatataaatacagccattacaagaggaatacatttttctcccatgttcgttatctgagagaatagcattttatatcatctttcttttaagaaaaatagtgttaaattgctggtagttgtggtattccttagtccctggtctttagatagacaaggaaataatgggtcagaaagtga

SEQ ID NO: 35212 - DNA, 1146 bp, Mus musculus
agtgcagtgtttctcttccactgctctttgtacctgctcttctctttctggattttctgtgttaccagacctcagcctaagtgtaacttcaggataaccttttgacttctttaagggaaatttaattattaaatagtataataagatggtgatgtacactttcaatctattgttctaacttattttctttttaaacaaacctttactaagctctttggcagacgaaccaagcctgatacttttcaccatgactcatatgctacttgatctcaaggataagcctttaatatatattatgcaaataagtgtacagatagttactgtctctgcagtctggataataaaacatatttacattgtgtctggagataaggctatctagtcatgttgctctgcactggattttaagttaatctaacagtgagagagtggtgcatgttttgcaggatgtgccggatgatcttgacggtgctcccatcgaggaggagcttgacggggcgcctctggaggatgtggatgggattcccatcgatgccactcccatcgatgacctggatggggtccctataaagagtcttgatgatgatctggatggagtgccttgtaagtttggactttaaacattcagactaacaggtttagttgccaaaatcccttaagtttttcacgtgatggtatggagaaatgttttaatttttgactgtcaagtcactcaccttttctgacattttaaaatttaggtatctagcaatatgtttgactgtggcaaaggaaagagctttattatggtatcttttttgggggactatcatcctataatattagcaggttttcctttttgtctcaattgtctgaaagttacaggcagtatcttgtgttttacagtcacatgcccagtgtcacttcctttgttttttttattttcctacccacacctccatatgcttctcttgtacccaaattttctatgcagtagttcttcacacccattttgccttgctcttgatagataaaagttacccactgccaattctggtctgcaaatatcaaatggagagttcaaaaaatttcataaactgtaggaatcataattcattctaacagttctttcgtgttttattatttttttagtgttcctaatttata

SEQ ID NO: 35213 - DNA, 1149 bp, Mus musculus
ctgtaaatgttagtaaatcttacttcagtttctaagtctatatagatcatccacccatcctgcgtactaggtttttgagctgggtctcccgtagcccaggctggcttgaactttaaccttcagcatcctgctgctccttccttgtatttcccagagttgggattacaggcatgtgccaaccgcttccagctcccttttttttaaggaactagaaagcactgatttggattattaagtgttggccatcataatgaccactcaaattgttgttgtttttttttaatttcaaatgtaagtctagacattattagattataagatcattttggccttagtacaatatttggaatttccaggcttgtattctgtgctgtatatcaagtaagtagagacttctgtttcatgctcttgctatggtagttacatttccatcaatttgggtagaggtgtttattagtcatttctacacattgaaagaatatttgtacaagatatagggtttttaccattgaccatgatgaagtctctatcttttacaaaagtgtgcatgtctgtgtgcacacatgtgcaccctcatgccgcagtgtagatgtgacagaggacaacgctaggttctaaggatcaaattcaggccttcaggctgtgtggcctatgtctgcattctctgagtcatgctcatggccccattagtgtttcttaattacaaaatacataaaccactagttatttttagctttaaaattaacttcatgatgtacacagtgtatgtagttcttgctaaggggacttgatgggggggcacccttccaaagtcccttttattttatgtaattgttctatacttttcatttttaatatctcctggtagacactgagcacatattttagaaataaaatttcctaagcaaagtatttcatggcttcaggagggggtttggagccatattgtagctttgtttcagagcagtaagacagaacgtatggttgttaacctgagatattgctagatataaaaaaataagtttaccaaaaatgtgttattttgccaggcagtggaggcccatgcctttaatcccagcacttgggggacagagggagaggcagaggcagaggcaggtggatatctgagttccaggacagccaggccta

SEQ ID NO: 35214 - DNA, 1172 bp, Mus musculus
atacttcaaaccattacataattcctgaaagggtgctgatcgtctctctgtgacattgataatacggctgaccataataatgtcagtataattagcttccaaattatagtcctgcgtcttccctcgtggctcttcctctccatcatttggagtctgagcttcgtttttctggtttgttttctttcactccatggaatgtttcaccagcattggagtatttagaacccactggtagtcctgtccaaagaagaaaaacagcaggaaaatgaaatcctgaggaattctgtgcaagcagatggaatgctctcaaaagcaccgcctctggtcttgtcacagcggcccctttctcctctcgctttttaatctccgctccaaaagcttttatgtaacgaatttttagggcaagaaagttcagccagttttcaaatggaaaatattttattagttgctggtggaaagtcagtgtctccccaaaggagatgtttttaccatagtttaaagtgatttttagtgtgagtgaggcagttctttaccatctcagatgcaactttttaaaggtaggcaaacatccacgtgtgtggcactgatgatccagcggctgctgggtccgacagcaatcccattgctcctgccagcattggtcaggtaaatgcataagtgtcttcttgggctctcaggaatgaatgccctttatttaatggggattgatttccatcatcttccctgaattaacagacagggttcctggctacctattgcccagcaagattgggtagcagctgaacgccaccattgttgatgacccagggaaatgcccttagattcacacactggaaattgtctcaaaggtactgcttgtaagaggaatgattccttacgaaattaaaatggataattcacgtgaattatttaggatactcttattagttctagagcaaaaagttaaataaataagaaagaaagaaaagaaaacctttaatattcacatttcatgcatcagtgtttctctgcaaactcttcaaaaattaaccacataccacacccccacatgcctgtgtcaggagtgtgcacacgtgcattcacacttcagcaactcgaatcagttcaatatgaatgtttatctcctctcaaaaggagaaatctacctatctcatgaacacacacacgcgcgc

SEQ ID NO: 35215 - DNA, 1203 bp, Mus musculus
agccggcacagttatcacgaccgtcactcgaggtgggagcttgcacgccacagtctcgatcatcagcatctacagggaaggcaacctggccattcagcaggctggcaagaacatgagtgtcaagctcactgtggtgtgcaggcagtgcccccttctcagacgaggtaaggacagagctgtagcctttcttctgggaaagctcagaagcagagtggctgttgaggggaagtgaagtaagggctaaaacacgatccacttctgataaagaaggaagccattaataaccatgaacacgaagggaagaaaaaaccagttatctttcctttctctttctttaggtctcaattacattattatgggacaagtgggtgaagatgggcgtggcaaaatcatgccaaacagctttgtcaaaatgttcaagaataagaatcagaagcccatgaacgcactgaagaacaagcagtgttagcctgagctctgtcacataacctgaacttactcatcaccgctgaacgatctgtccacgttaggaaaaaaaaaaaaaaaaaaccacgctatttaatgctgagcgttctgagagatggagctgagtaactcctcacgcgatggatgtgtgagccacgcccccagttcactggtggaaggtctgcgcctgcgctgtgatctccaacatctgcgaactcacccacccagtgcctgatggggaagagcagcgagctccgacatctggaagcttgaacatacatctctgtaggaggatattctagagtcgagttgtatgaagatatacaaaggattttataaagtgcaatatttataatgatatttggttaccttcaagcatttgctctgaggtgtcacattctttttttctctttcatttttttaaaagtcaatgcttaataaaatattttaaatgattataaggcagccagataaccttgttctcccagaaaatacaactgtggagccagtcccgtgaaacggtgctcgaggtggtatttgtacataaagttgtcgctgtatcagcttcaagttgtcactaagagttccagggttaagactgatgcagtgacgtcagtggactgtagtctctgtctgcaagaacagaaaggtgtccctctggcatccagtccagactccttcattttgtctctgaactgcaagctcaggtatatacaagggaattccccagagtacact

SEQ ID NO: 35216 - DNA, 1155 bp, Mus musculus
aatcttaattaatatattatttttgtatgtagtcaaagaattgccatagttcagccaaactgaacagttttaaatctatcccaatgtagataaaaagttgatagtatattgcaatttttgttttattttactactataattactggtgtgtgtgtgtctgtctatatgtctatattgtctacatgtgtgtatgcatcacaacaaatgtgtagagatgagtggcagtgggttctctcttttcatcatctgggtctgcagtgaccaaactcaggttctcaggcttcacagcaagtgcctttatttgctaagctgtctttctgactttttttgttttaaatattggcatttacttaaaattttgtgccggactttaagcctagggcctatgtatgttaaataaacactatttatgagctgtaccccaattctatattttgcttgaaacacatttgtatcatatattaataccttctgctgtaattatacttacttatagaattattcatgtggatatggacaaaaagagcatattatggaatgttctgaaacagaaagccgaatcccttcagatctctctcgaatgtggtactctcaagaattctgttgctgaggcattagaaggaatcactgttgtattacagctgactgctctctgcactgttcactgttctcatcaagacatggatgggtaaaaaaaattcaaagatttaatttttttttattacgtgtgtatgatgtttgttggtgtatgttacaggatatttgatcacactgcgaatccaagattgtgttattcactgagaaaattctgtttctagttgtggtatggcccagtccttagcacaaacctttaatccctctggctggaatacagtcatgcccttagtacatacctttaaccccaaacagtgaaggtaaagttagtttgtagaaggacgcacccatgtttgaaagtgatgtctaattgagtggcagcaaagtgacaaatctgagaaagacttgacagaataggatatgtccagctctcaccacaagagaggggaaagctacttaagaaagcaatacagagagcaagcgagggagagagggagaaggtgaggagacaaattgcagagaaaacaaggtagacagagcaggtgatgacagaagaagcca

SEQ ID NO: 35217 - DNA, 1142 bp, Mus musculus
atcttagaacataagccattggtgttctgttcaggaatttttcccctgtgcccatgtgctcaaggctcgtccccactttctcaactaaagtaatttaagctggtaagtttgccagctgtcgtggcacatgcccttttgattccagcattcaggaggcagaggcaggtggatcttcgtgttcaagatcaactggtctacaaacagaattccaggccagccagccaggtttctacagtgagacctgtctcaaaataaacaaacaaccacagagccaaacaaataaattaataagttctattttaatttccttaaattatatgtgccatgtatatctaaatattcatatataaggcaacgtggagttgtttgcagtattttatttgctgacagtgtttttaagtacaactttgttatatgatgtgtcaaactagaaaatactatctcactttagctttcatagacaatctacatcatctttgtaagcatcttgattttcaagaagatgaaagagaggtaaaagcagttcttgggactttattaaatttgatggaagatccagacaaggatgttagaattgcttttagtggaaatatcaagtatatattggaatccttgaactctgaagatggattcgtaaaagaggttagaaatcttaaattaaaacctatgatttttataaacctaggtctagaactgttctgaccagtgaactttgcttttctagctttttgtcttaagaatgaaggaagcatatactcatgcccaaatagcaaggaataatgagctaaaggatactttgattcttacaacaggggatattggaaggtatgtttgacagtatttgaattgaaacttgcttatttttgtccctgtcttatttgcctgatattacagatgtgagggctggagatggagtccagtggcagaatacatgccgactgtgcactgaaaaaaaaaaagagagagaagaataaattgtgatacaggatatatattatgggaaaatatgatttccatatctttgtgtgtctgcattagtttctgagacactgacttccccatgtttttattttcagggcagcaaaaggagatttgatacctttcgcactcttgcatttactgcattgcttgctgtctaagtc

SEQ ID NO: 35218 - DNA, 1172 bp, Mus musculus
agatattggatcactgaattaaatttcattctttagctactcagctatgtttttgtgccttcaacactgagtcatagacagatagtatgactatcatggcttctatcacctagataaaattagctatcactttacaggtttgttttttactgtatttactatatcaggccctcttacattactaccagtgttatataaatatttcatattcatttatagtgaataaatattttactttcatgttggcagtaaagtttaattctcatacatttgaatttagtttttatatatccttcagtttaacaagaaatcagggatgacatcaaggtactgaatgatttagtgtaaatacattgttgtttacacttaagtttaatcatataaaagttgccgtttatataccaaaagagtgttaaaaggttactttttcatagctgatctaaagtgcatacttaatatctgaggttaataagactgaacattgtaatattttaacatgttctgtctgtcttcagattacacatgttgtgtgagttggagcacagcctcaaaccgctttttcgcaagtctccaggtgacagttgtaatgaagactctctgaactggggagctcgacttgaaatgacccagaattcctatagagccaaggagcctatcctggccctccggagggctttattaagtctcaacaaaaggttgttcatacttctttaaaaagtcaattgtcttaaatttaatatatgttcatactttcttggaaagtgttttttgttctacatctacattttctgtttttagttctgggaattcatcacatagttgaaacatacctagaccataataatcatttttactaaggactggagagattgctcagtccgtggtaacaacacttgctgctctttcagaagaccagggttaggttccaagcacccacatggtggtttacaaccatctgtaactccaattccaagggatcggataccctcttctggcccccataggtaccaggcacacatatagtgcacatatatataaacagacaaaatgcttatatgcataaaagtaaataagtaaaacattttaagataaactgaaattttaaaatgtttttaaaaaatctaaagaatctgttttatagccaaacatgatatttcatgcctataatctca

SEQ ID NO: 35219 - DNA, 1196 bp, Mus musculus
atgaacttgacacacttacttattcgatataagtgtttacatgttcaagtgcctactcctttatctgaaaccttaggtctttatcagaaactacacttaggaattcatttttttctcattttaaaggtattcatacttatattggctattgtaactgatgataatgtatcagaatatcccataatcaaacacacatagcattcgaaattcagtatcattttgttgttaaatgagatttggtaaaaagttaattacagattttcttatgtctgataatagatctctggtttctactatctcctctggtccttaaatattcctgtgatagaggaatgttatttataaggtaaaagaggtttaaatgagatgattaaaaatacttagacatttcacattgttgagtaattgagattataaaagtaaaatatttactgtgattaaagttctataattcaaggtaaactcagaaaaattgaaatatactgtttgtttttcaggtcgatggaagcaattccacattaagcatgagcactcactttaaaatgcttaaaaggcttgtagaagacccgaccttcagtgagatcctcattcccctgcagtcagtcatgatccctactcttccgtcagttctgggtgcccatgcgaatcatgacccctttcctgggcactgggcctatcttgcaggcttcgatgatgtggtaaacttctgttctatataactatcatttttaaatgtagttaaatttataccttcaaattaagctaaaaatttaggtgagtattaaaaaagaaaactccagaaatgtacagaagcgcaactgtcttataatatagtacaaagttaagtaataaggaattataacaagccaaaaattttgattttctcatgctctttatttcactatgactattttttttcataattgtattttcctatattttcttttgtcttggaaaaatggagagcaaaagtaacaaaatatgtttttgtttcttatgaggaaacaagattcagataactttttcgtttgtttgttttgttttgtttttgtttttgtttttgtttttgttttttttcgagacagggtttctctgtgtagtcctggctgtcctggaactcactttgtagaccaggctggcctcgaactcagaaatccgcctgcctctgcctcccaagttctgggattaaaggcgtg

SEQ ID NO: 35220 - DNA, 1157 bp, Mus musculus
tgataaagtcataatttatttacatttcattctggttattcttgatgtcatgtgtaaattaataataataaaaaaaagctgtcttaaccagatttgtgaggctttctgtggtttttgtttttttctaatcatttatagacttagcgcctttttgtctttgatctgatttatgggtattttttttggtatggtgtgaaatagaagtttactttcattcttttttctatacaaactcacttgtcttgacaacttttgtttcagacaaggtgctagttactacgtagctctgactgaactggaactcactgtgtagaccaggctagtcttgaacttgcagagatcctctgcctccctaagtgctgaggaatatgtcaccacacttggccatcctttgccgataagactctttccaacatttaattgtgctttttattgagatggtcagttggttttcagtacttctaataagttatatgttaatatgccaattacccatccactgtcttgatgactatctttataaaaattttcgaaatcaggaagagcattctaattactttttttaatcaagatttttcgacttgcctgaatccctcacatttccttgtgaattttaaaaccaccaattaccgcaggaagccgtcttggattttgataggaatgaccatgaatttgtagttatatttgtagtgtagtaccatcttaacaacattgttttctgaactataaatgtttttctacttaattaaatattcattaatttcttgagacaatgttttgtagttttaaatgtacaagtcttaactttaaagttactttcctgaagatagagcgatagttcagtggttaagaacctgaatggagtagtggtagcagagatggatgagtgaggggactctgaactggttttgtatgtaaactggatggcagatgaacaccaattaaggatgatagtgtatattttgtttagggcaagagtaaaaattatgtttgttactaatttaggaatatagaaaaatagctcaaaaaagacaatgaattttgttttgaagataatttgagatgtttgtagtatatccaaacaagtttcccaaggcagttagagttgatgtctagagcatagaaagatgtgagattaatctgtatggtaactgaag

SEQ ID NO: 35221 - DNA, 1240 bp, Mus musculus
cacatggtggctcacaaccatcagtaatgggatctgatgccctcttctggtgtgtctgaagacagctacagtgtactcatgtacattaaataaataaatcttaaaaaaaatagtttctaaataaaaatgacagaattaaagctaatattagcaggggtgaggggtgtgcacctataattccagcattccttaggctgaggagggagcatcttgagctcaaggctaccctggactgcttatattatgtctcaagacagagattgagaaagagagcgtgagaagtaactcacagtaaaggtagctttgctccataactaaattaaaggagcaggagaaatgagtctgctgaacaagctgtcacaggcttgtaatcccaacagtggaggctaagaccaagtgggttttaattacaacattagtgacatgctgtctcagaaaaaaggagaaaatttttattgaaaattataatatactaaatacattgttacaacctagtaaagtaaggaaatgttgtaactacgttaatgaaaagttatattgtctctcatatctcagctttcctgtttatattttcacagcatttgatgaccagtgaagactcgccaattatagaatattatccacctgatttcaaaactgatctaaatgggaaacaacaggaatgggaagctgtggtattaataccgtttattgatgaggtcagtatatgaaataattacatataaacacataggctttttatttgaggcaggcaaagaacatcttaggtgtaattcctcagataccatcagacaccttgtttttggggctcgcctcctagggaccttcctgtctctttctacccagcacttagagtgcaagtgtgtgccaccatgcccagccttttacatgggcaggttaggaatcaaactcagattttgatggtgtttatatctattaccaactaagctgtctccccagcccccatcatttgttgttttgatgatggtcgttctacatggagtgagatagactctgagttcttttcatttctctttccctgatggctgagactgttgaacgtgttttcatatattcgctatttggaatgattctttagagaactgtctgtccagttcatttccctagttattaaatgattttttctatgtaatttttgagagtcactatagatatagtcattctgtatactaatcccctatcagatgtatagttagcaaagattttcttccattttata

SEQ ID NO: 35222 - DNA, 1141 bp, Mus musculus
tttctgttgcttatgttcttaacgcttgcttcccgccatctgattatctctagtgctatctgccctggctgtatctgactggaacctgtccttcctgtgatcctggttgtgtcagaactcctgagttcagctgcctctgtgatcctgtgattctgggatcctgtgatcctaagatcctggttgtgtcagagctcctaggagtcaagctgcctctgggcccttgagatcctggtgtgaccaagctcctgagatcctgagatcctgtggtcctgggcgtgttagagcccctgggagtggagcttcctttgggtgttgtgagactggctacggagtttgcacccaaggtctgctcatggcaccagcccagaccagatggaacctgtgccacttgaaaattaccttttattaaatctctccagcctctgcttttacttcctcttgcagattcaactatagcaagttgtttctttttgccctctggctttctcttcctttcatcaaagaatcttgaggttggaggggttactcaatgggtaaagtgcttggatatgaacttgggtcctcagtactcaaggcataatgtcacatgtctgtagccacagcgctggtgttttggagacaggcacatcctcggggcttgctggtcaggcacatgtcactgaagcggggaactccagggtcagtgaagaaccttgacaaaaaagttagattgagaagtattcgaggaaggcatgaggacatgagtgtgtaagcgtgcacatgtgtgcatccacagagaaaagaaacaatcttacgttttactattgtgcccatttataaactgtcttaattactgtgggcttgtgggtcttgctggaaaattgtgtttcatttgaaaatataaacattaattttaaaatccactatggaggaaagaacctagaaaggaatgtaaatgagttaatatcctcacctttcataaaatacaagaaagtattcattttagagcctttttaatggaagttgttaacatcagtgtgtcaagataatggagggggtgaatgagcgggtccagccacgttcttctgttacgtgtccttatctccacttacactaaaagtgtgtttgtcttgaagtaagcctagagaaagttagagaaatt

SEQ ID NO: 35223 - DNA, 2535 bp, Mus musculus
gagctattgagcgctgatgcggccagtgctgctttgttctaaatcttgtaccaaagcaactttagaagattctccagagcattcgtctgactgcttcaaactaggaatagcaatctagatttgaaaaataacgaatttttttagattattcaaaaaccagcattcagaattcctaatagaattaagtttcaaaatctccagggtacagcgattacaaatcagactgcaatagagtacagtacagaacgttaatcactatgcttttttaggcttcttgggttatatttgctttgttgatatttttttttcttttgagacggggtcttgctgtgtagtcctggctggccgggtactcatggtaatcctccatgttctgagattccagcatgcgtcaccacacttccttatgtggctttttctctgcttacttcacatatgtgaaaactcgttgtgggtctgtgtgtagagcttcctgggactggtaaaaatgtaaactttttaacaattccaacatgtctttttgtgtggacattttttactgcctgtcccattctggttgtgcattttagcacctgctgaactgctcagtgctgttgcattttgtctctgcgtgtcactcctggatgtgtgttgctcacactgttgaaatgatttggaatttatgaaattttctcaaggacatgatggcgtgcatttatatataaacatattgatcttttagttttgtgatatgcttatatttttaaagagtaaaaatgatcgtactttttcaaaagtaggaaccagtctttatatggagctgctcattgtgtgtatttaatttacgtcatggagactctgccataagtcttaaaatagtcttactgtttcttacaaatgctggtgttgaattcctttctgtgctaatttcagtgtttctctaggtgatggcaggatatatggatactagtagtgcctttagttaagaggtaaatgatagctatctttattttctatggtcatgtgaatttctgtaactttgtcttctgttagtagaaacttcttgctggggcactgtgggaaggttcaggccattcgcagtgtttgcctttgttgctcccaaactctgttttcaagggacgcatccattgcagacgcgagggaagttaggctgtggcgatgctatggtaactccttccgagagcgttgaaatgtgtagtatttgttacctcacttacgtttgctgtaccctcgctcgctcctgtgggataaattcaccgtgctgcacaaccatgtcccctgtcgaaacagaggaaggagttgttctgacaattccatgagaaatttgagtaaacacagtgccattgaaccagtgaggattctccaaaaactgtgcacaacaagctagtaattctgcatggaaagcagagtaagaagagcctttgccttccttttaaaaatagagagcaaatgctaagagtcaagcttgcaaagaaaaggagaggattccgtcctggcagctagggagcagcagcagagctctgaggacactggatctcctgacacgtgtctgcgggggaggagcacatctctgaaacatacatgggctgtggcaaccatatagccagttgggatgagtcagtctgaaaccaccctcgagcttttaaaatatgttcatttggctattcaatctaagaacctttggaaatggtgggctgtggtcccagaaggaacacttcccccagattgtctgtttccgtgtaactagaaaagttatttatttgattaagccttcctctcctcactggaaatgattgttaatatctttgttcaacaagtctttctttgttaagcaaattaagttcattagaagatgggtcctttcagctgtgtctccctttctcaattttgtacatttcctggccaatggattcattgacctaagaacttcatagactaaaggcttaaatatctaaacctcagttgtgtcaaaactttattccctctaaacctcagtttaaattacagattttccttctctgggctcagtagtgcacgtctccagttccagtgctctggaagctgtctatagcaggaggttccgtgaattcaaggcagccaggcagtaatgaagtctgaaggtacttcccgccttctgtgatgagcagaaggaaggtgttgctgcctctcaacgtgtactccattcccacaccgagagtcccgtgctcactttgtgactagagagttctggagtcttggctctaggggaggaggcgaagagacaggtgagatgcagtgctgtttgcagagtgtaaggtactgacttagcttaaggaaatgaactagagagtcatcttatttgctctctttttacgtaactattctttttgaatcaacaaatacttttcatagtggttatctagttcccaccttatatagcagaactccacagaaggtagcgctcacacagatcttctcggataaatgttctttgtgctatcttgcttccagatttttcttttattatagaagagaatctgttagaaattactgata

SEQ ID NO: 35224 - DNA, 1222 bp, Mus musculus
ggaactcagggaaattcatctgcctctgcctctgcctctgcctctgcctctgcctctgcagtgctgggataaaagcatgtgctaccaggtcaggcccattggcttttcaaaacatagagcatgtctcaagggcctcggcagtaattttgttactgcacgcgtacatgttacattgtttcaaagggatagtggtttcgtgtacatgttacattgtttcaaagggatagtcggtttggggtaggatctattcaaaatctgattctacatgctacaaaatatttctaagggttttgttttgttttgttttggggggtgggggggggagtgccactctctgttccaggctggcctgaaactcatggcagtcctcctgcatcagcctctcaagtgctgaataagccacggcccagttaatgttacataattggtatgtgctgtgttatgagaaccaaagagaatgcaagaataagttccatttagttgattgtagtttgaaatttctttttttatttgttttctcttctggtagatctttttttttccccctgtgctaggactgagcctggaccttacacattctaagtgtcccatcaatgcctctaaccctctgtggctggccttcgatgtagtgtctgatttgtactttcctattcccatctttcttaggaaaacaggccatcattttcacaacttcattagctggcaagacctaagggcagctgaacttgtaaagtcctggaataattctctcataatgaaggtaatttttttaatcaaatgggtttttttctttttctttttttaagatttattttatttatgagtacactgtagcgattttcagacacaccagaagaggatgttggatcccattacagatggttgtgagccaccatgtggttgctgggaattgaactcaggaactctggaagagcagtcagtgctcttaactgctgagccatctctctagcccaattgtttgtttgtttatttgtttttctataaatgtctcttaacttcagatttaattgtagagtctcctaccctttaagttttaggacattaagacaaagagccagtcagtgaaatgtaggagtagcctacccaaagcattggtggtagatttaaatgcttttctacttactgacccttggggaggctggagggaatttggggtagacctgtgcttcacgtgctcaagagatctcttacttctgcctgg

SEQ ID NO: 35225 - DNA, 1700 bp, Mus musculus
cagaactccgcctgcctctgcctcctgagttctggggttaaaggtgtgcaccaccacaccttgcaacattgacattttgaactgcatctgactttgctttgggatgctatgctggacacagtgggatgcttggcagtatccctgacctccactgttcagcattcccctgggttttatggccccaaatgcctgccaacattggccatcctgggaggcaaaaatcattgtcatttgagaaccactgatgcaggctgttagaataaacatgaggatttggtgaatatagtcacattcccaatagtctatgcactgttttctcctgggaaatgaattcttaacagtgaaaaagtagagagtatcctaaagtgcggtttcggttttgctcggtaatgaagaaaaagtgttggttggttgtgtcccttacccatcacctctgaagatggatcaaacctacagccttgagcctgatagtcaactattccactactgagctacatcccatcccgtaagtctcttgtagtacttatgtacctcagctctgctcctgtgtgttcacaattagtggacatttggcctcacgatatgacggttatattctgtagaccatctgttcctacccctgcacttctgagacagggcccaggttggtctggaactcatggcagtattcctgcctcagcctcctgggtgctgagatcacaggcatgaatcaccatgcctggctttgcttcagttttatctctgaacaaggaaaggactaccactgtcccaaagcttcactcgatgcttcctgaagccaaagccacgtttgctccccacagaacttaacactgtgccttcctgtctgtgggtggatttttacttcacatttatctttgatcttacatttattggtagtatcttatacttgtctaaaaggaagatatctacagctaggggtgtgatgtttattgtttaaaaaaaaaaaggttacatgtctgtatatttcgagtatatttttgtagagatatacatccatagatacacatggtataagctggtctgggaattcaccccagagtctggtgcatgctaagcatgcccagctactttgaacttcttaaggtatacttgaaactttcatccacagttttatatgttagactgcagctaactagccttgtgttgtgcccaacactttggtgctatagaagaaacctcataagtagcctcttcattaagcaaacacctatctataccagggaccagtttctttgtgttgtgtgtgtgtgttcttttgttttgtcttttaaggttttttgtttgtttgttttattttttttgagagagtgtctcactatgtagctctgactatcctggaactagagatctgcctgcctctgcctcccaagtgctggtattaaaggtctcctcccggagctactgggcctggatttggggactggttatcaaggtaaactacagctcaagaggctggcaagactttttcagttcatagaaataattgctatgcctcagagtcctccaactttgagtctacggtcaccaaaactagtctaaagaaggctcggatcagctcgaaggagtctggatccctttgggaagcttcgattgtgctttttcgagtcagggcaagaagcttcaggcataccctgaacctttaagattctcctgattgggaatccaaagcctgaaagagg

SEQ ID NO: 35226 - DNA, 1169 bp, Mus musculus
gagagagagagagagagagagagagagagagagagagagagagagagagagagagagagagagagagagaaagggaataagggtctgaggacagagagacagagacagacagagacagagacagacagacacagagaaacagacctaattgtctggattatatagggaggagcctctgagggaagggcacctcagcccctgggatggaaagttcaaggttgaaggcagggtatgacatgtagggactgagggatgctgggagaggccaggtctgtaaaattttgatatgtaaaatatccacctcagtctcttgcttctgggtcctaaccaagacagaactcaactgtatagaccagaatggccttaaactcagagatttgcctcccaagcactgggagtaagggctagtaccactttatcccagtccttaattcttttttaaatagaaggaaataatacttttgttgtttgtgtgtgtgtgtgttttgagacagggtcctccagagctctggctgtcctggagctcactatgataccaggctggcctcagactctcagatatccacctgcttctgctccttgagtgctgagattaaagactgtgccactgggccctgcaaagtgcacatgcctgtggaggccagagtcactggatttcttggagcttgaggtacagatggttctaagctgcctgacatggagctgcataatatacattcttaatcactgagccatttttccagcctgggaaagaatattttaaaatgtcttccctagccaacttttttatttttaagtactgtactttgagtctttaaactacaaagaataaaaacagaatttaatatgtactttaatttattaaatgggttttggcagtatttttaggaacgttaaattaataccttacttctaagataaaacttaggctgtcatagtgagactcaattggcctttatctaatttttaactgtacagttaagatatgggtgtaagtacactatagctgtcttcagacacaccacaaaagggcgtcagatctcattacggatggtcatgaaccaccatgtgattgctgggatttgaactcaggaccttcggaaaagctgtcagtgctcttaactgctgagccatcactccagcccccaagatatgggtgtctaagtttg

SEQ ID NO: 35227 - DNA, 1242 bp, Mus musculus
gtaaattaagaacgatttatttgtttatacaatctggatgccatctgagaggaactcataagctttgtgagattaatttccaattaagttttgagcatttttacagccataagttctgatcctgtggtcacacccagccacctccatctcctgcagccactcagtggctgtttgtctgagataaaacgcgctgctttctgttccttctcttcacggggcctaggaacaaagctaacttgccacagaatggttagagatgggatgagcattgagaccctagaacatgtacaaagggattggagacacggattactaagcaagcaccttctcttttataaaagtaaattcagtggggtagaaaaactattattttcttaatttgaaacacagtagttcttcccaatcagttgaagctcttttaaaaacatgaatttctacttagtttttggctcagtaggtgtccagtggatccctgaaatgcattttgaatgagaactcatgtcaccactccctgtgcagtgcacagtgtaaccagacacatagggaaggacagttagaatggactaggtgagccaggctgcaaatgatgtaccaaaataagtattaatcaggctgatggaagagacatggaaaattaagaattaagtatttctaagactgaataagataatagaaaaaagaacaaaatcacgttttgactaagtataaagaatggagtgaagaaggaggtacagcagactactggtgggcgaggcaagtgtttggaggagagtgactttaccatgttaaagcgaggactagacgtgtgcctcgtccttcttaataaacctttgtacgtgtactagtggtttgtaagaatagcatgcaatcagaaatgcaactgttaaggagtctgtgactgtgtgtgagcgtgcctgcacccctatccctgtctgcgtctccatccgtcgacccacgtataatgtgtacttcagattggagaacaaaagtaatcattattactttgacctccttcattttcatactaaaaaaatttaagagaaaaggtttataaagttgactacttccaaagcaatatgtggagaattaaatataaaacaaaacctgtcgagtatggtggctcatcctgtaattccagtgcatggggagctgagacagaactactgggcaccaaggcaaggcaggtctcaaaaaggaaagggaaagacagacctgctggctcacaccttgtaatcccattac

SEQ ID NO: 35228 - DNA, 1228 bp, Mus musculus
ggagtcccgcggcgagaccccctgttcattcaacgatgaagatgaggaagatgaagaggaggatccctcctccccagaataaagacaggagagaactcatgttttaatatttgatgctcatatgtgtctttagtgtgagctcttgtgttttgaaatgattgcttcagtctttgcctttgtttgcatttgtgtttagtgaaaactagagaaacacaataagcaaatcacttgaaggctgagatgattgaactgaaagttcccatagcgtggatgaaaccgagcagcagagcagcaggacatggccaacaaagcgtgctttctgaggacgtggagagtggcagtgacgaaggtcatttgttttcagggaggtagggtttaaagacccccagtgggagcatttagatggcaggcggctgcaaggagtctgcagtggtaacagcttctctctagcctggctggctttggtaggcaaaagtgaacttggaagtcacagtgggatcagaggggtgtaggttgcgatccttgtcgcctgaggagccggtggactgctgagctagtccaggggtagccggtcccctcatgcatctgctgccttagcttctagaacggagcaagcttttacgtacctaggtgacatgtagaaaaatttacagtaaactgaaatgaccatttgtcaatgcattggtgcataggagttactagggctacttctggaagccaaaatagaatagcatctccatgtgcattaaaaacttcgccagcactgccttttgccagcattctaaatttggagttttactgagaaggaaactgtttttatagttttaatcagagctatgcatttcatacagctttttaatttacaatgaaacaaagaaacaaattcctttgaccaaattgcttgtctatagttgtctgcagtactgtatgattttacccatgtgcaatttgtaaaatgaaccagatgtcactacttttgtctttatttcaagaatatggccatcactgttctcttatacatgttcttttccatattttaattatcaaaatgaccatatcagacttattcctgggtaaattgcatttcaaactaactcaatattcagtgtttttgttaaaaccttgaacactccagttgactgcatctgtgctagtgtggtatatcatacatgatcttaaagccaaagatgccatgaaaatactgcagtatggctgtgatttctgcttc

SEQ ID NO: 35229 - DNA, 3280 bp, Mus musculus
caaagggttttgtgttggcatgagttctggaacacatctcaggctgtcagagcaaagtgatccagaatgcaacaggagctacctcctgtaaccactacaatgtctgtccttgggaaggtagcaagacctgaagattggagatgtcagggtccataagatgcttttttagtcttcagaataccgagctactggtcctaagatgtttcagacttaaagcaaatgcatgtgttacacccatcccgtttaccatattaccaaatcctcacaagaggtttcaaggaactgtttcgcttgatctgcaccctgctgctgtgttctgtgctttacactgacagaacctgggttttcagttggcaatcatggaaagcatgttgtgtggctctgatcctagtatttgggaaacagagacagaaaggttagatcttaaaagtcaatctcggctacatagtgtgagtcaaggccagcttgggctacatgacaccctgtccaggggaggaggtgggcaagctaaccgaaagactccatctttgtgtgccccacccctggacatatactgctaaggacatctcaatactagactcagtcaggagtggtggtgacacttgtaatcctagacaggcaaaagggtcaccagaggcttgaggccagccagggctccataaggagatcagccgcccccacccacacacacaccaagaaaaggcggggtgagggagggatctaagtagaaaaagatgagttctgatcttctttatctcttctaaactgtgtttatattgctctgggtccaacaacactaaatcatagtttaacacaggaatcaaaatggaagccacggggagcatagcatgtgggtttctttgtaggagggcacttaggtcccttgcacacagccattccctagcgcaaaggtgctggtcacactgcttactgaggcgctgaagaggctccccccacccccttgagggtcagtttgttatttctcaagtatacagcaccgaggtcagtcagttgtcactccctgatgacgtgtagctgcccgctcactccatgtgaagaagagctccagcaggctacacagagatgctcagccctcagcgcttgcaggcttcccgtcacgtgtccctgctggaaggctattcagtgtttgtatttattgtgccttacataggaaggaagggactcaactgaatccctcctccctctaaacagtcccccagaaaacaggctggtggccatgtgctttgcatctttcttatttgattcttttaaagaagtgtagggaggaaaacctgtcatttttgttgttttgccagaatgaatgacgataactcctcctgttaacaaaactatacttaaagcagtagcagtactctgccaattttagaaggtaattcccagatctgttctcagcaagaaagtaccctgttggatagtccagatgaagaagtggctcactatatatccctgcatagattcctaattatgccgtttctaaatcttaaccgatttcttgaacagtgtttaagtacagtgtgatttgtgccccgagacagtcagaacagagtgtgtgtgctcgtccgactgacagacagacaggcaggcaggcagacagacaggcaggcagaataagcagatgacagaaatggtttcagcagtttgtgctgtaaccatgcctagagcaagaaacctgctcagttttataagctcccttcccaaccaaaatggcttatcgtcattcaaaaaacctgtgacataggcaggccttggaattttgctcctttagtggtaagcatggggcatggtttgctttggggggaggatgttaaaatccagaacttagctagttagtacctgcaaggcaggtgagggctctagcaagcccatgaagttctcagtgagcctcattccctagagctgaacctccactgcaggccccaaatctgagatcacatgatctttacactgctaattcataaagatgcataatacagaaagcctgtgaacacatggaagatgatcctcatggtatgtatggtctgtgtctttggtgaaatgcagactagatacctaagaaccagcttcccagtggggctccctactttgtgtgcaccttgggcagtgcctctgggcactaatgttcattagtccaagtttttgaagatctgcacacagtaagtgatcctcagaaatgtcccttccagctcacaaactcagttggcccgtgctccgttcacctgcgaagggcagcctaatatgaagattgatccttcaatttttttcctgttcattttagtgctaaaaggcttttataaattataataagcctcaggaagaagcaagcctcttacatattaggaaaatacctgaaaagttagttcatttgtcagatccagttttcctacatacatctttgttcacagtatgctaaggggaaaaaaaaatttaggatagaaaacttgagcattgtatatgtttcctggatgtccttgacgggtacaaacactgatgtggtggtagccatcccacatggtgtccagaggaaagctacgcgcatttatactgtctgttctgtacagttctctcagataatgacaatagcttgggattttttttttttttaatgtagaaaaaccctgtagaaccagtgctttggccactttcatgctagcagagtggaccttggtcctccctgcttagaaagctactttagaagccattgtagccacagtggaaagtcaaggtttgtgtcttttctactgaggtctcagaaagagagagaacatctctccggaccccctgactcagagcctcgtggcccggcatcccttagcctctatagcagtgtgctcaaaagccctggctcaacaaagcacatcttcaccacgctccatccggacaactccagtcttgccaacaagtgccaaatatctgaggaacccaggaacccaggggatcccttcccccaagcccgtcagtagcgtcagcttggggcctctcgggactcctgttgtaggtggtcccagtcacaagaaaccctctccaggcaagaggccattcagtctgtacattgtcgggaccggagaggtgggactgccatctgggcctcggtggcttgtttccaaccaaattatctgggcttcagaagccatccctttgctatgcttgacaccaaactcagtcactccacctcagtcatgacctgatataaaagccgtgctagtttcccgagttcagactctcagctttggtttggttttggttttggttttttgttctt

SEQ ID NO: 35230 - DNA, 1850 bp, Mus musculus
gatacccctcaaagccgtgctaagggaggagccatagcaagaaggaaggtgaagactataaaataataagctaagttcaaagacttaatcttacacagtagatcaggtgcttcggggcatgtttattaaccctgaccttggaaggaagctaaagccagaggtttgagaaatgtgagatcagcctgggctacaaattaagactgcttcaaaaaaaggaaagttgaaactgacttcctgagtgcaggcaaagttaccaaagaattggaactaatgtttgttcgtccatttgctaggttggatatcgacagcccctagttgccgtacaggtcaaatttgactctggtcttaacaagaaagaagtaacagttgagtgccatattgctggaaccaggaacctaaaaaacaagaatgagcgtgacaagttcttgggacgtgtttcgttcaaagtcacagcacgagcctaggaataggatgtctccacagaattcatgttgtgttgtcgccattttgtatcagctggacctgccattctaggattatgaggccaccttggaggaggaagtggtgtggtacacacttgggtgacatcataacatgcttccagatcatagtgttcagtgtcctctgaagtaactgcctgctgcctctgctgcccttgaacccatgtacggtcgccagacagggaccagtgagctcccgaccccaaacatgcagagtgggggccctgtcttctttgtgtgtaattgccaaacgtctaaagcttcatgtgctgggctgtgtacatattttatggatttaacactggtaactgcatattttgatgccaacaaagttttagggatacaatggtaccttgccaacatcgagtgactttagctggaagaaatgtctgagaagctctgtatgtgaggagggaaaaggaaaataaagtggatctgaaagtagactctgcttctgcgcatgtgtgagtggtgcctgtccgtatgctccagactgtttcttacaaggtgaactagaccatatctgattttgctgagaggacaaactttctgttgtagtacatatttaaaaatactattgggctgactttgagtgttggaatcaagtcttccacattcgggtatcttagacacagggatgaaacagcatttaaattaggtgaatgtgcaccgatttttgttgttgttgttgttttgttttttgaatgaatgaaattcccaagatataaattgtatagtttttcaaactgtcttgttaagtgcttttatttagtagactgtggaccctaataaaaacaaattgtgaaatacaaaaacttcaaactgatttaaaacttggaacacatgatggagtcttctttcacatcctgactggagccctggactgtccttgtcgtctcgggtggattcttgctggaactgtagtaactggagccctttctgttctgaggagagggcctccatttgacccatgggtttcattcacacgtatgtatgtatgtatgtatgtatgtatgtatgtatgtatgtatgtatgtttgaatgaaagctttttgtttgttggtttggtttggtttggtttggttggttagcatgcatgtatgtgagctgcctgagctcccggtgagtgtggaggccagagaagtgttgaatccccctgtgactcagggcagttgtgagcggtcatgtaagtacttgctcttaagcctacatccttggatggagagctcaaccactgagctgtctccagcttctcatttatggttttatctctcatttattatcttttttttttatgtttacttatgtatatgagtacactgtagctgtcttcagacacaccagaagagg

SEQ ID NO: 35231 - DNA, 1176 bp, Mus musculus
gcaaattctttttttattataattaagacttggttatatattttatttatggtcatatttttttatttatttttttatttttggtttttcgagacagggtttctctgtatagccctgcctggccttgaactcagaaatctgcctgcctctgcctcccaagtgctgggatcaaagacgtgcgccaccactgtccagccataataaatgtttttgctaagcaaaaagaaatactatctcctattaagaaaactgccgaaccaggactggtgccacatacctgtaccccagcagaggcagaagcatcactgccagttgaacactagcctggtctgtcatagcaaattcagccagtcagctgtgcagtgaaaccctgtctcaaacacacaagaaaaggaggaagtaggaggatagagggagggaaagaagaaacatttcaagacctgatcatggtggcttgcatctgtaatcccagctccctgcaagcaagactcaggcagggtgattaccatggcctctgtagtgagttctagggagcctgggctatatgtgtagcaaggctctgtctcagcaaagaactctgctcagagagatgcctctctccagccactctgcaaatctgattgtgaaatgaagtgctacaccgcttgctggcatggtggcttttggtttgattacctggtttggggttttggtctcactgtgtggccctgacttggaacttgctctgtagacaaggctggcctttcagtgatctggaaccatagggtgtgcacacaccacgctgggtagcttagcatgactcctcacttgtagaaaagcagctccctgggtatacagctgctaatggtcctgcccaccatctgtttctaatagccaacgctaagttgtaaaacactatcttggtaaatgaaaaccaggaaggatgcttttcaataaaagcacagaagatccctaaggatgcctgccccatgactgaggggtctgggattctagcaggttcaggtccctttaatctcctaatttaagacagtggagctatttaggatctaggattgtggcttcacccccaaaacacagtggcacattaaatatttttgtaaatagaaaaaaacatgttttgatcacttacccaacttttctcagaattacgagtcatgactattttcttagttttta

SEQ ID NO: 35232 - DNA, 1163 bp, Mus musculus
acagtctctctggctaggtcatgagcttctggtcagtagtgacggtgtcttacacagctgtttgctcctgtgtattcccataggacttcctaaaacatagcagattctaaatcaatcttcagtagttgacaaggtatattttaaaaaactgattcttactatttttaacttaatttcatagctttagaaattaatttattttatgttttcaaaaaatataagtgccttctttaaggaaatactgtggtcattgcagtatataaacatttattaagcaggtataaagttcctaaatttctacctgtcatatttcatataaatattagaatgttttctctcagaactttgctatatatgcgcatgcatgcacatacattggtgattattagccatttaacaaataaatctatgcagagatatgtaatagtggttagtgaataattatgtgtgccatttggatagaagtacattgtaatattttgttagcaaaataaaatagactgagtttgatattttctttttgtcctagggaaaggttcaccttgagttaagactgaatgagctgataacagagaatggaaccgtgtgccagcagcttgttgtacagtaagtatatcctttttattcatttatttgtttttgtcaaaaccacctagaaataattctgttttatactcttagactaatttcttattttaaatattttagaaacttcaaaataaagctctcatgcatcatttctttaccaaactgagaatccagcttattttttcatttaatccacttaagctatggcaagtcattaattactcaacaaagttttaatgaatgtgggttgagcaacaaatgtatgtaagcattaaggcatgaagggtcataggaaggagcctctggcttcctagctgcggagactcagaaagtgtttccaggggattcttctccgagcactcagtcactacgcagagcttcagggagccagggatcagggtgaggaggtcatacgacgtgatgctcaaactacgtgaccacctaagattgctagcacctttccctctaggaagctctcagtagtcagtccaactctgttgtgaggtcatgttctagcctagtcttctacttcttgcctctgtaaacgcttgctaccaagcgtttctcattctgga

SEQ ID NO: 35233 - DNA, 1197 bp, Mus musculus
tactagaggagatggggaactgcaagcaaactgagctttgttttgtccgttgtatatatgtacacccacatcatttgagttttgttgagagagtcacaaagggcttatgaaaatcacttttgaattaataactagatgacaagcaatcctgtgatccactaatttgttttatctcagttataattataaaaaattataggtttaagttgttttgatttaactacaaaaataattatatgtatggatgtctcctggcccttatatgtggatattttttaagtggacttgtatgctgataattctagaccaaagtaaatatggcagaatatttatacatacaaataattttgcaaatattttctataattgtattattcgtttaaaatgttgatagcttgtgttagtttcagggaggggtgtatattttgataaaatacttgactttgtatttctgtacattctatacaatttatagaagagccattttaagacaactggtgacgtttttgttgttgttgattgtataaatgttatgactggtgtttaagtttgcatcgagtacgtaaagaccaagtagaactgaagtgtaaacagtggacatactgtatgccatacgagatatactgtaactcactgtcttcgcatctgtattttggttaggaaatatgattaaatgcagatgttaagggttggaaaggtctaattttatttttagagataatgaatataaatttgttttgcttgattaaaatagcttattcctacattaagtgtcttttctaagtgacttactgttaattcttctgtgtagctatttcatctttatgagtcatggctttgttacatacaacactcattcaccataactgtttccttgcgtgtatttcatggaacctacatgcttaggactcataaactgtgatattaaaatagggaccagacatagtggcagattcatttaatcccagcactcaggaggtagaggcaggcagaactgagtttaaagccagctggtctacataatgaattctaggccagccagagctaccaaacaaaccaatccgagggggaagggggaaaacctgaataagagacatcaaatacttccggtaagtgttggggataagcctgatgttatggtacctcaaagtgaaatcctcacttggaagtattacagaaaacaaatatttactgaat

SEQ ID NO: 35234 - DNA, 1170 bp, Mus musculus
cagcgaacaaaaggatgacataaaagcctttgctgaaaacgtcctttgagtgacaacaacagttagaaatcttcaaaattgtttgtgatttttctttctttctttctttttttttttttttttttttttttttttttttttttttttagttttttaagcttagttttgttcacataatagtcacaaaggatagggggggcagtgttaattttcatttgtgtaaactccaaaaaaaaaggatcctaacaactattttgggttttatcatttacttcacacagaatgagtaaaaaacaaaatagctgaatcctctaacgaccctagtatcttgtgaaggctaatgaagttcttagctgtgggattttgaacagtgaaaacagcaacggaattttagcctaatttaaccctttctcacgagcactaatgaggtctgctgaactgttgttagtcactggagagagcaagggtcaggatcatgaagacagcgtctttgagacgtgctaacgagctatgacaggatttattgccattgagtttctgcactgttaatctttggtaaattaatgggtatttacaaaatacttaacaatataactgaaaatatgtaatggataacctaaagtaggacattcacatatcatctagaaatacttttctgcaacataaaccttgtaaaatacatatatgaatcactataacttttagctgtctatatgtcccttgtagagaatcctaacgagcaatagacctcagagaatgaggactgctgtagaaatcagtagagcacttggaatctgactggcgagcatgtgtatgctgctcaatggaatgctgtgctgttcccttgaagtacagctgagctgttattagaactggtccactcaagtcacacagaacataggtcatgccttatctatggggaaagccttcccagacttacctaagcttacctaggccatataatcctctgcagtggcctcacctcagagaatgaagaatggtcaaattcttcagaactctctgcagtcttccaaggccatggatgttgggggctaccctacccagacttaaggggtcagataatcctgatatctcccattccgctgaatcagcacgcaggaggttgagagcaagacacacctctgtggtaatcaagtctcaggcacttgg

SEQ ID NO: 35235 - DNA, 1167 bp, Mus musculus
tgctattttctttatcagaatccgtcttcacttggcagtagcttaataggtttgttgggttttttaaaattattattattatcttttttacgtttcttgctgctgctagcaattctgtgaaattaacagtctataaaatgcatccccgagcagatacctactgtattgcaagctttctccaagaagaggatatgacagtattcattccagctgatttccttccttagcacaaggactgtttgatttgcagaagcagacgattcattcactgtgcagccgcgctgctgcttaagtgcatggaatgccttcaactgcctggttgcagaatttggagtttgctaagcagtggttagtgattgggctcatcttgcatcaccacttgatggcatttttctttgttccctcctcctacccagttgaaccaagactctgaggctgaaatgcaatgtcacttacaacattaatcagatcccgcatttaaggtgagctatcccttgccgccgcctccttccctcacgcttgtgtgctgcatgcagtttgcgtcttgcttgtgtgagcctaagatggcaggcaggattagccgtgctgtgccgtgtgtgcatgctgtgtgtagaattcattacacgttgcctagtgtttcagatgtgagtatgtaaatgctctttatgccacatcatctggtagggaagacttgttttgcctcattacaaccttcgttattgcgacacgatctttctttcaggattcatttgcttctgggggtttgctttgcatcccattcaaaataagattatgccctttttttttaaacaaagccaaataaatcccacaaaaccctaaaacccaaacgagagcaacagaaccctgttaccagatggtgtctccccgtccttcttgcatttgctgtcttttaaataatgtatgttgtattgttaattaatgtgaatatcaaattaaacacccgaaacttacatgtttattacgcaggtaggaggaaaggtggactatttttaactcccagccactgcatccggtgcaagcaactccggctctcacgtttgtgtttgcagagcccgtgtcagtggtttgattttcagcaaatgtgacagtggcctttgcagtggtcagctctgagctttgaactctcagaggagcaaaggagaaaaa

SEQ ID NO: 35236 - DNA, 1167 bp, Mus musculus; identical to SEQ ID NO: 35235

SEQ ID NO: 35237 - DNA, 1572 bp, Mus musculus
ggtactggagtgattctatatctgcaaatcaataaatgtaacaactcatataaattggcttaaagacagaaactgcatggttgttggaatagaggcagaaaagagcctttgacaaaatccaatatctcttcatgataaaagccccagggagacagagatgggcaacatactccaacataataatgactacagatgacaaacccatgactaatatcctaaatgaagaaaaacttggcttcttcttctttgggaaaacaccaaatggcggatgacgccggtgcagcgggagggcctggaggacccggggggcccaggattaggaggccacggctgcttccggctaccgcggaggattcggcagcggtcttaggggccgcggccgtggtcgtggccgcgggactcgcggaggtaaagctgaagacaagaagtggatccccgtcaccaagctgggccgcctggttaaggacatgaagatcaagtccttggaggagatctacctgttctccctgcccattaaggagtctgagatcattgatttcttcctgggtgcgtccctaaaggatgaggttctgaaaatcatgccagtgcagaagcagactcgggctggccagcggaccaggttcaaggctttcgttgctattggggactacaatggtcacgttggtcttggtgttaagtgctccaaagaggttgccactgtcatccaaggggccatcatcttggccaagctttccaatgtccctgtgcggagaggctactaggggaacaagattggcaagtcccacactgttctatgtaaggtgacaggccgctgtggctctgtgctggtgcgtctcatccctgcccccagaggcactggcattgtctctgctcctgtgcctaagaagctcctgatgatggccggtatagatgactgctacacttcagccagaggctgcactgccaccctgggcaactttgctaaggccacctttgatgccatctccaagacttacagctacctgaccccccgacctctggaaagagactgtcttcaccaagtctccttatcaggaattcactgatcatcttgtgaaaacccacaccagagtctctgttcagaggacccaggctccagctgtggctactacataaggattttgtacaagaaaaataaaagaattaagtctgctttaaaaaaaaaaagaaagaaagaaaaaagaaaaagaaagaaagaagaacaaagcaattctattaaaattaggaacaagacaaggctacccactctctgcattcctaagcggtcagaagagaataagacaagagagggaaataaaagggacacagataagaaatggggtctaagtaacccactcttcagattgtatgattctgtacataatagaccctgaaaattccaccagaaaactcctagacctgacaaccactttcatcaaagtagcaagatacaaaaccaacacacacataaaaaatcagtaatttttctatttaccagtgaaaaccacacaaagagagatcaaggaaacaattccattgacaatagcttaaagataataaaataggagaaagcct

SEQ ID NO: 35238 - DNA, 1116 bp, Mus musculus
taatccctgctcgttattgagaggtcttttttattttgtgaccatgattgtcagtaaacagagcattggtgagaagtcactgacttacggggttcagtgctttcttccgtttgtctcacgtcactgtgacaggtgcttttctagtcacagtgccttctggtgccctctttctccacacctcctgagtactgcagcttacttagctctgagacacacacacacacacacacacacacacacacacacacacacacaaacacacacactcacacacaccctctccaaacactggaagaggccagagaggaaactgacaggaacccttaatgttgatggacaccagaggatgggttgaccctgggcactgaggctgtccagtattgaaggatatcagggcagccatcagaggaaggtgacaactatgccaagtttaagataaaccaagtcaagagaatgtcatggccgtgacagtgacatgggcccagaggctaatttatgtaaagggttgcatgaggttctgtagtccatgtgccaaagctggggtgggccagtcactggttgggcactgttgggcttcagcacctgaggtggcaggagccagtgcatgtggcagatgagggctcagctccagtggcactcaggaccttgctgtgaagtggtggggctgtgagttcaggtcagagttggctacttgcagttctgaactcggctcagagcgtttgtgttggaagctgaggagcatacgggcttcgtcacttgtgccgtcacctctcatgccctagccctctgtcaccaatgcttggctggtcctgtgcccaggtattactcaggctgtaaaaatagagtttggcagagaatgccatcgagaagttggtgaggagagctggggctgtcaccacctttcaagacacttaaccagtgagagtttgatgcagggctttcttgtgtgttggagggatgaggttttaaagctggcttacactttccctgtagctttggattcctatcagtactctgtgccacggactcagattggcacctaccccgacctcaggctcatacccacacactaactctaaaacccaccaagtgggctcatcttgggaagtcagcgct

SEQ ID NO: 35239 - DNA, 3567 bp, Mus musculus
aggaagaccaaaagatcacagtggaccatggaatcttgaagccagccagcatggtggacagaagacagtagttgggaaacatgtaactactatggctgagtggaagtttggttttaggaagtaaggtaccatacgacattaatctttcagtgagtaaaccctgggccgcctcgtcaagaatgctttgaaaagcattcctttctcaaaattgccattttctctattgttcaccagctccagtttgttttactggtttatgacattcagaatacagtgttgattccatgagcatttttggttgtttaaacaaaatcattcctaagtgtatactgtactgtaattttccaaagatggtagtgacaattacaaatgactaacttgaacgtctgcaatactgtaaaataacaagtcgatcctcagtaacacttccccaggagggcctgcctgttacagtgttttatgttatctgacacccataatcactgtattttgacagccagtgaagtagtatctaaatacttcacattttcaacatcaaaatgttatggtcacatctaaaagatctccatcataattgaacatatcaaacaaacacacacagctaatggtttgggactataaaataagctagtggatactgactcagtgacttagcatcctcataccttttccaattatgtgatgcaggtatggatataattttgattcataatgtgattatcacagtctcatacctacatattatttactttaaaagtagaaaactaacaacttgaattttttctacttactttcacattaagaattttaacctttgaattatttccacatctgtataagttattctttgttggtagaggaaatggtaattttcagttttgccctttataggctccttgaagtgatattaatatttaggacaatataaatattacaaaaagacacgctcagctatcagatacaataaatcttagttggcagagagcctgtaagcgagtgtgctacattgcacaaatgttattcctagttccctaaatgctctctcatagagtcaggctagttttagttcattgtgttaacaagataatagtttttaaattttgctgttgagtcaacaacatgtttgaatactttaatatatatggccattataaaggtatttgctgcaatactatagattttcctatggatgttgctatactggcatatgaaacgtctacaattaaactctagtgtggtgctcatcagaggaccttcactttacactttgtgcaatggctttctcttcagaatgactttgtgaatgcactttgtggccttttgagggggtaagggtcaggagagaattcatgttaatttctttaacattgttatgtattaggcagaagcagtgttcataatatttttctggattttaggtatgttttggagatcttacagtattttaagtatgctgtgtaatgccacattattatggaaaaaaatagccgcatgccattgaaagctttctctgctgtcaccaatgaagtttaatccctcttaaatttctcaccttgacttccttgtaatcagtaactggatgtttttgaggtgctcaattggaattaaaaatattccaatctatttggagaccaaaggcacgtttagatccgttacctttggaattattgtagctttgacatctatgacatggaacataccaaaaaataaatccccacgcaggggtttaacttaaatgtgtagagaaggtctcaggctatagtgtttgcctcttcaggtgccactgatactgcctaatacagcgccatttgctctgtgaagatcaataacaattatgttgaatgtcagacatgttctcctgtgttacacagatctcagatgatgaagaatgacatgaaaaccagcagccaaggaacagcttgtgttgtcgtagcaagtccacaataagtgtccttcagggataacatgtagcagtcggtattttacaagtaaaactcacattagcctctagtgcttttaaagttagcgtgtgatctgcaagaaacggggttttagagtctcagtggttacttgtaaagcaaccgctggaaaggagcaaggagatctgtttttttttttttttccctgagcattgtgtaccacagtttacttcatgacagagataatccaaaaaaacggaaatcatatatatgttttatatagtttgtctatgaagtatttctttgaagattctaattgtaatgtttttttttaagtgcatactcagagcattggatttttttaaaacttgttttcaattagataatcttttttttaatgtcttaaagagctagggtggatcttgttgtatacttttgttgcagtcttctcaaaaaagtgaactcactcagccgggctagagcagtagctactagaagcaaccctcacacagcagcagctcctgtggctcaaatgcttgaaatttggataatccagatggtgagttgccaagctgtcatgggataccatacagtgctttaagttgcctgggttggcttttacttcaacttttgtttgttttatttttggactcttgttgcctgagatgaccctgactcctgcttcccctgcctttgcctataagtaccagcgttacaggcttgcccctccacgctcacggaccttgttccagttctcattgtacaactgtgtggaaccatcccgactcagaggggctcgagctagcttgtaattctgataccatgacagcgttgttaggtcacacagcctggtcctttgtccacttttggtagccttattaggatgagcacaacatggggtgtccagaagagtgaatgtcaccgaagtctaaacatggggggctttaaaaatccatgaaatcattatttcagtttgaagaacttaagtggtagatatcagtgtcccccttcctccaaggcccttccttcgtatttctcagttcacatgctcttctgtccaatctgcccgtctgatagggacccctgcggctgatgcacagctcgctctccttctttactgtgacttccaacattcctaaggagatccacacatctgggtaaagaagacagacctttactataatataaaatgaagagtgctttctgcccctcacatcccctataactttgtttctccctaattgcacctgggtttttatgctgtccactttagaaaataaaggactagttctgatcagctatgctaacctttctgaatgtaccccagtggatgtgaattaaattataccaatcactcacagtgtagtcagctttaaaagagctgatgagctttgcccattcatgtgagtgttgctattgttgcggtttttgtacatggctgcaaattatgtgcatttatgttctgtttatgttaactagctgacttgtacttgaattaaaattcaaaaaattaaaatgtgcttttaaaaatgtgtatcttaagattttataatggtgatatcattgtaccagcattaggctgtgtgtagaacagactgcattgttctgagttacgcaaaaaaactttctgcctgttaaacctgataat

SEQ ID NO: 35240 - DNA, 1172 bp, Mus musculus
acacttctttgtgtgagatgtggctacttttacagtgttaaagcagggcttaaaagaagtaaagtttgagtaagttaattatctgatactgcagaaagggaaagaacagttgagttagatcattccacttaatgtagcagctttaaaagccaaagaaagtttatgactggctctaataacttttatagtaggattaaatacatcacagcatttttctcatattaaatgtgttgggtatagtatgtctttctaaaagcaacccgcttgacatgatagtatttgatagaaggtattaaaataactaggttccttatttctctatctgagtttatgtaatggatgtaaaggccagttgaataaatgtagttctgtgaagtttatgttactgatcttatttgggaaagcaaactaaatactcttctatagatgaaacatctttataaattcttgttcataagatagcattttctatgctgttttgctaaaaattaaagataatacttggtcccagaagcacactgctccagcgatcctaatttgctctaaagctgagccaccccgccatggccactgctgctctgcagtggtgtcactaggtgactgtagtgacagagggctgccttctaccctactcactttcttcattgtctgtagaagggaggagagaattccggtctgtaactttttggacaaactttttaagagtttatacttgtttaattgggtaataagtgacccctcctgttaatcctagcagaaatcttacctctgtgttaatattatttaaaaaaaaaatgatgggccaaacttctggtccacagaccaaaatattagtatataatgccatttatgttggattctctttgaatgtagtgtggcaggtaatagattcacccccaggcaactgttttagaatgcatgtttgtgaacttggattataggggagaacaccatgttttcatgtagattaggagaacacttgaagtgaggtcagtctgctcctgacagaatcatctagaaaggccagaattgtgaacaggtgttcatggtcactagaacataaaatgaaaagtgtgaagcctgtatcagttaatagtttcaacattgctagacattttctttaatatagattcatataatgtaaagatccttaatgtgaataatgtatttcc

SEQ ID NO: 35241 - DNA, 1218 bp, Mus musculus
agaaaagacattgaaatctacagattgctaatttgtcctctgaagacacataccaagtttttattttcatacagtgaactcattgttcttaagccacatactaatgaatgctggctactgtccttttttaaaaaagaaatattttatgaatatgagtacactgttgctgtcttccaacacatcagaagagggcatcagatcccattacagatggttgtgagccaccatatggtggcctgagccatttctctagccctcactatccattctaaaaatactaactaaatgaactaaaattttcttttggtattttgacatgtatttaatttttgtgtaattataccctctttattagaagttgatgctttatttttcatatttcctatatgtatattccataccgatttctctttaagatatcttttgtaatttcttcttgggaatgagtttattccccgtcatgttttggaattatatatcctaagttttattattattattttcttcataaatttaatgcttttgttataaattgttaaataatctccttgtatttttgaagcaggctttcacttagtagattaggttgcccttgaactcatgatactcatgccttagccactgccttagttagggtttccattgctgtgaagcgacaccaggagcaaggcaactcttacaaaggacaacactgggacttgtttacagcttcagaagttcagtccatgatggtcatggcagaaagcatggcagtgtcctggcagacatgatgctggagaaggaactgagagttttacctcttcagccaaaggcatccagaaagaggctctcttcattgggcagagcctgagcatcaaatctcatagtgacacacttccttgaacaaggcaacaccaatcccaacagggacacacctaatagtgtcactccctgtgcgctaagccttcaaacacaggagtctgtggaggccaaacccattcaaaccaccacacctgctgttttctgggattgcagatttaagcaatttggcctcttttttcttaaacacagtttttaaaaaatataataatggaagctagagagatgatggtttaatggttaagagcatttgatgctcttgcagaggacctgaattcaattcccagtgccctcgtggagtttcctaatcctctgtaactccagagcatttagtgctctcttctggtgtccatggctctg

SEQ ID NO: 35242 - DNA, 1191 bp, Mus musculus
gcagtggctatggtgggaatggcagctatgacagctataacaacaaaggaggcagaggcggctttggtggtggtagtagaagcaattttggaggtggtgggagctacagtggttttggcaattagtcttcaaattttggatggataaaaggaggaaactggaggcaggagctctggcccttctggtggcagaggctagtactttgctaaaccatgaaaccaaggtggctaaggaggttccagcagtagcagtagctatggcggcagcggcagggggttctaattacagtcaggagacaaagcttagcaggaaaggagaggcagagaagtgacagggaagctacaggttacagcagacttgtgacctcagccaagcacagtggttgcagggcctagctgctacaaagaagacatgttttagacaatactcatgtgtgtgggcaaaaactccaggactgtgtttgtggctaattgtataacatgttattttagtttctattctgtggaaagtgtatagcattccaacaaaaggttttattgtagacctttttcacccacgctgttaattgctaaatgtaatagtctgatcatggcgctgaataaatgtgtctttttttttttttttaatgtgctgtgtaaatttagtctactctgaagccatcttggtaaacttcccctacagtgtgaagttagaattccttcagggtgataccaagttccatttggaatatatttctgtttgcttggatgaagaagccgttgtcttcacaaaccttggtgttgttaaggtaccagttactattgtaactagtaatgagtttcaccgttgaaagggtcatccaagcaaggtcacagttttgttacaatggctgttagcacaccctatgcaatatcaaaattgaataatggtatcagataaaataacagatgggaatgaagcttgtatatcatctgttatcatgagtattcaataaacgatttaattctcttggaaaaaaaagtacactttttttaaacaaatggtgcctgtaaatgtggatatccccagacaaaaacaagtcaaagccttgaaacctaaaactcatacattatatgaaagttaatttaaaatattattttgatattaaatacaaatcatagaacccaaagatctttttaaagcattcctagatttaagagcacagattgtact

SEQ ID NO: 35243 - DNA, 1182 bp, Mus musculus
gcatgtttaaaaccaatcctttttgaatgagattttgattgcaaatatttaagtctagagtttgagagcactttgctctgctctgacttttcagtgctgagtggtagatggctgttcccatgtccccctgggctacctcttgtggctgcattcctcattcgtggttgggcaagttgtttgggctattagaatgcctttatgggttttttttggggggggtgggggtagaagagaggcaaatgaaagctaggaagctttgggggtatggcagccaagatgtatcaatcagttcaggagccatttggcaacataaatttgcagggaaatagtggtgacacaaactaaagccttcccctcctttctcacggcacaaagtcactctgcatgccaactccaaagccaaagcatctaagtgatattcctgggacaacaggcttttattctgttcccaacactcacttaaccttggttaagatcaaggaaggagtggttataaaatagtgaccttcagcaggtatccaggtgagtggtaggtcaaggcataggcctcccaacaactactctgaccaggaatgcaaggcactaatcacactggcttttcccagtgtccagagtatggtatcttgaaaccaaagttcccagatgacctggacaccatgggacccctaggaagaggtgagcaaccaaggaaaggcagattccgccccgaagagaatgaactgacaggtgtggccatagattcgtccattgcgtttcttgccaaatggacaacctgggtctgctcttcagagcttgaagataggtgggctgcgagtctcaggtaactcagaaggttgggaggaggagaagcaggaggatgccagtgagtttccccagtggagaaaagccattaaacccactgaagaagtgtctcaaggaatcctgagtgtattcaagtagatttaagcaaattctgtaagtctgactaaggccccaagtcacacaggtacaaaggactatgattgctgtggcagaactttctgagaactttattgaattaaccattcattttgaccactcacagtttagaccaaattttctgaccttaacaagagagtttgtctcaagggacacccaccaagtctccatggagataaccactgttagaaaaacagcgcccccttcccgtgtaccagagatcag

SEQ ID NO: 35244 - DNA, 1099 bp, Mus musculus
aataatcctgttcattttagtaactaacagttgaatacagtcttttgttcatttagtgatgagcatggggcacaggtaaacctgctacaaggcagtgcctccttgcggtgtgatgctgtgagcgcggtatacgcatcttggtgctcagcaagcattgccgcatggttggagtcgctgcatctccagccgtgcttgctcctcatatccaggctctgagactgagtgaggagagaaggccgctgcagtaatgtttttgtcagtaaccccacactgattgatagttgcttttggttttgtttcttagaatatttattcatagcatattcaaagaagtaaatagctctaacttaattttaaattataataaccgactaacatagcatctgttagtgaattactttatcataaatatgaattagtttcctgacacccatgtcattgtccctgacttccgtcatttctaggtttgttgtggtatgtggtgatggggagtatatcatctacacagcaatggcattgaggaacaagagcttcgggtctgcccaggagtttgcatgggcccacgattcttcagagtaagatgcaaatagggtgttgatgccaatgtggttgatgcttttccctggtaaaagacagtcccagcacagctgcttcattgaagcacttggagagtgtaaagcgcccttgtcctgtctgaattaccatgctgcctctcaggtggatgtgataaatccattcgactggggattcaagaccgatatccttgatggggcctgtgacatgacgtgatgcttgggtttaaggcaaagtaggccctcccagacatggcctctgagggccggttgcgctttataaactagttgggaggtgctgcttatgccaggtcactttgatgagaattttaatgtatcttttaaaagttcaatttctgcatgtcccctactactcattcttaacctatttcagtctgcattcagaatattcataaaatgttctaatttaaagcacaagtcacattaattctttacatgtttacagttcatagtcaccaacacagtcagattatccctaccccaatcagctcattccccaggcccag

SEQ ID NO: 35245 - DNA, 1198 bp, Mus musculus
tttttaagacaaaaattcttaggaagaatgttcttgaaattggattttactttgcattccttatcactctcatcatatctagcttgttcagatttctggtgttgactaagattgtaatagtctgttttcttttttataggttcttggtgaaattcaggaaattgtgaaaactgggctgtgggtaggtgactgcttcatttacacaagttctgtgaacagattaaactattacgtgggaggagagatagtcaccatcgcccacctggacaggtactgagtgtcattttgcttttgtctaaagcagcctaaatttgaaagtgctttatgaaccaaatgtcatgctgacttgtgtaacagtgatgggttaatttccccccattagttttagtagattttctgatggtaaccaaaatcacatccattaaatgtgtaagaatttgagcaagaagggtgtgtgtgtgtgtgtgtgtgtgtgtgtgtgtgtgtgtgtttgtgtgtttgtgtggtggtgtaactgtagatttgggcttctgagttggtttctctttctcttacaggacaatgtatcttctgggctatattccaaaagacaatagactttatctgggggataaggaattgaatattgttagctactccctgttggtttcagtcctggaataccagactgctgtcatgcggagggattttagcatggcggataaagtcctccctaccatccccaaagaacagaggaccagagttgcacactttttggaaaaacaggtgagaagttttgcctgcctactttccttccctcccctctctttctttttaaaagtagcatttgacagaatgttgatacaggttgtagaatgtcatctcttatgtcttaccactgaccatatcaggttggcagcacacacacagcacatctggcttgaactcttgcttctttaggcgtaggaacctcagtgcctctgtcagtgttggagctgattttatcacttttcttacatcccctttaaggttcttggcatttttatttctagcacacctttaattccagtactggggagtcagaggtagttccagagttccaggccagccagggctacaaagtgtgtctctaaaacaaaaaacaaacaaaaaaacaaaccctaagctggacttagttttcctattattatcttgttttaacttaaacatgtggtaaagc

SEQ ID NO: 35246 - DNA, 1150 bp, Mus musculus
ctacccctagttgcaaggcacttaggccccatgatgttagaattaaagccttgctgacccaaaggactcttcccgaggccctaaaagttcctagaaattcaagtggtaaaatccccaacacctgtttcttctctaacaaagaaattagtaggtgtcttaagttcttggtggcctttagtgttttcccgtgaatttttgaggatttggacacgacttatctacctctctgttgttccgggctactctcctagaaaactacccaacaccatcatgtgctataatggttacctcacttgcatgtacagggttcaaagccatctccaaagctccttggaatagtctcccatttcagttccttcattgtaagtgtgattcatggtgaagtttgccggctgttttcagcatgcgctgggatatgcatttgttttctttgttttttaatctttgtttagtttgtgattagtcaggatctcattagaaatctgtggctttcttagaactatgtaatagaggctggtcttgaactcgcagagatctacctgcctctgcctcccaagtgctgggatcgaagtcttgcgccactctgccaggcttgggtttctttttatagtacattcgcttcaagatttcacctaaactggtggaaaatgtttacattactattattccacgttattgttttgttttaaattctgaaccaatttttgctcttataaacctaatttgtaatgttttgtatgcaatggtcatatttatcttgttttataaaaataaaataaatgtccctggtaaaggtgagtcaaaaatcatagctgttcagcttttagctgttcagttttgtcaacctattttaccaaattccctctttgttctcaggctaacctcaatttttatcttgctactactaatctgcttttaatttctttttgcattaatacagatttaacctaggatctcacacatactgggcaagcgctcaaatacatgtacatccctagctctctccttacttactctttattttgagacagggtctcactaagctgcttgggttagctttaaactcattctgtagcccagacccaccttgaaaatgaagtcctccacaggagccaccctagaagctaaggttattggccagagtgtagct

SEQ ID NO: 35247 - DNA, 1832 bp, Mus musculus
aaagagtgtttaattttgttgtccttcttaatgttctcagtcaaataaatgggtggtttcatctgtttggggacatgtgggtgtcttctttttgggaagcacagtctttgcaacctgctcccactgggactctccgaaatggccacgtcagtggacaaaccagccttaggagtgggcttgggctcagggcctctgcccggcttccccttgctttcttgttccacatggacaacctgggaggcctcttagaccaggaggattcaagcctaagaggaggagatgtttctgacagtttgctgttacaacctcatctcccctgactctgctgcactacatgtgtgcatgtgcacatgcacacgggaaagccagggcagtgtggctcagtagctagacactgacagtgctccatccatacttgctgaattgcttgtctcggtctgagaagatggaaggcagaaagctaactgcattctggagtgaattaacactctaggctgtactaacatctacttgaacaaagactgattagccgccaccttgactttgagcaagctatattttatatcttcttaaatgccaagcttgttttgcagcacattttctctctctggcccccagccaaaggcccagatgccctccaggttggctttgagaccttggtgttagtatttggaggatgtcagactagagttaacacagatccccaggcagcacagatgggggatcgtcagatcacatgtggacggtgatcactctttgttcctgcgtgcatgtgttaactatatctcatcgtaactgactcagattagtcagatatgagcccgagtgctgtgtttctgtgcctctctaaaattagaacttctgcccagaggcaccctaaggataccactcattgtcctgtggttcggtgggtgctcctaaaagaagtgtcaggtcttcagcatgtgttttatacatctgccttgacccccttgggggcgtaaagccacacacttgtgctgcagcctctgccagtgggttacttggcattcttggcaaatgcctctataagattaggttgaaggcaggcctgtagggcatcttcttagtgattggtgattggtgtggaagggcccagaccttaggggtggttccaccgtgggatgatagtcctaggtagtataagagagtaaactgagcaagaaacattcctccatggcctcttcagttcctgcctccgggttcctgccctgtatattcctggcctgtaatgtggaactgtaagccgaaataaactctttcctccccaagttccaaggtatgtgggggtaccaccaactgaagttgatgtaatataatttcattacctacttaataagcaggctggaatagaccgaagcaattttagattttagagtggagaagccatccaatctgggaggataccagttctctaatctccaggtttctctgaagcaatatcttatttacaatatcttcgagcacctacctcaagactggctgatccccacttccccacgtcttccttccgtgttaccttccacttgagtaagaaaacaccacggtcttcagcagtatgacagtgaatgacttcgatctttttctaattcataaaatgtgatgaagtaaagatttaaattccaaaatgctacatgcctgcaccaatagctgactgactgtgcgcctgcaccaatagcaggtcattccccagtccatcatatctcccatctgtttgtgggcttatcttaagtcaacagaattctaccaagttaaatttgagtgtggctctgcccttggtctttgaataaacatgttctccatgtaaatttgtt

SEQ ID NO: 35248 - DNA, 1225 bp, Mus musculus
ggtgtaagactgtccaggaaaatctatggctcttttataatgtggtttaagattgtgtattatgaatttcattttttattattacatttttacttttgtgagtgtagtatgccatgactatatccatgagtgtcctgaaactggtagtggctatcctgcctccactcccaagttttctcagtgttacaggtatgcaccttcaatcccagttttgatggttgtaaggttaataacccaccggtatttctctataatgttttaaatttgtgtgttccagagattcaacagcatgtatattttatatgtgagacccattttatctgtgttagtttgtcatctttcatggtagcttcctgtctagttttatctgcttggtaaaagacaaaacccaagttagtttgtattgaagatattttgtgttcttttctttttttttttttaaaaaacaaaactatttttagctatgaaaaatgtaacattcacaaaatttctttaggtcttcatgagtttgatgccttgaaggatcccgaagtgaatgaatttagaagaaaaatgcgcaaattcagtgaggccaagattcagtctctggtagggttgtcttggatcgactggctaaagcacacgtatccgcctgagcacgagccgtccgtcctggagaacttggaagataaactttatggaggaaagctggttgtggctgtgcactttgaaaatagccaggtattgtttgatataatatttatattctcttgtaatgagcctctgattttatctgactgccactgcattcttagaagtgcttcttgcttagaaagcactactgcaaagaaaactcgcagagtcaatagacttagtctgtaattgtgtaggattgggataggctttgtacagaaattcttgacgtgttacaatagtattttagagttgtcatttttagagttgtcaaaccacacttcttaattgtcttttaaagttgtttacctagcacacacaaggccataggttcaaaccctagcacttctcttcccctccctgcccccacagttggtaaaattggacagaaatcattaattgataggttactcagcagtaaggtatggatcttttcataccaacacatgtctctttttttgtctctgctgggcatcaagcctaggccatggcacaggagtgcacacctgttattccagagtcagaaacaggcacatctctgagttcgggacta

SEQ ID NO: 35249 - DNA, 1099 bp, Mus musculus
tatctcctcattgggaaatggttcatttttctttataatgtcttctccactactgacttgaaagtttcatacttcagttgtctttttttgttgattttgctgatcgtcataaaattctgtatatatactttctcacccagtaggcagaagccacactgtttcttgaaagattaatataagaatttctaactaataaaaggtggttgaccactaaaagggaagtggcgaagaagactctcacaggtccttgctgtaacttgagaaaatgtatactacctccaagagctaaggggcagcaggcaagaaatgagcttagaaacatagctaagcacctgtgctgtgctgaatcggacctcaggtgctggcacaggaatcctcagtccacttagctgagcaacttaagatggtggactgttgctaacacagacggccagggctgtgctggcagagcctgagagtgtaagttactatgaactgcccttaaaccattcggctaaagagactgctcatcagaagaaaagctgtcatctttctcctcgcagtagccctccatcgtcctctgttgtcaaagcccgaatcaatcctacttcagagctgcgatctgcagcttaaggtacaagtaactgaccttcctcgtgttgagagctcatgctctcaggctctgctaccacagccatggccctccaggtcattccatatatccatgcagatgtgtgtttttaagatgcatttctgattgtacacatgggggcaggtgtgtgcatctgtgcgtgcaggcgctcatggagatcatctgtagcagtggctctcaacttcctcacgctgtgaccctttactacagttcctcatgtgctaacccccaaccacaaagttatgtttgttgctacttcatacttataattttgctatgaattgtaatgcaaatatctgtgttctggtagttttaagtgacccctgtgaaactttgaggctcgttggacctcagagggggtcaagacccactggctgagaactgctgctctagagctgataggtggttgcaagccactcatcatgggctctgactgctgagccatctctgcaggcctagttttatatt

SEQ ID NO: 35250 - DNA, 1681 bp, Mus musculus
gtttagagtaactcctgggcagttactgagcacaggagagcactcttgtggaaataaaaagcatccaaagtcaaagccacccagagctaaccctggttgcttgtaagcctacatttgccccaggttctgacgtggagctgcagtgtattttcctaggggcaacagtgtgaagagttacatgctctgggaaagcctaggggacaaacctctggtatgtggcattatttccataggaaattttgagcccagccccaaaccaaggtctatgtctgaactctaggttcaggaggctgcaaaacagttaattcctaggaggaaacggagcctttatattctgttaggcaagggtgagacgaagtcctgctgttcgcccaaagacatgttaagaggaaaatatgtacattatgtatttaaacaagtgccttttacacatttcagtttgtaagaccagatagacttctgttctgtttctagggtaagccacccattcagacaataatccctgctatgttcctgttgtcttcaatgatgcttttcctttttatttattattattctgtgtaggatgtcacgtgtcacagcacacgtgggcatcaaacactttctgtaggttctgggcaggcttgtgcaacagatgacctttgccctctgagccagccatccctgatgctctgtaaagaatgcaacagagcggttatggcggcaaatgtctttagtcccagccctgggaggctgaggcaggtagtctctgtgagttcaggccagacaacactacaatgtatgactgagtctcaacaaaaatggcaatgttctgcctgggcctggtcccagaacttgggaggctgaggctggcctgccttaataacacaatagtgttcactctgacttgtaggttatgtgttatttattatagactgtaatattcatagttccaactcccctatcaagtgtgagatgtggtttctgctactgtattcttgcgcagatgtgtgttcattccgcagcatcctgaggacacagaacagtccagatactgtgccgtcctttccaatggccagtccatactggaatggtctcttcctgtgtagcaccgtccattttaacaattctcagtgtaggcaggtggatctctgagtccgaggccagcctggtctacagaggaacttctgggacaggctacatagagaaaccctgtttccaaaacaaaaacaaaaacaaaaaacaattcttagtgttgtaacattagttttttaatgtttacaagctctgtacttggttacatactaagcaactacactactttgataaatgttttagactatatcccaattgaaccacagactacttgatgcataataaaagttttgtaaatatttctacttgtgtgtatatttctatttgtgtgtggagagagaaagagactgaaggatccccttccctttttttctttgtgctaggacctctcactggccaggaacttgtcaaatagctagactggctggccagtgaatcctaggcatccaaatctccagcttccccagtctggggaatacaagatgcaccatcaccatacctactttttatatttaagttctgggactcaaactcaaaagtatttgcaagacacatactttttgactgagcaaacaattcctcagcctgacatttctatcttaaaatc

SEQ ID NO: 35251 - DNA, 1376 bp, Mus musculus
gcccatgtcctaaactgaccccacacgcaggtggacaaaatggccgacttctggccatctctggtccagggctttcatcttccacaatcctgtttcccccacgtgtggcatgggtagatgacactccagaattagaaatgagccctctgacagagtttccagggaggccgagtaaaagatgctcagtgcatctccatcgccagctgacaggggacgtcaggagacctggttggctgtgataccgcatgaccgaggaccccttgggtctgtactgagctctcattccgaggttccctgtagttttttcagaaatgtgtgttcccatcacatctgatgtataccttccctgcaatcccctcacctctgcctctcttgtgtgccgattttcttccattactctgccacctctttataggttcatttgccccccccagccatcccctctcccccagtatggggctatgctatggccccctccttcccaagcaccatgccacacagggaacatctggatgctccccttaggagctcctcacacccttccatggctcttgctgtggagtacctgattggatgcgtgtgacctgtcttgcctgccaggagacatgacccactgaccatgccagctctaaccccaaagcccctcagagccatcacactaagtccagagccgcagaggggtccctccttttagcagcccacctggttggagagtccacattgggtcaggtttacccacaatgccagatacttgaaacaatgagccctttgcgtgacagtattagcaggtggcagttgtcgtgtgaggagcgagagtgatgcctggacatcttgttgacgcttgagccttttatgtactttttatcaagtctttgtgtatctctacttattaataaagaaacaatcagagatcctgccttatttcctcttccccaaacactgcccgttttgcgagcttttagttctttactgaaacacccacctcttccagagcacagccttgggcttagccaaacctaaagcaaagaggaagcacactggtggccatgcaggtatctttgcctgcaggagcctgtagagaggagactatcttatgtctgtacggatggggcacctgtcaataataaatctgatggcctatgctgtggcaggaatagggggtgggacatccagaagacagaaggagtctgggggaagtggcaggcaggagcttcaccagggaagatgtgacgagacgatcacatggtacccgagcacagataaccagctacgtggcagaaagtagattagaataaatgggttattttaagttatagctagtcagagaagagcctagctatatggccgaggtatttgtaaatatactttgagtctga

SEQ ID NO: 35252 - DNA, 1194 bp, Mus musculus
gggttttgttttattatttgtttttttcctagcctaattcagtaagttctcaggcttccaaatcagaaggatggtggaatagagcaaagtgagggatggtcactgtaggctttgaaacgtcaaagggaggctgatagtggaagccttgcggggaccaggtgggctggctttgacaggacggggaatcgaaagcttcccagcaccccaacgtcctgtcattagtgtggcagtatctggcagggtctcagagcaaacctggagagcaggttgcctggaaacaagccagatcaccgggtgcttcccgaggcagcgtttgctgctgggagactagcttgttctgcaaacatgtcctagaaagaggcagctgcttaagtgccccagcaaaggccatgcagtagctggggacagctgggtgctgtgctcatccggaatgaaataggaagtctttttcctggatgaagctaaaatacttcatgttgagaaaagggaggagaacctccccatgatgactaaaaatgcatgggggcgggggtgtagaatctgcttcaacttccggtcccttcaaattgaactcatcagagataggaacaaacagcctgccttcctgtgatcagcagggcttagcaggcagtgtgtgcggtgtctgcagctgctggggcccacaccctccctcccaccagccacacccgacagggctgctcacctgagagctggtctgtcaccagccttcgccttccttggaagacttaagtatggttgattgcaaatgaatgtttttaaaatgttgtatttaatgcaatgcttcctgctctccatatggccacccaagatacaaacacagagatttccaagttgttttttccagaacatcactgactttaaaagctgtcacaacagaacttgggttttgtacagacgtcagagtgctaatgtgagaaaacctgggaatgaagccttccccgggccacctattgccgccgctggtgttggggctgtaccctccgatagcgttttgtaacaagacgctacagcgttggttttagaaagtaccagtaactgtaaagaaaccaataacacgttgctgagacaatcgtgaacccaaaatagcatgagagggctgaagaccctttgaactctgtggataaatcttgcctgtgggtataggcaatggtcacataagaagtgctttactcg

SEQ ID NO: 35253 - DNA, 1148 bp, Mus musculus
tcgtcactttcagacagaagtagacttcatttcaggtcacactgacatagacacagcaagatctcaaatgtgaacagagagcaaaagtaactaggaaattcatttagtgacagaaccagtgttaatagtttctgcttgccctgaaactcagtaatttttatgttttatttttattattttattatgttgtattttattaaaatagaacttatagactaatttggaatctctctttcccccacttcctgtagcttgatcatgacttaaaacatgcccatgagctccgccaggctgcgttcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaataaaataaagcagagtgacaaaaggcataattgaagaatgaatgggacctggatttggggggctgtttgtttttagaacatagagtggcatggccatgctggaatgatacataactggcctgctgattttgtcattaatatgaatcattatgttgcacacttttgcatgtgttctgataaaaatcatttctagcactgtgaagctttagacaccttgaaagatctaacactagaattgtaaatgttatttattgatttaccttctaatgccattgagaaattcaaatctctattgtatattgttctttaataatgtggcttagttttatgttttgatttaaattttttattttatttttttgctactgtgcaagtttaatgtgaataaaatctttgtggaatgatgattttatgtttagtgagtggtcatctgaactttccagctcttctgaaatgtctcactggtacctcaccccatgttagtgtgacactgaactcatgttctttatggaggtagttgtaggcaagaagtgcagtgtagtgttaaattctaacctggctcccccaacaaactaaacggctagaatttactactcaaaaacttacagtctgatggagtccacagaggattgcagacattaaccagccgatccacatgtcctgtcatgagttgctgtagtaacatgtttttctattga

SEQ ID NO: 35254 - DNA, 1197 bp, Mus musculus
ggtccctctgtgtagccttggctgtcctggaactcactctgtagaccaggctggcctcgaactcagagatccgcctgcctctgccgcctgagtgctgggattaaagacctgtgctaccaccgcccagcttttatgtagaatttttaacatttcatttttactccttgtatctggagtccatacttaggtttcattgcttattgtttgaaggtaataacttgtataaaccagctgctctgattgttacaggtgggattatagtgcaacggaagaaactatgaaggaagtaatggaaaaattgaaccatgaccctaaagtcccctgtaacttcaccatgacagctgcttgttatgatcccagtaagccccagacacaagtgaagctggttcacaggatcaatccacagacgactgagttctgtgcccagcttggcatcacagacatcaatgtcatgattcagaaggccagagaggaagagcaccatcagtgtggtgaatatgagcagcagggtgacccggggactgaggagtctgaagaggaccggagtgagtacaacacagacacgtcggccctctcctccattaatccagatgaaatcatgctggatgaagaggaggaggaggaggaggaggaggaggaggctgtaagcgctcacagtgacatgaacacaccttctgtggaacctgcttctgaccaggcttctgacctctctacaagcttttctgacatcaggaacttaccaagttccatgtttgtgtcctctgacgatgcatcccgttctccagcaagtggagaggggaaatgtggtgaaacggtggagtctggggatgaaaaagacttggctaagtttcctctgaagcggctgagtgatgaacacgaacctgaacaaaggaagaaaataaagaggaggaaccaagccatctacgctgcagtggatgatggggatgctagtgccgagtgagacagaggctggactgtgataaatgtaggggtgggatttccagaccctgtttttagggcagaatttctgatttattactggactttgtaataatgaaatgatggaattttggttataagctctgtatttagatgtatgtttatatgattcagatatagacttattaaatttcatatgagatttgattgatgaccatttttaagacattcacttccatagttttcagcacttagtac

SEQ ID NO: 35255 - DNA, 1199 bp, Mus musculus
tgcctgctttatagagcatatttttttgtgctgtgttggaaatggtgagccagtgagttgcacaactgatactgtggagttttactataattaaacataccttttttaatctttctagatgctaacagttaaaaaaatttacattttaacagtacagatatatatgtaatactataatggaataatggaaatagtagctgcttattatgaagtaatatctaacctttgtgaggaacactttattttctactttattgagaatgcgggttacaacctaacattgtggtctgactcacagtagtttgggttggattgtaatcaggaaagtgcaaagtagaaagtataaggaaccaacttacttcaatcaaactgaaaaacatgaaaaattctgataatgccatatgccaatgaaatagttgaaactacgataaaaaattcttgggggctggagagatggctcagtagttaagtgcactggctgctttcccagagggcccacattctgttcccacccacatggcagctcacagttgtttgtaattccagttttaggggatgcaccaccctcttctgtcttctgttgggtactgtatacatgtgacacactgacacacacaggcagaacaattacaaataattagatctcttaaaatttttttttgagccagggtcttactatgtagttcaggctggctataaactctgtaactgaaggtggcttaataataacccattatcttcttgcttcagcctcctgtgtactagtgctacaggcgtgtatcaccatggccttacattaccacttctggatagagcttaaattggtaatagtgaatatataaagtttgtttttttaactactacattggaagtacatctgctttaaacctttatagtctagatgagggaaattattttttggtttttgacgttttgatttcttttttcaaagacccagtcgttctcttacgtagttctggttattctagaactcaatatgtagaccaggctgactccaaactcaagagttctgcttgtttctgcctccgaggtgctgggcctaaaggtgtgcaccagacaccatgcctggctttaaaatgtcttattatttaacttagatttggtttatgtgtgttgtgcctttgtggaagtctgtgcaccatgagtgtacagtgcccaccagaagagagcataggatc

SEQ ID NO: 35256 - DNA, 1183 bp, Mus musculus
atgttatatagcatacagattttgacaaatgcacaatgatatttacctcttgtttagaagtgtttcactgtgctaacagccctctttacttggtgattccacctgcaccctaacttccaacaatcactgacagccaaagttttaccttctcaagaatgttaggtaatcagagttaggcaatatgcagtcttttcagatggctccttttatttaaaggttcttcatttttaattttatgtcttgttggagcaattgttttctacatctaataatacttggataccaaagcttttttacctactcaccttctaaaggacttcttggttgatcccaactttgatcagttatgaataaaggtatataataaatatctttgtctaagcttctttgtaaatgtaggattttaactattttggataaatatcaaatagtgtgatcataagtgtgatggattgatatttcatgatatatttattttatttaaaaataattttttttaaattaacaggtgtgactttgaggttgaataaccagtttgaattatacagaaatttctgtactgtggaatagcttctccagcaatgattacttcagagttaccagtgttacagtaagtatcatacttttatttatcgtctagagaaatgagtcagtattacagggtctgatgaaatatatcaaatatgttctgttattgagacagtatatttgaaatctaaatattagggcatgggattactctgcctttgctattgaaatgtcagcatgttttctgatgctaaagtcaggtattaatgtttttgtatcaggggtcagccagctattatactgatttgttataaattgaattacagctgtatttatttcctgtatactgattccagtttctttgttctttgctatgctagtaactgtattgtttggaaagtcaagatattcagtcttgctattgaaaataacacatttattaaactttatcttatattgtccttttaaaaacacatttactgttttaatttctcctactaagattccttctgttatatttttgaggcattctggttttttgaaaaatctcaggcaaaaccggttggtgtgtgtgtgtgtgtgtgtgtgtgtgtgtgtgtgtgtgtgagagagagagagagagagagagagagagagagagagagagaaagaaagg

SEQ ID NO: 35257 - DNA, 1157 bp, Mus musculus
cgactgccaagttgttccaacaggtgtctctttcactgtgcttatcctagtcattccaaagagcactaataagagtttgtcaaaaatagtcataaaaaaggcatccagttggctgagtggaatttacagtcaagatgattttagtttttataattgaacatcatttgatctttcaggtgctgctcttttaaaaaagcacaatttaaacatttgctagcatatactgatatacttatacgagttcataaatttcccttcaagccatttttctttgttacagaattagtctttcagtcacactttatatattatagagttagtaggtgtcatttccacattaaatttattcctttttatttgggggataaatttttttagtgatatatgacattggatagggagtgtatgcattttagtttattgaaatttctgaaaatagaaatgttaaaagtgctgcttgtcagggaagtagtagaacagagctgcattatatttatttgttaatttgttcactacaataatctggcattttctagggattcaactaatgaaactactgcccactctgatgctggcagcgaacttgaagaaacagaggtcaaaggaaaaagaaaaaggggtcgtcctggccggcctccagtatgtattatattttatctttatgcttcaatgctttcccataaataagcttgaaatgagttgtttgtcagttctagtattaatgctgttaatattttatgctttttattcctgtaacagaagagattcttgggaactttgctttggcttagcagtttcagagaaggaaatttgtagcattgtctactgtctgtacttgaaagcacagagggaatgttgaatgaattgcagttaagacatattgctctttgccctcaacatttttttccttctggtagctccttaatgtgcattttgatagtagtattttaacgatcgaggcaagttttaataaataggcttaatgattcatgagttgaaaatttagaagagtgcagggtgtcactactttgggaggcatctttacagtctatgcgcttcagttagcattcaagtatagtaaactttgagagatagtacaaatatattaacatgttaatattacattttattcatctgtggtctgatttgctattgta

SEQ ID NO: 35258 - DNA, 1206 bp, Mus musculus
gcaggctttcatgctgctctgtgatcttttaatgatttttagccaccaattaatgacaggtggcagagagggccttcagcctttggtgtttaatccagatactggactccagtctgaactcctcagttttgtgatggatcatgttttcattgaccaagatgaggaaaaccaaagcatgggtacttacgactttttcaccttgtcaaccttaaaagacagcagtagggtgtagggtaaatctaattctaaaatttacagagatttctctgttcttaaaataagttggataaaaagattaaagaaataagctggatgtggtagtagtgcatgccaataccctgtgctaattgtcaattcagcactgcctgggctccacagtaatttctatgtgaagaaaaagactactcccaaataacaataggccaaaatgtgaaaatgtcagtatacacatatgctgtcatctagatctttgagtgtaagttttttagaattacaaatagataagccagtgtggggaagacactatttgttatgtttttacaaacttttaaaagtacatttcagtgggggctgaagatagctcagggtttaagaaacctgctgctctcccagagggacatgggttcagttcctataacccacaggggaacttacaactgtcagcaattttagttctagggaatttgaagaccccttctgatctccttggacaccagacaagcacatggcccacatatatatacatgcaggcaaaacactcatacacataaagtaaaataattatgggggaggtgtccttttgggttgttgggtttttgggaaagggtttctctgtgtaacagaatccaggttatgctggactcgatttgtaggacaggctgaccttaaactcacagagatctacttgcctctgcctcccaagtacttgaattggaactcactaagcctggcaaaataaattgttttaattaagtaaaaatgagagtacattttgtttgagtctggagacagagagctcagtgtttaagaacacttgccgcgcttctacaggacccaaggtcagttctggcacccatgtcaggacatgtgccatatgctcacatagacaaatacgtatatgtaaataaacattaatgtgtttatatctgtaattttgaccgattagataatcaaatataggacaagcaccaaaaatgaagcctgttt

SEQ ID NO: 35259 - DNA, 1129 bp, Mus musculus
aataaaagtaacctacaaactgaatgtgattcccatcaaaattccaacacaattctttactgatcttaaaagaacaattctcattgctggtgggagtgcaaacttgtatgaccacattggaactcaatttggcaatttctcagaaaatcaggaagttttttttttttaaaaatcaggtatttatttcatttccatttccaatgctatcccaaaagtcccccacacgctcccccacccacccattcccacttcttggccctggcgttcccctgtactgaggcttgcacgagcaatgggcctctctttccactgatggccgactaggccatcttctgatacatatgcagccagagaaacgagctcgggggggggggggtactggttagttcatattgtttttccacatatagggttgcagatgccctcagctccttggttactttctctagctccaccattgggggccctgtgagcatccactatagtctcacaagagaagctatatctgggtcctttcagcaaaatcttgctagtgtatgcaatggtgtcagcgtttggaagctgattatgggatggaatccccggatatggcagtctctagatggtccatcctttcatctcagctccaaactttgtctctgtaactccttccatgggtgttttgttcccaattctaagaaggggcagtgtccacactttggtcttcgttcttcttgagtttcatgtgtttcacaaagtgtatcttatattttgggtattctaagtttctgggctaatatccacttatcagtgagtacatattgtgtgaattcttttgtgatggggttaactcactcaagatgatgccttccaggtccatccatttgcctaggaatttcatgaattcattctttttaatagctgagtagtacttcattgtgtaaatgtaccacattttctgtatccattcctctgttgaggggcatctgggttctttccagcttctggctattataaatagggctgctatgaacatagtggagcatgtatccttcttaccggttggaacatcttctggatatatgcccaggagaggtattgctggatcctccggaagtactatgtccaattttctgaggaaccgccagac

SEQ ID NO: 35260 - DNA, 1125 bp, Mus musculus
tgatgattttataaataccatacatcctattaaagtaaaataaaacttcagagtagtaatggcagtaaagcaattatcatgctattaccaaatctagacacttgtataaatgcttgtataaatctaccttcagattaggggatagtgtctagtcttgtctaaagcctttctcaactgacataattgataatgtgaacaaatataaggctctgcctactgaagagctttgcatcctgcttgctgttctctcctgcgtcaaacattcattgtcattcacacacacacacaggttttaaaaaacaattctaatttctttatactattttgtctgccagtcgccaattaatttctctggttcctaaatggtattggtcctgcgatgtatttccatttgctttcttcactctgaatctctggtgactatcgctatactgagtttcctactgcagactcctcacacccacctacctgcgaggcacctgcttccagttatgttacccatctctgtagtctgctgcagtaacaagctgcctgaactacacgctatgatgtaactgcctgagctacatgctatgatgtaactgcctgagctacatgctatgatgtaactggtaggaatggttcttccacagatttccaaataaatgtagctaattataaagttttagaatttaaatgttttatacactgatatgtaatagaattaaattgaacatttcttaaatcaatttattcatattgtctacacacacagttctgatttaagtagtaccagtgtacttattttatcttaaaacttgatctatttgtttcattaatttgaaaaaaattttcagtgggtatagtggtgtgtgcacccagtttcaactacctgggaggatgcggcagggggatcacttagcccagtctagacaacacagtgggatactgtcttaaaactaaataaaaataaaattaactatttcagagtgtcagcttatttaactctccttctgctgacgaacattagattatttctagaaattggtatcttgggatttttacttaagcaatatatatagtacattttcttggtgtattttcttatttgaacatcactcataatccttccttaaaggtttattt

SEQ ID NO: 35261 - DNA, 2128 bp, Mus musculus
atttacaaatctggaactctattatttagagctagaggcctatatactgtgatagcttgtatgggggaagaaacgcttttgatgtgatcgggtttgttttgtaatcaaatgattaaaggttggtcccttttgcagtgacagagcagcatgtcagtcacccatggaaatgttggtgaatgtcacctcggaaagactgaccaaaaaaatcatttgtactctaatgttggacttatctcagtacagatgtgtgtgtgtttttctgaaaggaggaagatattttaaatttttaaaacagctgtcaaaataaacactgttatacacctgttttatgaaaatcagcattgagtaaaaaaaatatttttaactttattttcctgttgtacaatttaaaaaccgttttaacattttgcctttttatgttttaaaagctaaccatttttattaaactatgagtaagcagctcgttctaatcgccgaagagtgtttttggagctcgctgggttttgttgaccttgtaaagcagacattgaaggaacagagcatggacaagctaaaatagagttctaacatcgtgcatctctgccaaaaaccacacgccctctgtggatggatgggaatccccagattttatatactcttgaataaaaaggtttatttttatttataagtgggcataagataagtgcccatgcagccatttttccaacagatgctgtacaccgttcattttctatagaatagtgagattcaaatacagtgcattttctattggtctttgttctgtgcatttttagcaacttctaccagcaaataaactattctcagtaaaacaaaaatggttctcaagttatcagtctcactgttgttaacacttgtttcatgccctgccaaagtcacgttacacagacttccgttttcttatagtcatgaaattttcctttgccattcagaagtaattttaagatgtgtaacgtaactgtcttcccatgcactcagtatcccctcaacccactaatgttgtgaaatgtttaccaatcatagatgtatgtgctgcatagaagtctgtgcttagaaggtggcgttctaagcttaccgtgaaacacagctacatttcagtgttaagtgtgcatattaagaaaaattcttttggagaaagaaattctgaatcttcgggacagtcttcagtggcttagagttacaatcagcttacttttatgacttgctattattttaaaaatccacatagctttccctgattttagtgtaggcttccaaatttccaaaccagtctgtccacagctgtttctgggctggttttttaaaatagctgcaacagaattgagaggctttccctttttaccaaaaatgaacattttttaaaagtatatgaactctatgattatcttttgtgtgggaaaataaaatacgattttattcatccttttagtagacaagatttttctcaacatttgtacagttcagagatttaaaaaaaaaaaattcttggtcaccaaaaatgttttacctactaactcagcaagtcctaggctccagttaaaacatctggggccttgctctctcctagaaatgtgggcttcactggaactcaaggggcaggaatgaatggactgcacacctcagccctgcctcactatagttcttggccagggacccagctttgaggaaccctggaataagcacagataattctttgcctgacgatctcctgtgaacaccacatgctgatttaagggttacagactaccatgcaacaacaaaggcggcttaatctctactccagtgggtttccaagttcagtttaaagtcaatcaaatttttgtattttcagtgtctccttgattggttttgctagtaattctgtaaattgtacatttgcaaaatgatggttttttttccttttgtacaatttgaaactgatgcttcacctttcctttaataaactattcaaaatcagccttgtggttatcctgttgctgctcctgggcaaggattatggacagtttcctttctgctgcccttgagagtttgttctttcagatattttgttaaatgatagtagttttggtgggttttggtgtatttgagacaaggtctcattttaaaccag

SEQ ID NO: 35262 - DNA, 1314 bp, Mus musculus
acgctgcccacatcgttggcctatggagctgagcatggggctgggggtggttgacttcggtcacgcacacagtgatggctttgccttccactcaccagggtttgtggatgacatcatccagccatcctctactcgtgctcggatatgctgtgacctggaagtcctggccagcaagaaggtccatcgtccctggaggaaacatgcaaatatcccactgtgagcagatggaagggactagagcaacagttgaaaagctggccttttgcagcgtacccctccctgccttttacaatcatgaaaaaatggatctatgtatcttggacactgattgatttgcataaagagttcttgggcctggagtaaaactatgtgctctattaaaatcattggtactttttgaataaatatttcattgttatagtaaaaatctcaatcttatacaagaaagccagaaggaggcgggggatggaatcatagttgactgaatcaggctctggttcacactgatgtgggtatgatttttgtggccctcagaggtcgacatgctggagcttgaactccgtgtggggtagtgagagcagagagatagtgggagatgctgtggtcagctgggctgggctctgtgctgaagaggctaagagttcttagtctttccccagctgctcgatagctatgtgatgtctcgatattcccccaccccatgcgggctccacggtgtgatacaccaggagggttgtcaccagagcttcaccgatggtagtgccttgccattggatctcagaattatgagctaattaaaccccatacctcttcataaaattaacctgccttcaagattttgttatagtaataaaagcggattaattcaacatacttgggtgttgtttttttattccccccaaggaattaattttaatgcatgggtaagataatgtggctttggagcagcttattttataggcctcagtttctttctttctttttttattttaattttttattagatattttctttatttacatttcaaatgttatcccttttcttggtttcccctccaaacaccccctatcttcttccccctcccactgctcaccaacccacccactcctgcttcctggccctggcattcccctacactgggacatagagccttcacaggacctagggcctctccttccattgatgaccgacgaggccatcctctgttacatatgcacctagagccatgagtcccaccatgtgttttctttggttggtggtttaatcccagggagctctgggggtacccgttagttcatattgttgttcttcct

SEQ ID NO: 35263 - DNA, 1137 bp, Mus musculus
acgctcctccatggctcccttctgttgtgtcattcagtgcagcccaggatgctgcagccctggatgctgggctatgggatggtgcttgtatttacggtgggttcccagctcaacccagccaggcccagagttcgactcctacaagattgtgtttgataatactaaccatcacagtgttcaatcaacgatttgaaaaagatgttcttagacaggcagagtgtggggctgcacacctttaatcccagccctcaggaggccgaggcagtcggatctctacattcaaggctagtctggtctacaaattgagttccaggattaccagaacttttgcatagaaaaatcctgtctcaaaacaagcaatcaagcaatcaagcaaacaaacaaaccaaacaagatgttctcagaagcttagagcaagggttgggcaagtatccttttcccttataataaggaaacaacccatcagaactgaatgaagctgacccttcagaagccacagttaatgatgacgatacacatccgggctggagatgaggcacagtggttgcccagtatggatcctcagcgcctcagaataaaaagcatgaccctaccgaggatgtggcctttgttgcccctctttggtgccagatagccactgtaggtgtgcttgtcacggctggggaaagatagcagcgggtcacatgaaattcagcagtttcttctgtctccatcccgaaagggttcgactagacttcccgaaaggtgcttccgacagtcctgtggctgaagttatttcctggtttcctaaagctgtcccatctgtcttctgtgatgtctcatggctatatcctgttagcctgagtgcttggggggtgggggtaggggtgggggtgttccatcatttttagctagtcaggaaatcacttgagtacatgagtttgagactagcctgggcaacgtagtgtgagattccatttaaaaaaacaaacaaacaaacaaacaaacaaacaaactgattttataccaacaagagaaccctaccccaagcccatagctcttatgttaaatacttttagtgtacttttaaatttcctctatgttcgttctttcttcttcttcttcttcttcttcttcctcttcctcttcctcttcctc

SEQ ID NO: 35264 - DNA, 2053 bp, Mus musculus
ccaccagccctgcacttcatgggttatcatgtacagcagcaactcccaaggtagcaaagttgaatcgaaaacgatccagatctgaaagtgacagtgagaaagttcagccacttccaatttctaccattatccgaggcccaacactgggggcatctgctcctgtgactgtgaagcgggaaagcaaaatctctcttcaacctatagcaactgttcccaatggaggcacgacacccaagatcagcaagactgtacttttatctactaaaagcatgaaaaagagtcatgaacatggatccaagaaatctcactctaaatccaagccaggtattcttaaaaaagacaaagcagtaaaggaaaagatgcctagtcatcattttatgccaggaagccctaccaagactgtgtacaaaaagccccaggaaaagaaaggatgtaaatgtgggcgtgctactcaaaatccaagtgttcttacatgccgcggccaacgctgcccttgctactctaaccggaaagcctgcttagattgtatatgtcgtggctgccaaaactcctatatggccaatggggagaagaagctggaggcatttgcggtgccagaaaaggccttggagcagaccaggctcactttgggcattaatgtgactagcattgctgtgcgtaacgcaagtaccagcaccagtgtaattaatgtcacagggtcccctgtaacgacatttttggctgccagtacacatgatgataaaagtttggatgaagctatagatatgagattcgactgttaaatcagtgggtctttaaacctaccccttggtaggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgttcttagttcttacagaacctcatagtttgagaacaaatgctgatgcaactgatttatacaaaatgaactttggcaaggaaataacaataacctcattgtttatggtcatgctttgtgcataatcaaagttgatgattaaaatgtaaggaagtggtatcagtcagtccataaagattgcgctaatttttttgtgaaaaagtagccattagtttatcaggagactttgtgctgccttcaaatgccgcactgatatttctcctgttgaaaagctgatgtgtccagctcaacctttgtgctgacataataccatttctgatcatgaaaattggctactggcgtgtatgtagcagttcttaaatcagcagtattatgaaagaaaatttccccctcattagaatgtttaagaaatctgtcttttaaaaaagtgaacaaataaattccatcagaccacaaatgttaagctgtttatgctttaaatatttatgagttcagccctcctttctagttatctgatttacttctatgagaaaatcctaagtcctttcactttgagcaatgttctatttggtaaataaagtgaagagctgttttattctgaatataactgaatttatatagttcatgacagaatttttaaaaaatataaaaataatctaaaaattgggttttatttaaatgaattctggaataatgccccaaatgtgcccagacttatgcattatacttattgccattgacaacttcttttttatttatttcctatttgccacgggctttaccttgaatatgctcctttttttccttttctttcttttcttttttcttttttagggtgctgttcaaaatgaaggcttcttcatcaaggcctttagtgaagcctgggcatttaggtctaaagctcggaggatcttctttagatgctcttgcatgtaaagcacaaactgtttcagtttaatgtacttcctcctactaactttatggggaagataaacattctgttgatgggaggtcctagtcagttgcttgagagagcacagcccaggttaaacaaggactgactaggtgtagagagaacc

SEQ ID NO: 35265 - DNA, 1264 bp, Mus musculus
cccttccaacaacagccttccctgaatctgtgacgcattattgagtgtgtgaggagctggagcagacaggcactagacttggatggagtcgtctcgatgccacaggaaatcgttgatttattggtcttcatttcctgattcctcctctcaacccatttgcaaacaatgtattcagaaactccaatttctctctctctcttttttctaaagtatatttccctagatatcctcaagggtggctctccgcctccgccttcttaggaggatattaaaaatccatggtgaaggatggacttcttcagcatgcacaatgctgtgtgtgcttggtgcacagtaggttctcatgcaattatgattccttgcctagggccaaccccttccccgaaagctcaagttcattgtttttctcagacataggtcccaggaggttgaaaaccttgtctctagagtcaaaaggatggagaactagtgaatgagcaggggaactcgaacagctgcctagtaggactcttgcagggttttactgacagacaatgggggctccaggagctcttaagaatggaagacgtgtctacagccataccaccctgaaggagcctgatctcgtctgatctcagaagctaagcagggtcgggcctggttaatacttggatgggagacctcctgggaataccgggtgctttaagaaaagaaaaaaaaaaggaaaaagaaaagaaagaatggaagccgtgggctcctgagggaaggttacctttctcggggcatatgctagcctgcctgtaaggtgagcttggctttgagttctcagtctgtccctctgccttcaagtcaaactcagagtaaataatccctgactgtcacattagaaggaagacatcatactccaagcttgtcaacgctcattctttttgtgtggttagagaaggatgcccttccctgcctcactggctcagcctccatcttgcagaagatgaaaatctgccattagtgtccctacatccaaatctctgattcaaacacactccctgtcggctgggccttcactaacatgacagtgtagacttgaaaggatttaaattcttcccaggcaaaaagaagtaggagactcggcacagggaaatgtagagcaggcagcggctttgaaaaatggtggcagaatggccgcagtgccctgggcttcaggggagcttgagatgttccctcgttgctgcaccacacatacaatttcagatgacagagaagtgaggaaacctctgagggaaga

SEQ ID NO: 35266 - DNA, 1214 bp, Mus musculus
aactgtgagccacctttctcttcagtacactgcgtggagtttggtgatgtgtgagggggctgttcatattctcccagcccagcacatctgggaggtaaattaagcatattgggaggtgagctggaagctcaggccctcttgggagccattgaggaaatgttgtcttggttggttggtgtgctaaatgataggtccctctgggcatgtaggagtttatgccccaaggaccacattttacattttcattagccctctagcttgtctaatctcctaaccctttcaggcttaacctactatctataccagagcttctttcttggagtccacactgattggtgagaagctgaatggcggtgtctctgacctatctgctaccctaatgaatctgtgggctcctttgtgcttgatgaagttgaatactgctggaggcatgttcagagaggcaaccatctctcctgattgggcaaggccatcatatttccattattgttcccacagagcacagtggtaaccatttctactgacatagcagcttccctcgacagcaggtgatgtccaattacagactgcagagtggatggacccagagcctctgagctgggtcgggttttgttttcctgtgatctgagctgctggaagagagtgtcccactgaaagcccaattgaaagaagatggtctacactgaagtaggctcagtggaagcctgggaaattgccagcaaagagaagggctgctggttgttttgctgggtctgtacagagagggaatttgaacctctagtccttactttctgctgagcacagggtagcataaattatctaggatcaagatggcttccacaccccgttgactcagctagtggcaggtcttgaggttgacacagtaatgatggtcattgtactagtagcactaattgctggtagtcagcaagtggtagttgctgaagactctataggagttacttccatgacctttgaggcctcaccacaccctgcaaggaaaatagtattttgcatgtgatgagactgaaactcagaaagttgtctgtggtcacaagactacagctggcagaggtgaggcctcttgcccctagccacttgtcagtcttccggactctgtgttcttatggccacactggtggtctggttttcttggcatatgccaggctacttgttctagggatttgtccctgggtctggaatggtctccccac

SEQ ID NO: 35267 - DNA, 1200 bp, Mus musculus
cagtgatgccttggtgcatggggctcagagaggagcaccccaggggagctagctagaaaagcctgcaccccctagaagactgctttttggcctatatttctcctatgacaatgaggaaggaaaagccagacatcacctgcagccggaggcctgttgctggggcagaaaggagctgagccccctccgtcctgcctgaaggaaacagcggattctgacgcccaagaatggctgggcaccagccgagcggtctgcagggatcgttaggccagctatggtgttctgtggctaagcatggctccagccaacactatctgctcttcagtccctgactgacttcctcagatcactaagacttgaatccttgggaggtgggggacgatgggagtgtgagtctttcgggagccaccagcatgtccccttggagtaggttagaggtcacttgagaggccccgcagagcagtgtgttttgtatataattctttttccttgggaacagaagactaagcgtgccggttcagagtctcctccagggctgtgctgcctgcccctgctgccacagttcttgaaacatgtgacaggtctaccagatgttcctctgcctgcagttcctggctgtggattttgatactggttggctttcctctgctttttaaatccctgtgtttcgtgcccatgggattcttatcaccagcctttgtgaatggctccacagctcctatccctgggacatcctgtcagtttggttataaactgagccagatgtgatgagccaccacaagcggacatctgtcatgcccagcaccaggttctctttgaagaaactggagaagttgttctcataaatgtattcgttcccaccagcagggactgggagagggagctatgttgttaaaacgaatcagtgaacttaaagaaaagtcctcattatggtgcccccaccacagaatggcacccttagaggctggctcctcaagttttggtgccccagccctgaagcagggccagctacttggaattaggtgaactacccccacgtggcagaccaccagcagcagtgactttgacttctggtcttaaagcaacccccattcagctcaaaaagcgattggtggatttcagatcttttgtgtttttctcctctggttgttttgtttgtttttctttcactgtttgaagttctgtctgttgtttgttccattc

SEQ ID NO: 35268 - DNA, 1140 bp, Mus musculus
atgataaaagagtggtcgtttataaatgcatgcctgagggccaagcagtgacctcagtgatgtacttagacatcttccgtgtaagacccttttagccgtcttgttgggagtagctttatgcttccttctatccccacagagttcgaggctccagaaggattgaatactttgcctaagccacacagctggtgatgtgggcaattgtgatttacaggtttatgctcagcatttgcttatgaccaactacatatgtaaactcacataaatcaccatttagtaacttccagaactccaaccacacagtagcctgacaaatctttgttacattctatgaattgaaagtcccctcagcaaagttgactgtaagttcccaggaagaaataacaatctgaaatgtgagcgtctccagggaaagaaggcatgttgagggcacattaaatgaacaggcatttcacgtggagattgtactgtgcagagtggctcatgtgcacacaggctctctgaatgtttattggaggacacctctatctcagtacttcagccatgacagtaggtcattctaaagtgtgttagcgataaaaggctacatagcctccagaactcactacttagatgccttatgtctgtacgtttttcacatgtgtgtttgggctcttgaaattggcaaaatacaaatccatgtgtaagtatccagattatatagcaggtggtcaccagttccattgtaatcactggggtttgaaactacgatgataaggtacaaatatcagtcagtcacaaggttcttcatatgtaatagtgggctccaccacctctgtggtgacaggagttctgtctggctctctggttttactctctgtgctgaatctctgctttaacatctcctcggctacaaaattaaaaggaataggccagtgagattgaaatgttccccagagtgacctgggacaaggtttctacccattgagaagatggaagaatatgcttgggaagtgttggtttataggaattacaacacgtgagtgacaagatttgcgcccaccaccttcaggggctcctcttacttggaaagtatggggtgatgtgatgtttcaagttctagagatttctgagaaccatgaattctaaaagtggcatggg

SEQ ID NO: 35269 - DNA, 3011 bp, Mus musculus
cccttactggttttaggtaactctgacttttactcagctggacagtatcttttcagggtgttcctaaaagttgtaaatggtgacaacaacacattgtctctctgtgcatgctagggttccatccctcgctctgcaaaataagcagatcagaaacccatgactgcttctatgttatgtaatctgcatgtctcgcttactgagggaatcttctgtccatctaggttgttctccatttcccaccgtaattcgttaacttaggggtagcatggtgaatagccagtgatagaagtggtttctttgaacggacctagttacttagaccaaatgatacaaatgttaacattgaagaattaatgcattttaatgctttctttcctacaccagctggagaaactagccagtatggtagcttttgttttatgagcagtactcactttatttaggagtttgttcagttgctatttgtgacctgtctgtagtcaccagcgcccagttttagaatgttcccctcattgtgctgctgtcctctcctagtgggcctttggagtgacgctgtgggagctcatgactctgggccagacgccctacgtggacatcgacccctttgagatggccgcttacctgaaagatggttaccgaatagcccagccaatcaactgccctgatgaactgtgagttttttggatctcagacatgagccttggtgcatttactatgttactataaagcaggaaagcacgtaagatactccttcagagtaaagaaaaaagtagaggacagaactcagtgctgacctctgctctccacagacatgcacagacacatgcatacaaccacacagacatgcacatagactacatgacagtaaacacagacagagacagacacctttctcatcctggccttgccttccttccttgcctccatcatggcggtggggtacacagggcctggttgggatggtggcacagcaatgtgttgtctacagaggccctaaaaggtttccctgccagttttagatagtagctttgctgtagatccaggagtcttaatttcaggtaacacttcttcctagttcttcctcaacagcgtccaggacaacgcagcctgttattctgactgttctgtgtatttacacaaagctctgaactttctgagtattgtattctcataaagaactgaagatggttgtgtgtaatccaaagaacttaacttcctttaatcctgaagctgctaacagtacagctaagcgattgctcatggctgtcctccccagcagcccattaaacagagcacataactggcaggacgctgacggaggcctgacacgtttccatgtcactgcaggtttgctgtgatggcctgttgctgggccttggaccctgaggagaggcctaagttccagcagctggtccagtgcctcacagagttccacgctgccctgggagcctacgtctgacttctctcccagctccgccactcagaagaaagtgcctgtctgtcacggatgcccctcgtgcagcgcagtgcctgcaggggcacactgtctccagatcacccagccttagcagtgcttccaaacctcagcttttaacgatgacgtaataacgcagagtgttttctagataccacttttactaggttgaaccaaaaggggttttgtacattttttggccaaaaatttttttaaaatatagtgactttggactagggggtgcattcttttaaaaaatgaataaacagttttaaaaattatttagacacagatatttggaatagctgtcttagtgccaactgcttttattcttaatgttttacttcattgaagtaatgtaggtgactcacctttaaagctattttaatattttggtcactacttttgggagtggtttgtcttcaaaatgcggtacttttcttaggaaaaacaacattacgaagttgtctggtttgccttatacgaagaaagatagtatattaggaaaattgaaaaagtaaaaagaaaaagaaattacaaagtaaaaataaaaaaaaaaaaacatatcgcccccgcatggaaaatcgcttgtttagtgaccatggctctgctcacatttggggaagcaggtctgagttcacatctcagtcagctttcctgtgagctggaagaaggctggggcaggcttgtggaaaacagtggtgaccttatttatttttgctctccggggaaggagaggacacagttcctgacagtgacccctctctactgctgcggttccctctgtgcacgcctgggcggagctacgcacagagccggtgcttctgttgttgtgggtttggggggttttagttttggtttttggtttaaattggtaatttttatgcttatcttcaaggctggcttaagtataaatttgtttttttaaaacacttgaaaaattaaaggactcattttatatgctggtattcaaaatactgctcacagtgtgtgactgttggtcgtgtcctgaaagtcttggagtcacattttatcccctgagagtttgactcaggttccaaaaccctaacagaagaacagctgactctgctcagccgccagggcctgttaagaagttggagttactcctacaaggacttatcatggagagagtccacaaatacatgtatgtagttacacacaggtttggtctacctaagggattgtcacctgggcctgtgaagtgactgggcctgcagctactgcctctgtgtctgtcctctcagggatgtgagggagaacatgggtctgttctattaaaataagtcttgtgaataaagagagtatctgaaaagacagcttccacagtccaaggctccaggaggcaagccaggagctcagtgtcccgcatagggcgtcctgcatatggtgtcttgtttatgatatgctttgtcctcaaatgtctgggttttaaaatgcctcctttgaaccttttgtaacttaagccactttgttaatagcctgcatcttagaagggattcagtcaatgagtgctagt

SEQ ID NO: 35270 - DNA, 1101 bp, Mus musculus
ccacttttgacaggaaggcctctaagcagtccccacctcctaaaggctctacccccttacaactgggaccaagctttaacacatggacctctgtggggacattagcccaaacgttagcatcatctggtccctggcttacacacatacacacacccgccttgtgccttcacttctgatctcctctgtaatgttgttccatacctactgcagtctagcaaagctccctgttctataaaacccacctctcaggttcttcagtatccttagtctctgcttgcagtctgaccaccatcaaatccacacacacccccaacatcaggttatttatagcatataagtgtcacatgagcagatgggagggcatctcacatttagaccacaaaagcagctggccatgctagaggccccttggccctcttaacaccaggactatccagttggcaccccaactctgtcattatcttcccctctctcttgcactctgaccctgcttcccactctcatcctcctctctagccgctcccagcttcccttgaactccatcctagtcaacagctcctccttcttgctggacagagtgttcctagatatcctctccgttagcacagcctcccatgcttctcctggacccctcagacttgtatgcatggttttctctgccaatgactttctcagcttccagcacccctccctccctgccttcctgttagcattgagttactacttctcagtgagttacctccactccactcagcgtctgccctgacgtgggcccagggtccttccttcctggggtaatggctcactttgcaggcccctgacaccataggtgccaggttcagtgacattctctccgtggcatgtgtcagcatatcgtccttgaactgccttctgtaactttggcttttcaaatcctactttgaatagttgttcttaaatgctccaacctcccttctagcccaccacccaccagaggtaatgggaaagaaagcttatggtgatacaggggcagtgggcctgtttagaaattgttctttggagcaaatcccatctgtgttgtcaggaaaccagcagttcagttcacaggaatcagcagcggca

SEQ ID NO: 35271 - DNA, 1112 bp, Mus musculus
actagctctgagttgctgaaggacaagctggtggggctcctgatttatagtattcctccttcttgtttattataaaaggcaagaaaagaggaaggggtcgtggtaaggtggcaatgggggtgcctatgctttttagactgctccctgctatctcagagcatggatatctttggggacccaagaaaactggggtgctggccaactcctgagagtgctggccatttccctagctgtgtaggctctgtgggaccatctggggctagcaaagtgcaggcctagttgaagcagtctgtgaggctggaccacctggggccagccactttcaagctatcctagatgctgactttgagttaacatggggacctggcaggatgctgggacagatacatgcaggagaaaatcttttcttaggtgtacatttgaaacttttagacccagggtcctggtagttgggagaggggagtccccaaaaccaaggaaaggggatcccaccgtcagaaataagtggacagtaggcaggtaggggaacaggctgttgactgacagtacttatctggagtccattcaccaggagagaaggattcatcctattccctgaagcttacgagaacttaaatttacaaaaagaaagaagttttaggcatgttaccattgccactgtttgtaatctacattgaaatccatattgtagagaacagactcgcctttctgtcatagtagaagctcaggatatgattctgggaggacaagctgggggagggcagggaccttctgtggagcagcaaggccaacacacacttgatcttgatattcagtacaagtacagaccatgaaagaggggcttcctccctctgtccggaagactggatgtatctatcagacagacagttttatcagcgcaataaaaagcacctgtaagtctatacttagaagacagccataggaaatctaaaaccttgagcttgtgactgttataaaagcagtagtgcttttccagagctagattgatagcttattagaactgcattgactcgggttaaaactctgggtttttgaagtctgaatacaaccatagcacagcaaaggaaagaaatctgaagcattttttttta

SEQ ID NO: 35272 - DNA, 1635 bp, Mus musculus
ttcctgttctcttggaactgtgtgtcacctctattttcctcctacccccgccccccccagcccagaaaattaaagcaattaactgaacagtagtaattacattctagttctgggtcacatggcccaaaccaaccaaacccgcactccacagtcaaatccaactttaatctaacaaaacagcctctgagggggtattgtcgagttcttccctggcagagtgggacacattggcaggcccctgagaggagatgaaggcccgtggactgtagattcagcagcagctccttggctgcttccgcctcttctccttccctgaaaaaaataaccatagagccagaaagcacaggcaacagtgtgttctctgggctgacccggtgacagacagcaagaagttactggaaggatggggtgcgcttggcagctgagggctgaggcagtgtgtaatctactggcccaaccattgacacacatggttaggctgactcgccaactcaatgtgtgatgctgggtggctcagggacactgaagcctagggcacctgccatcactgcaactaccattgaggaagtgagaggagtcggccatgactccggacactccatgttgtcagacccttggatactaatcttgccgaacgttgttctggaaaagctgattccttgatgtgtcctcacctctggcgtggtacgtttgaaatctttgtatgaatacctttgggagtgttggcagctgcactgcacgcatcttggagtcactgtggggtttccagaaggctgctgccccagggtactgcaacttgccccccagcaggctgtccttgctatttccactcattccccagactgaagaccttcagagtctcttagcagagtgctcttctcaaagcagaatagctcttatattctaaacgctcccggactcactgcccctgtctgcctttgggcaggcctggggcagtgactctaatcagagcagcctagccccatagcattggctcttctttcagactgctggtgggcagagtgaattgcctccacaaggcagaactccaacaaggaggttgggatgaattatggaatctctcaaagaatgagttcaaaatggcagcctgtgtggcagggctgattctgtgagtgggcccgtcatgcgactccatcctgggagactgtgtcaaagccggttctgatgatgaagagaggaagcaggaccgccctgggtacctcctccagaaggcaaggaccaatgtacgagcataatcgaaacgtcacgtgtttagtttttatatgtgtgtacataattatacatagagatagacttgtgtatacacccttcgcgcgcacacatacacacactcacatcctcacatatacatgtgctcagtgtatatcctcgtctctcccgctcacaacttggaacttacattgtgattccggtttttggaagttcaaaagtatgcagtgtattgaaataagaaataactcaatattgtcaaataacttgtggttgtcttgccttcaataaaatagtgcatagatgtgttaaactacaagcaaaagtagtccacagaactacctttaccactgctttttgtacctgtgtgcacaggtgtgcatgccgtcgtgggccagtgtcccc

SEQ ID NO: 35273 - DNA, 1225 bp, Mus musculus
caaacagcctctattgctacagagctaacttgaagtggcctagcagctatgaaagctgatagcttcagctagctggaaagtacagcctaccgacagtgtgagttccagggagagggctctaaagtagaatgccaacatcacatgtagattgttcccggctgtgtttaagtagatcgtgtaaggagacactctgagaaaaaagtggcttccttgccaaaaaatgtagggggctacattgttagaaaagccaattgtatctaggtcctaaaaagaagagaaacctaagaggcttttgagtcatggccatgagagcctatatatggaggaaagatggaggagtataggactcttctgggctgagtaggcgccatcaagtgagatatattcccattccagaaacaatggcttcaatgtctgttgtttcaggattctggagttaatattctacctttatccttaccaccaacatcgttcgttctctctctctctctctctctctctctctctctctctccctccctctccctctttcctccctctttctctctccctctttggttttctgtgattctgtttcactctatggccaggctgggttggaactcattatgtagcccaggctggcctagtgcctgtgctgttcctcctatctcagcctagcaaatgcttggattgtagcaatgagtcatcacaactggtccatgcttctttcatggatgactgtcttgttacttgaaggagacttacaatggctccaaagggtcagagtccacagtggtcggggcagcatagcagctggcagcttcctcagctcttgaactacaaacacaaggcagagcaaactgcaagtaggcaagtcgtttcgtttgagtcttaaactccaaccccagtgatctgctttgtccaagcgcgactgcactgacttgggtcggagagtcattcttcagtaacatggtcctaagcgggagatggacattagataagaagatagagagaaaatctggggtcgggaggtctcatgcgagctatgtcttaggacaagcaactacagcatctcagacaccattttgagagaagaaatgggactaagtcagcagaaactgtcctacgaagggacgaagtcaacaggaaggtaatcaaacagtgttgcacaaggggagcaaggggtatctcaagaacattacagaccgggtacacagtggccttggactgataaccatagccc

SEQ ID NO: 35274 - DNA, 1107 bp, Mus musculus
tagagttcctgacttgttttgtttactaaccccattgatcctttaagcactgaaaaacggagtcacaatgcaatagttttggttcattgcttgctctctctctttctctctgtctctctctctctgtctctcatacacacacacacacacacacacacacacacacacacacacacacatattcatgaatgaatgaatgatgggagtagttttgagctttgccattcacaaaccctagtaatgtccttgtagcttgggaatctattagaaatgcagagccttgggatcccaacccacatttgacaattagaatatgcattttaaacaaaagtcccagtgcatattcaggtttgagaagttagctgttttttttttgtttgtttgtttgttttgttttttaaagttcactcacttagcaatcatcaattgagtgtccgtcatctgacaggttttcctctagcataatacttggggtacaccaatgatcagaacaagcaaatatctctcctctttcagcatacatagaacaggaaatcggtattaatcaggtgataagcaagaaactacacagtatgggggcagtgaaagagttgagactgagtctcacagtgtagcccagactgatctggaactctgtgcttctgcctcagtttcctgcatgctgagattacaggtgtgtgccccaaaacctagtacctatgtaatgtgttataaggggtctagtactgtgggaaaatgaaaaagaaaaagccaaaacaatttaaggttttccagaggatgtttgttggaggagaaagacatggaagggttacagcttaaaactgaatttaaaaaaaagcaaactatttctcttaagattatagactagggtcttgtataaggtactaggtatccggatatgcttataaacaaaatacatcatggaatgttcatttgtgttggtgtgtggggatggtgtttatgtgggtgctcttgtgcacatgcattcggaatagtatctgcataccacagtacatgtgtagatgtcagaggacaacttgaagcagttggttctccttttaccctgaggttctcaggctgaatggcaggcacttttacctgatgagc

SEQ ID NO: 35275 - DNA, 1194 bp, Mus musculus
ttctgcacttatttcaacattattcagcatgtactcagtacatttcctagttagtaccagcctggtgaagtttagcacacctacttattgtggcaacaaaatggcagtactattgttggaactctgccgaaaagcattccttttacttatcaagagtaatggaagaatgtgtctgttttataccagacaacctgtgtaaacgttaggtttttaagtacagatccagtcttataattctgccaaatgctccccatttattagcaaggacttaggagttaatagtgctttctttaagatagtcttgggactgttgctgaaatacaagtttttattagagacttgggactgagctagatgagcagttagtgtaatcctcaatgtcagttttcctttctgaaaaatgtttatagatcctaaagaatagcaactgagcagacagggagagcagtaggagctagcacggtctgagtactcgggctcagttgtctcctcttcttactttctccagaaaaataaccaagtacactgatgtaaacatggaagactttaagtgtcctatttttcttggttgcattatctgtgtgactggcttaaatggaatacacagaaagacagtccagcaactcacggctaagcacggaggccagtacatgggacagttgaagatgaatgagtgtacacacctcattgtgcaagaaccaaaaggtaaacaatgccttagatgtggttgagcgtgcaagtcctgtttaagcactaattctctgtagaccaccttgtgttctgatgtgtcattgccttagtttatctgggtttttttttgccttttaaattcttgagaagatagtttgggtcacagtctagaaaaattaaggaactgtccttgttattgtccagaatatggaataaacataaaatatcaaaagttgcccatgatgtttcactacctgacttagaccttgatgaaaaaaaaacaaaactcttcacagcataacaaatatgtatagctgagtggtattctttctcatgactaacttcagaagcttagttaagcacttagtgggatgaattggtttatattactgcatttggattggggtgcgggtgggtggtatgggtagagttcccgagtgctgggcaagtgctctaccacattttccaactagtctatgaactagaatttctttctttctttct

SEQ ID NO: 35276 - DNA, 1132 bp, Mus musculus
actgaattgttatgtaaataaaaaactgggcttttggtctacctgatgtgaactagcagaaagcagtagcagatcctttttagaattttctctagtgagagctctggagaacaaaaacatctctgcaagaatttttcttaattttccaacttggtaggaagataaaataatttttttatagcagtttttctgactatggtcagaaaacccatgagctatccagatagcttttagaatttttcctagcagagagaactgtctcaaccagagtttttagaatagtgagaaaaggctgtccagagcagagcagagcacatacacactcatacacacacacacacacacacacacacacacacacacacacacacacacacacactaactctcacacactcacacactcagactgagagatcgagcagtctggaaagccatctcagcaaaacctaggctgccagcttggacccacaattagacttcgagttgttcttttcgctgctctcagacactacttctctcagaacccctctctgccaaggctagtccctggcagtagatcattgagctggcctcagattgagattgcgtccactttctgagcactgggattaaaggcgtgtccaccatgcccagcctatattttctgtattggtttactgtaatgattataaatcattacataaaaattcggcctgcatgaagtcctgagtttgattaccttttgattactactactgcattataaagctggatgtggtggcacatacctataataccagcacttgagagttggagatggagggatcagaagtttaaagtcttctttggctacaaagagttcaaagccaacctggatttggtgagactctgcctcagaaaacaaaacaaaaggccagggacagtggtatataacctcagtgccagcactgcgggctgaggcaagttcgatgtggtcctgatctgggtagtgcagtccttttcagccttcctaatgctgtgaccctttattacagttcctcgaattatggtgaccccgaccataaaataattttgttgctactctataactgtaattttgctactgttatgaattgtaatataaatatctgttttctggaggtcttaggtga

SEQ ID NO: 35277 - DNA, 1154 bp, Mus musculus
aggatccaacaccctcttctgacttctgtaggccctgcatgcaagtgatacttagtatatgtaaatatatgcaaaaaacccactgagttttgtgtgtgtgtgtgtgtatagatagatagatgaatgacaagaaattacttgacactaaacaattaaattcatgcattatctctgcattttgaatgtttagtatgttaaaattacatgtacttatttttaaatagggagcatttagtggctggaaagctattttacgtgttgatcggccccgagaagctgggttcaaacgccttcttcaggcaggaggagcaaaggtttgtcctgaattaatttactgctatcctaggggcaggtttgcaccaacttgtccagcaaggtttctgtgatgtctccctgccctctgcctttgaggggaggagcatctgctatggagcatgaggggattaacccttcctgtttttcattaggtgttatctggtcatccagaacctttacttaaagatgctacgcatctcttttgtgacttcaataaactgaaacctgatgactgcagagttttcatcgcagaggctactgcccagaacatggtctgcttgaaaacagaatatatcgctgattatctcatgctggtttgtcacattctactcttccgtttatcattatcatttttattacttgtgtgtatatgtggggtggggagttggcacatgtgtgctcgtcagaggatagcttaatggagttggttctctcctaccatgtaggttcaaacttaggttgccaggctggtagcaagcgcctttacttgctgagtcattttgctggccccatacttccttatttctagagatatgtgtatgtttgtagatgaacatccacacatttactcttggcttgctgctaatagaattgacagtctgccattctctagtctttcagtttagttccatttctatattggatgcctgtaaactttttagcatgaaatttaagtatgacaggtttatgaaaatctgggtagctatagatgttttacaagttctttaaaatattgggctataaagaaagcagggggctagagagttggctcagagacaagagaactggctgccattgaaatcagactcagttcctacctaacagtaacagacctaccg

SEQ ID NO: 35278 - DNA, 1234 bp, Mus musculus
tagaaaaatggctgcaaaggtagccattgcaaggacttggtgtcaggtagaaacacttaaatgtccttgctacctgatagttaagcccattgcacatttgtaaatgggtgtaaaaacacttatagtaattcacactactagctactgaccagcctttccccaatttaatctatattttaatccatggaatcattaaaatctgaactagccatgctttacctgaactttgacccactggcaagctttgaggggaaaaagaaacctggagacatacatgcactacaaatttgaagttttcctcttcccattccaggaatcccctccttgtgcagacaattaccgtgtatccgaagctgctttattccataataagaaaggtgggcctggattaccacagaagaggaaaactcctgcagagaatgtagtcaaacggcctcgagtacactgaagtgagccatacacaaccacccaacgaatgtttttgagtttagtgtgcttgcctaaaatgtataaagtgcactagaaaattttcagctacaacctgaacattgctgtgatgcatttgtgtagcagtttaaaggcatacatctgaaggactatgcttcagattctaatgatcctgtaaactggatacctttaacctgaatttgaatcactggttattgactgttcctaatgaggctgaaatagttttaacaaggagatttgtttcaaaaatgtcatagttcataaaagcaaaagttatacattagggttatttcatgttttcctgatttttatatatgtattcttgccatttaacctctttaacagcctgagcagagagtttaacaatgaagctggggctctaaacttaaaatatgtatatatgtaaatgtgtgtatgtataaacttctatcatttgccaaacttgggcaccaaaactttgagataaagaataaaaaaaaatagcaacttaaactgtattgatttgttcatttagatctgttgatatgccagacttaaaagctgtctcaaaatacactcacgcacctcacctgcaatcccagcactcaggtattgaagtagggtcattgagtccagcctagcctgggttggaatgagacgctccattaagcaaaggactaaagaggcatcagttggagacagtggtggcatatgctacacagagaaaccttcttgtcggggtgggttggtggaaaaagcaacccttagaaggtgtctcacaattgcc

SEQ ID NO: 35279 - DNA, 2568 bp, Mus musculus
ttcttttcccttagggataaagaaatggagaagagctttgaagtagtaagacacaaaaatagagatagggaggaggtttcaaaaaaccaggcccttaaacttcagctagacaaccagtatgctgtgcttgagaatcagaagtacagccacacacagtacagctaaggaatggtctttgctaagccttccaaggtaactagaccacagctaaccaccaagaacagccattcatcgttttgatttctggatctacagtgactgactgaagacctcaagtccagtgactgtccctgttgcactatggaagttcaagagtcacgactgatcttgatgtgtgttggatttaggggtgtttcattgtcttaaatatttgtgaattagattcaacagtgtttccatagttgctctgcgtataaaaccaaacctgcagccagtggtcattcaaacatctttatgttcagatactgagccttcgcaaggttgactacctcagatttgctgcccttagttgtggatttcatgtggatcacatcttctacataaggttacagctactagtgtctgtgtgaaccttgaaaccaactctactggattcctgtcagaaagccttcagaagtcagccatctgggttctgagccgctgtaaaagatgaagagttaagtgaccttaattaacctgttctgtgccccatcctaaggcatactctgtaggctgtggctgtgttagactccctggaacaagccgctgtcagaaatgatgtgtttggatcatctgtgtggggcttatgatttataatttaagtttttagttttatgcggtaactggatttaattcaaccaaactctggtccaccaaatggggagtgggtgggggggtagtcttatttctttgaataatttttcattcagatagtgcttgttcggttccacattaaggccttgctttgactcagagtaagttctttaagggcatattgtctgaaatatgtctgaaagaagcattggaattgtaaaatgccctatgaatttgccaatccttaggtggaaccagatagcctttgatgcatataaaggacagcggatccgctgcactccaggtgctgctcaagcctcctaatcaggtctaattgaactgctgtggacagagtgtggcgtctgctcactgctgtggacagagtgtgacgtctgctcaggaggagagggtttcactgacctggcttttaacagttcaaagcaacaggagcaaaacacccaagttgcgcatgaatctggcatggtgtctgataaatccttgtgtgtgccccaaatgtgaaggttatgggctattcattgtttagccagctcttgacattcaccttgggagtatgtttggtaatcacttggagacgcaggggaatagtcagtaatgtagcatttctgttgtaatttcaatttaactatctagtagtacttggctcttagaagaggtttctgctaaatttctttctacctaatgaaatagcctgtcagttacctaccttgtcactacagatggttcagtacacatactctatgttggcatatgactatgtgatacaatactagtgcctgggtttctctctgtaaacgaatccctttgccaaacacaggtcagacttgctcactactgacaggagtggaacaggaaatggatgttttcccagcttgagagcatgtttagtggatttagggcagcagtgtaggaagcaggaggtggaggccagtgtcacctgaccagactgtatgccacttcagagcaataatgttggcatgatctgaaccagccaggaggaggttgagtgattagaggcttgagattcttagttgaactgaagacttcatttgggcaccagaaacgttaacaccttgagccacaaacttcccttaaagtatgcttcactccagcgtgacacacaaacacagattctgtttggggttatggtttaagacgtgaacagaaacatgatgaggtttgtttaatggcatactgtactggaacgctgaagaactgcagcagatgtaaattccaagtcttgttattttttaagattgtgaaattatcaaaatgcatatgaatcaagttttaatacactgtctgggtggatgaggctgtccattgcaccatttctttctttgggttctcaggcatggttctgacagtgtaagaactctgtaacatttaacattgaataaacagtaaaccaatggatggtggaatgtgatgctttctgttgaaaccccttagcctaaactctagggaatggagaacagtgtgcagtccatttgtggagatgaccctgctctccaagagtgcatttagtaatgtttgccacattctgtagatattaaatggcatgagtgaaaatggctgcaatttagagacactccttatgaaaaagtgttaaacgtattctgggccacctctgggctccttatacaaaatattaatttttagggttttggttccccccccccaccccctttcaaatgtgaatgagtgttttgcctttgtacatgtcagaagtgctggaggccaaagaaattactggaa

SEQ ID NO: 35280 - DNA, 1217 bp, Mus musculus
gtgacatcacattcattgggagatttctatttcctttcatgtctctgaagtgtagtgttttatttttagatagtcctagcccagagggcaacccaaagacaatgctatttcaagggatttttatgtaaagtaatgcatattttcttaaagtacatcttatgcagcttgctgagagactttgaaagggaaaggacagttgggtaattttggggagacataaaagtggggttttttctgtgttgatggtattgctcctttctgcatgaaatgtaaaaggaatatatagtttatctttagaaatcctgggagaatataaaaaggactatacaaccatcagtcctggagcaccctgctcctggtgagaatggagctgagaccctccatagctgccacaggcaaacctcttcctgtggttcttgggaacagagaagagccaagttcccctttagccagaagcctgtgttaccggtatacctcagcttaccttatcgtcatagagagtaaggctattacatcaactgtcaaccctttcctggaagaaaaaaaaaatcctgatcaggaacatcttatctaggtaaaaagcaaagcaaagagcgtcgggagccacgtgacccagctgcagctttgcccatctggattgactgtatgccaccttgccttgctgaagtggtgtggtcctgaggagttcctctttattcttgactctctttttgcatatgttcctagttttctgtgggaatagaaagcagtctaatagatgtctcacttctcttacacccaaggagtagcttcttggtatgtttgtgtgcgcgcgcgcgcgtgtgtgtgtgtgtgtgtgtgtgtgtgtgtgtgtgtgtgcacgtgtgcgcacgatctgcaggcaggcatctcccctgaaataagaaatgacatgaactgtcaagaccacaatacagacaaacaagaacggcaggtggaagtgatctttgctggaagatggaggctcgttcctgagcaactgttcgctcctggagacactctgggacaggtaatagaggttataacaatcatacttgtttccataatgatgacagctagcatttgatcatgcttgttacatactatgcacagcttcagatactttcagtagagataagcctattggttctcatagcaacccagtgaggaacaagaacttggggctcaagaaggtggtgagaggtcatagaggatgaagg

SEQ ID NO: 35281 - DNA, 1206 bp, Mus musculus
attaaaaaatccactcagtaggagtgccgagaatattgaagttgctgcctcctgaacaacattttggtgggtaatataaagaactttatgtctcctacatactttcaaatatatttatcagagaactctggtttctcagcaagctgcgcatgggtaaaggcggctgcgaggacaggcagttttgggtggttctgtttcatggcacttcccccttttgttgacagacggaggattcggcttctgaagtaacagtggaagactccggcgaaagcttggaagatcttatggccaggatgaagaatatgtagacagtggctggcttctgtcttattttctctgcttatgctagtcccttggaattgaacaatcggaactaataaaacttagcgccgccttagttggcatgtgtatcttcacggagttgttatgctgtgtggaactagtggtttcctcctgcttccgtatacaacctaatcagtaccacagcgacagaaagagaaggggtggaccatcccatccgtgtctgtggcctacggctctggacgataaatagcacaaatggaggatggactgactgtgtggcctggtggctgtggctgacaggtgtctgagtgaatggcttcctactggacagttactcactactactctgaccaggagtgactttaaacagcctatagaataaaaacatcaatgtaaatgagctaaatacctaataaaaaatggaaaaaaaaaaaagaaaagaataaaaacatgcctcagataattctggatgaaattgaagcagaatgtcttcattggtagtgtataaacccatggattgaatatttaagatgaagcatagataaaagcaagctatgttcacggcagacagaattacgttcaggaaacattggttatcctcagattttcatcgatcaaggaaaaggcatcgctctctgtagcggaagtgtctggtcaccatgttactgaagaacagacaccgtccatactttgtgcatcatagagtgttcctccatacttgattccataaatactgacatgctagcaaggcttgtctgagtggtgggcaaaacaactcaaacctgcctctgcagaggtgcacaggtatttattccctgcaagggctccatttcccaagtgtgaccacttcaattgtaaaccgaggcctgatgtgaactattggtggtttaaccttgaagatag

SEQ ID NO: 35282 - DNA, 1176 bp, Mus musculus
taatgattgagttttggtgattgtttcctttgatggagcctgtctatacatatcactgttagctgaaagattgcaagcttaggctggagagcactggctgctcttcacaggacccaggtttgatccccagcaccgacgtggcagttcatgcataactctagtcccaggtgatctgccacccgcctctggcctctgtagccactgcatatgtatacctgcagtactgcatgtatatacctgcaactcacccatccgcatgaaaataaagatgaataacaagaatgcaaatgctctaaatttgttttgttttcctttaagccgtctgatggcattgaaacggatgggaattgtcagtgactataaggtatgatgaccttgatttcgggaaatgagactaatttctagtgacaaatctaacagtattaacaggtaccgttttgtgtttcacagaaaatccgtacctacgctgtagcaatagtaggtgttggtggagttggtagtgtgactgctgaaatgctgacaagatgtggcattggtaaggtaaaaagatttctctttgcctgtccagtaggaaactgttcactccgggagcaaatcaggtacagagtagcactctattgcctaatcagtggttatggtttctgttatatttgggtagcttgctcttctctagaggccgagtcataactttctccagacaaaggctcatattattactaattcaacaaagggtacttaattgtgtccagaaactttggtttagggcagtgtaatgtgtaagtaatttggaattattttagatatagaatctgttagaaatggttctggggtcactcccaaaataccacgttatctgtagcattttagcaaggcacaaagtttacttctgcaggagggtgcatagccacgccaagtcaagcaggcaagctcacacagtggggattctgttgggtttttactcctgatgtaagggctcccgtgccccactgtgagtggtcagagttcagcctcacactctgcacagttagctaactcaaaatggcacagctgatgggtgaagtacaacttttgggaccaggatcgagcctggagcacatattctgatttcaggaagtgctgcccctggaggagcttaagtttctgtcacgtcgtctttacagattttattattattat

SEQ ID NO: 35283 - DNA, 1147 bp, Mus musculus
tagaaccaagacccaggtctcagcagagccagcatcatatgtgtccagatcaagtcgacggccattccgtctttcctatctaggaggccatgagaaacaccagggtcttttaatgcaggctcaaggttctggcggactctcttcttgcacggaccgcacaggtcttccgctggcgcgtccttagtctagggtgacagctgtttgtcttcattcgccagagtcacgtttgcgaccttgtttttctataagactgaggactccagctctgacgctgagggtaaattctaagtctggtcccacaacaggcaattcttttatttctccaccagactccgagtcccagactccgcctcccacatggctttgcagcaacactgcccagagtcccggtgattggcttctcctaagccccgcccgaccacgcccccccccccccccccccaagtgccggtctcctttctgccttggcgcaacctccgtacagtctgtggattcctcggtgacaacagtggcggtcatggagacggatgtcaccagtgacaccgtggaagtgctaccccagcacaagttcgacctcaggtccctggaggcctacctgaatcagcacttgccgggctttgggtcagattcccgggctgtgctgactgttactcaatacaggtatcaaccatagcctttgcctcctgggaacatgtctgtgcttggtgcttcgcttcctttggccctgggtgggtgtctcatttgcccggtcgggatttctttccctgcaaggatgcttcctggataatttgtactcgaatcccaggctagtctgaattagagggcaggagcagaggtgcagtatccattatgcagtgcagtcttgttaaggactaaaattatgtgtctaattcaccgagagtgttgcggctgaacactcttgaattcctaatagatatcttctgtgaccttctgtgctacaatctaaagatcagtttctgaggggctggtgccattttgtttaattgaccttagtcacctggggctaggttaataataccagctaaaatataccaattcgattctagacattccacttcactgtttttagcaccacttaaggcctaagttcttgaagcaagggaattaaacgggaggaggtgactcc

SEQ ID NO: 35284 - DNA, 1211 bp, Mus musculus
gggaaatcccctatttctacaccagtgttactgcatgaattttaaaattattctaattgtgtcaaatactaaaagccatgaacataggtgctgtatcgctgcctgttgagacagttacacatgtagatcgtatttagagcttcccagtggtctgtactgggtgctggtccctgagactgatagaaaaaatgcctgctttcctttctctcttgcaggacctggagttgctggctaccttacagcaggtacatcctcatcagccatgtctaatctgccgcctcccgtagaccatgaggcaggagaccttggctatcagacttgaagcactcagacagtaaatgctggaaggccagtactgcgcccacattcctccaaccaacatgttgaaacagactccgctgcctttctcctggtttcatgacagtgttattcctttttctataaatagacttttatttaggagaagagtccatgattctgacgtatcacgttctgagaaagcactctgtgggtcagccacctgggtacacaagaatttcttcttcttgatgtatgtaagcacattttgttcctttatatctgtttacaagactgtgaatcaaaaagacaaactttcttcctagtttttataacttttttttgaattactgtgactgtgggattaagctgcagtctacaaacattgggctaaatcttatcccagagcagggcgcctctctctcctgcaccaggtctccatgaccgtcttcctctcatcgtccctccacccgtgaccagatcctcaatcattaactctgagagctcggtgcacatcggtgtgtatgacaggcgtcaccaaactgaacgacaaggagcttgtgcaaaaaaattaaaactaaaaatggatgtgaagatgttatgtaagagattagtgtaattgtgaaatgttctatacattatcaaatatataaagctttctatattgaatgtacattatacagatcattcatatgtgtacataaaattttaaaaataaagggaattgactgctttgttaatgagatatgtatgttctgtaattttagcctttggaaacttcttccatgttcacttttgggggagatggaacagaagcagacaaacacccctcaccctcacacgcacagctgtgcccacctccgttcactcactggaaacagcagcttagttacttcttaaatcgtgtttaggtg

SEQ ID NO: 35285 - DNA, 1174 bp, Mus musculus
taaaggcatgcgccaccacgcctggctaaaataaatatttattactgcttcatttatgtagcatagcctgtactttattcttacaagttgaatatctgatatttcaatatttcggcctgttgtcactctccaaggagcattgttcttgtctgaatctcagccaaggcttgttagcgtctcctcgtagtgagtgcttcattcctttggcctcttgcctgtcattcccacttgactatgaacatccgtgcatcagtggttgaggggggcaggctgtgtccagaagtgcagctctgagttgcaggtgtttctctctcctaagacaggagaaatcttaggtgtcttaatagggtgtcctctggatgttaggaagtagtgattggggccgtgcagggaacagaggtaggaagaccgtgtagcctagtggtcatgagtgtggacctgagagggaagcagacataggtaggaaaccagctagagcaccacctcactatgagaccctgggctgggtggactgggcctcagtttgctcacagcccagctgtattgcacttgccttgctggttaacgtgagggtgaagtgtaataatgtgacacagtgacacaggctgagcctgcactcactggtgctctgtacgtgtaagctgacagttgttgcatcccttgttgtgtcttttcctctgcaggccgtcagcttgtcctggagactctttatgctttggcatcaaatacaaagataatcaaagaagccatggcaaaaggtaacgtacacggctctttctcatccgtccagctcagtcttctccagagaagtagactgcgtgaaggtggcattagaggtctaaaaactcaacagctgcctaatcagtgtgatggtcctggttcccagctacacaggctgaggcaggaggctcgtttgagccaaggactttgggtcaaaatggacaacacagtgtgaccttatcgaaagtcagagatcaaaagtgtaagaagtaatgagttgaacttacatggcaagtgaatagaggctgtgctgatgagaaagtcactcagcatttgagcattgatctttttttttctttctttcataggagctttgatttatttattggatatgttctgcaattcaacacaccctcaggttcggtcccagacagctgaactttttgccaaaatg

SEQ ID NO: 35286 - DNA, 1234 bp, Mus musculus
catttgtgacctttacctagatagaatatttcagtgttcataaaatatttgtatacacatcattttgttttaatgctattctaaagatacctgctagttagaaattactagaaaatacatataacactctgtgttcatctgcagatctttaaaatcagattagattcaagccatacagttaatatttagaaatagtagtgcattaattaaagctgtatttgaagagtactgaccttcattaaactaaggtttaagttaatttgataaagcttgatagaacctttggggggactgtccacagacagtgtgttagacaacacaaagtttaatcaattaaataataaataagagtctttggctcttctagggtactgtttttcaaggaaatcttatggaaggaaatgaagtcatattaaacagccagtagatttaaaccaaatacctaatcatgttcccagctgtatgagagcttagtcttcatttacaaaagaggaaggtaacttgcttcatgcctggtagaatgccgtatgctctgagtacacactttccaggaaatacagtaaatgttgaccgtagaaaatattttctagggaccaggataatgccatcattcgtcctctgcccagagtgaaaagactgctgtcagatagcacctgccttccccatgtcatccaggtgggtcctcgtgtgctgctaagctagaacactaatgtaaaaatcatgtgatcatactgtagctcttagctttattataatccattccattttcatggagctgaaccccaagctacatttgtttcatttattcacttattcttattttcaagtcttgtttatttttagtgtgtttgggtgttgttcctgtgtatatgtttgtgtgccatgtgcatccctggacccctggaggccagaaaagcgtagcaggtcccctggattgggcttacacctggttgtgagctgcgttgtaggtgctgggaaccaaatccagatctcctacaagagcagtctatgttcttaactgtggagccatctctgtagccacagttctgcattctaaactaggtttttaatctgggtatactggaaatgaaatgtgtgatgtcttcttcagatcccagattcatccaaaagggattttatttagagtctattcttcaaagtcacatcactgtgggagctgcaatggtgctctcctttgtgctgcagaggatgcagcagcccacagataagggca

SEQ ID NO: 35287 - DNA, 1220 bp, Mus musculus
acgggggctgcttttctctaagatgagaaaactgggtttatagagggaaaggtttgctggttttcctgagtggtctgtcctggtgttccaggcgctagatggagcctagtcctttatgtttacagaaacagacaggaggtgctggaggtatgtatggctcagaggtagagtacttccccagtgtgtgtgcagcactgcataatttagaacatggaagagttctttaatgtaccattttatttctggttactggataacctgtttactggtgggcaggataattgtagggctagggtttatcatgccgctttgtctttattgggggaggaaagtgcttactcagactgtattaagtggacattcttacatgatctctttatgggataattttgtcttttgaatcctacaaatgccaagtaagtatggttgcatgccagcatgtctaaagaaattccacatgtgctcatcctagagagtgttctaggttacagtgccgattgaagagaaaggctttcaattatgcaaaaatgctttcctctttcagaaaaacgttaaggatctcatggactcaaacggcattagaattcttgtggacttgctaactcttgcacatctccatgtgagccgagcgacagtccccttgcaggtacgtttgctttctagcttctacaagttgtgttttctttggatacaattttagactcacaagattctttgaaatctgcacctgggtttgtgtttctccaatgaatacaatcgtgtgaatgctgggagattaatgcataccaaaaaaaaaaaaaaaaaggaattattaccatcagaatcagttttattacttgataacatttgtcttttatgataaggtaactgtatcgctaaaaagtggcttggttttaatacaacgtgacctttcagttaattattggatatgtaactagaatatcatcattgacaaacatcaagaatatgttttgccctaaggccattggggacattattcaaaccatacaacaggacaaagccaccaaggccttctctggtacttgatttaaagaaagatctatattttcgcctatttgatgttttatgtcttcagatatatttttctggttcaagatatttatgacaaaaagagccttttaaatattttagaatggggcattttggggtttgggtatgactaataaaaatcacaacacttgttaaacaccattgcagta

SEQ ID NO: 35288 - DNA, 1227 bp, Mus musculus
cgttgaaaggtaggttccttttcaggtctatcatgcacaccagattcggtggtttcggtgagttccggggaaagctagagccctgcctgcactagccggctcgctcacctgattttgcttagctgctgttatcaccggttttctggctcctctatctaagcagctcattcctaagagctttttcacagttagcacctctggcaaactggtcaccgtggtgatgggtgccctaatttggctttcagagacaacttaggttgcacagaccttctaacgttagaaaccagaacatcgctcagagccaacactcagagccagagctaatgctgctattctctgagcatgcgccctaggaaaagcagtaagatttgactgcgcacagatcacaactacttcgctttcccagcctttgatcgcctttacccacactccagaccaccctgtttctttaacctataagtacccctacaccgtttcccccccagaggcagatctgaggctctctgccccaccttcataagcgacctcttcaagaaggtactatcagtatcagttcccacatggtctagcggttaggattcctggttttcacccaggcggcccgggttcgactcccggtgtgggaacacaagatctttagctggctgctgaggaggtgtgagttctttagtctgagtggaatgtatacaaactctacaatgagccttgaaggaaggaaacacttgaaagtatggaagtatgtatggtttacaaaattaaaggggaaaaaaaagagcccgcacactacagcaaaagactcagtcttgcaaaatccagtttattattgtaatttattattattcacttgtagcgcttttgtactgcacatgtattagtattcgtagtgtttgggattgaacgcaggaccccacacttgctaggtaagcactccaaccctgacctgcatcctggctttctttaattttttatgttgagacagtgtctcgctaagttgcccaagctgaactctgtaacacgagcaagccttaactcaccatcgtccggcctcagaatctggaatagctagatttacaagcctgtgccacccagtaaaactcttccggaattgaaggcaggctctaccggctgcagccaatcacgtgctcagcagcaaggcttgctttcagcttctgctccgagggtggctggccgccttataaccctgctggcaacccttattaacccgcc

SEQ ID NO: 35289 - DNA, 1271 bp, Mus musculus
gtgttaactgtatttagtgtcagacctttatgtttgaaagataaatatgcatacaaaagatacttgacatgtacttctaaactatccatcctattggacagttaaatacatacttacaggtcacagtaaagtacacagtggtcagcagtggctttattctcaggggctagctgattcagttgaggaaaaacaattaaccaaaattcctagaatacaaagaaatacagcagaagagctgttcgcctctgtgtggagtggctgcattcatgctcagacgtgtagagcggagactctttgtcggaggtccctttacaggccagcattggtagcacatatgaatgagaggtttttccttattctctcagatcaaagactctacactgcctgcatacaaggattcctgcaagaacctgcctttccccacctactttcctgatggagatgaagaagaacttccagaagatttgtttgacgagagcgtgtggcagcccagtgaaccttccatcacctttgcctgatgcccgggtgtggcaggactctgtgcttcgtgcactttgatgaaccagatcaggaatgggaatcgcattcccgcggcttagtcatgagagcatgctcttgtttttatcaaaggacacaaatgagtcactgagccctcccttcagcctggttagcaaggttactgcattaaacaaacagtcgcatagactgagtttgttaaaattaacaatttgtgaagatcaagacgcctgtcatttataggtgtcattctttagacatatttcccagtctaggtttgcgtttgtttttataaacttttattaaagatttatctctcaatgtctggttgtgaaacagaacctggaggaactacattgctgcctgttggataaaagaaaccatttcttaaaaatataacattcttttagagtttagaaacttaatgggaggaggacttttttaaatctaaattatagaaacctacgtgttaaaatgaggacttagtggatacagagcccagcatagcctgctgtctgtggagcagccactgctgggctctgctgctgagcatggggggacatatgggcaattcacttctcagaacttggctcctgacttgagcgtgagcctgacatgccacttctgttttctcttgaaatcagggatcatattgtaaccaaactgcattccaattagccatttgtaccaacactggtgcaggttattaactgtaaaatggggctagtactgagccttgagtaattgtgtaagcc

SEQ ID NO: 35290 - DNA, 1952 bp, Mus musculus
tcgcccttgaggctttcatcttggagccaccttgcttttcccttatttccacatttttaacttatgggaatgattgatccctacctcctgaaatagttgtggaacagtgtattctaaggtgtaagatgttgctctacatttcaaagtcttgtaaaactcttttttttctctttcagatctgttgtttcttttgggccttacctcgtcagtgtgcattgtgtctgagattataaagaaggttgaaaggagccgggagaaggtccagaagaatgctggttcagcatcatcgtctttccttgaagtatgatgcatattgcatttttttttaatttgcaaactaggaattgcagtctgagaatcatttagaagggcaagttcaagaagataatgaagacttaaggacttttttaactttccattgactaaaaatgaccattaatgttaaagacttgatttgaactttgttggtagtcccaaatgaaattatgcaactttgaataacacattccttgatttgaattggcttttgcaattgagtgaacttcaacatatgggcaagtactgaattaaaaaatacaaaaggcaaaacctgaaccaccttctgcacttaaagaattctaatgtacaaatacactgtctgtcttagatggatataaatattttttttatttttaaatattgtactatttatggttgtggggctttcttactaacacacaaataaactcaatcatttaaaggcattctatttggtttagaaattgccaggggtgccgtatttcagctaccgtgcttcctttttcctgaaatgtaagcaactgataccttgtgctaccatttttatatttcaagttgttttttttttttttttgcacaggatgtgaccactgtctaatcactgttcttttctttctttttgtgactgaaaagcatatactgcaattgaagtaaatgtttgctcttcttagtaagtgtaaatggttgttttttggtttttttgtagttttgttttgcatagaggaacgagtctttgatctagcagaattattagttcagggctgttattggcattacagttagagtaattgtagttaacacacagccatagagtcaaaaacaaggctgggttggaatttaaaacattatattaacatgtccatgtttagtttaatactgctttgtcggtatcattttgtcatttcttctttataaatcaaacacttcagctgaataattgacctttattactgtttcatatctgtatttttaagtctatttcttagagagtatagactagtatacttacaaaatagaaaagtcccaaactcagagagatagcatatgaaccagggtgtacattggaagatcctgtgctggccgcctcctccgaatcctctaggcagctgctttgacctagattgtagcacaaccctgagtctgtcccttctaccatttgttgtactgtcttctacttcattcagtatgcttgggaaatagatgagtttgttttgtgcaacaccatctgtttttataaaagctcgataaaataaaaggtaagtgttttgtattttataacctgtcaggattaataactgttcctaagcttgttcaatattactggtgactgtcaacactggtgtgctgtcattgataggagagttctgttgtttgtgtctgtactactgaagcacgagcataaggggccaggtgtctgcactttgttctttattctttctggctcaactgtcaagtgtacattgttctgtctgattaggtggaacgtgaaatcattgtctgaccaactcttagaggtttgatgtctcatagcaaagttttataatggttttttacattctgttccagacttgaaaactacatattaagtgcatattcagtcttgtttattatacagtagaggttgagaatatgactcatgaaatgaatgtgcctat

SEQ ID NO: 35291 - DNA, 1154 bp, Mus musculus
tcatggccatcacagcaaatctcctaatcaaagacatccttgcatgaaatgtgttttttgtcttggtaggttaggaattttagaaatcaattcatatgtaaatgaaactttttgaaagttagctagcaagttctcgacttaccttgccaaatgtatagatgtggaaagcggcaaatcagtagtctctattgccctcacttcttgcctccctctccctctccctcctctccgtcccccatttccttcttcctgctagttggtactagagacatctgccatcatgtctagcagtggtaattttcaagtaatcataggcagtgatttttttatgatccaacatcttgttttcaaaagaaagcatataattccctagctaatagatgctagttaggttataaaagtagtgtaaagaacattgcaaggtactttgttctctttgtttttaagccttggagtagagccagtggataaagatgtcattcgaaaaccgcctcgaaactggaaggacagcattttgacaaaaaacttgatacttaaaatacttgtttcatcaataatcattgtttgtgggactttgtttgtcttctggcgagaggtatgttcactggataaactgctgtgttaccatgcatctgtgtagtcagattcctagtaattttggtgtacagatgattgacaagtgaagaaccctctgagtgaaaagcacaggctgagagaatacaacgtaagtcagtaagcctttagtaaagtaccgtgtacatgcaagtttgagcagagtaaggaaatctaagtccttgcatagcagtgttctcattagatttttttttttttaactttcatgcagactgtttgttcactaggtggtctgtagaaaattcagatgggtttcatgtttagaatgaagctatttcattttaaaagcttgcagtgttatccattctattcagccaccaagaaacaaacaaacagtcattttgtctttcttcttggcagcttcgagacaatgtgataacaccccgagacacaaccatgactttcacttgctttgtgttttttgacatgttcaatgcactgagttccagatctcaggtatgcttaaatgctcttatttacctctttgagaagaataacctttcctaggaagcaggtggaaa

SEQ ID NO: 35292 - DNA, 1141 bp, Mus musculus
cctgggtgctgcgactagagctcaggtcttctgcaggagcagtgggttctgggtactgagccattgcgtcagccctatcagggattgtggtttttaaagaggatttgaatattgtataatgaaaatagtttaaatagagctcaattttctggtaaattaaaatatttcaatgtttcttaatcttacctaacaatagaaatttttttgtaagtgctaattattatttgattggaaactaagtttcaagatgtataggcatattttatgtgatattttcttatttgcttatttttaaatttcaggtctgcaatagaagagggtaaaggcatttataataacattaaaaattttgttagatttcaactgagcacgtaagtttgcaagaactttttacccatgggtcttctagagaaattatttgaacagtaaaattatgacctctatttgtgaaaattacttactagtagttttctaaaaagtaaaaggctattaacatactgtttaggtcatactagatattataatcatgtagggatgatttaaaatatataataaatatataaacaataggtagatattttgacattctatattaagtgactaggactttgacatttgaagggatcctgcaaacaattctcttggtaactgagggatacctgcataaacttctggggtttatttaattgcccctgaaattaaaagaggatgtgtcacatctcagtaatgcttcttggttatctttttctcaaataggatagattttatatacccaaaaagtggttaaatatttttgaaagtgttgctctgtaggtttaaaaacctttcatcggggcttgatggcacatgtctccaatcccagtgtagaagactgaggtagaagaggccagaggcccagcctgtcttccttagagagggcctctctcagggttggaaggtcttaactacttttgctgttgttgcctaagcattaaaaacaagctttgttgttgttgttgttgttgttaaatacttgtagcttgctaatcagggtgactttcacttttgatcccaacacctgggagactgagtagattgttgtgccaatccagtctacattagggagaccctgggctgcagcattagactcactttcaaaaaa

SEQ ID NO: 35293 - DNA, 1424 bp, Mus musculus
aagaatcagctatgattaaccagataccagaactactaaagtaaagcctttgcattactggaactattgatgctggttagctggagctaagaaattagtggtgattaagaagagaccagcatcactgaggtgaaatcttctgggaagtattttctgaaagcacagaggctgtgtttcagagatagccaaggctgtaccttgtgctgtggatggacttaataatgtgtaagagctcttttcctctggcgcgccaccgacgatcctattgtcatcatgggccgccgccccgcccggtgttaccggtattgtaagaacaagccatacccaaagtctcgtttctgccgtggtgtccctgatgcgaagatccgaatctttgatttgggacggaagaaagcaaaagttgatgaattcccactttgtggccatatggtgtcagatgaatatgagcaactctcttctgaagcactagaggctgcccgtatttgtgccaacaaatacatggtaaagagttgcggcaaggatggctttcatatccgagtgaggctccaccctttccatgtcatccgtatcaacaagatgttgtcctgtgctggggctaacaggctccagacagggatgcgtggtgcctttgggaagccccagggcacagtggccagggttcacattggccaggtcatcacgtctatccgagccaagttgcagaataaggaacatgtgattgaggctctgcgaagagccaagttcaagttccctggccgccagaagatccacatctcaaagaagtggggcttcaccaagtttaatgcagatgaatttgaagacatgattgctgagaagcggctcattcctgatggctgtggtgtcaaatatatccccaatcgtggttctctggacaagtggagagccctgcattcctgaaggcttcaatagttctctcctataccctaccaaatcgttcaataataaatttcgcatcaagttcgcttaaaaaaatactaataatgtgtaagagtcacccaggtggtactggttttgaaggcatgaaggggtcatgcagagcagctgaggctcggcactgtgagaggccatggaaggccattggtgaaggcgcagcctcagttgcaattgacggcccaggactgaaagggtcatgcagtgttttggagatgccaagtactatgagatgaccaccaagagcagcagcagtggagtacaggcatgtggagcctaaaggacaacgtgtgtgctacaaagagcatggctggagaagtgacccaagcacttggaggagcccagaagatcgtgagttggatactagacattggacggttggagattgatttttgcttttgactgtgactgtgccctgatatttttccctcttgaaggaagtttgttagtgaagcccacagttaagagacttt

SEQ ID NO: 35294 - DNA, 1197 bp, Mus musculus
agtctgggtgttttgcttcttttgttttgttttgttttggtacagggtctctctaagtagccctggcttctccggaacttgctctaaaaaccaggctggccttttctgcctcttgagtgctgggacgaaaggcatgtgccaccatgcccagctgacatctgggtcatatggcctggggcagtgtgggacccacacatgttatttatgtacatagctaccctcttgagtgaagtgatctgtccccatggtatagctgagaagttgaaagctctgtgaagtccatccattgcctgggtcactctaatgtcaggctggagttttgcaactttctggcttagaaagtggccttcaagctgtttgtctaggctaggatggtcacaccccatgcctctaaatcagcagtcaaggtttttctgaggaataagtgactgctatgtctctcagaaactgaaaagagccccgaggtagagtctttttgaagctgtttgagcagtacttaattgctaccctggtatcttagtcagtcctatgtcatggtccagtagacccctctggatggcctagccaggggactgttgattagttcttatgagtgccctgaagttcgtagttgaggattgtagctagaaagtgaggtgatattgtatctctcagccacagtttaagatccttttgctttttctcagggtggcgtcctaaagggctgctagttgcacatcttcatgagcacaaatctgctgtgaatcgcatcagagtctctgatgaacacttactttttgcaacatgttcaaatgatggcacagtgaagatctggaacagccagaagatggaggggaagaccaccacaacgcggtaaggtggtgacgggccagccaatccagctacgtcagcagtgcttgcagaatgctctctctgtatcagagctgcttagggctgtgcggaccagaggctggccatctggggggacgtgagacagcagaagctgtaaatgagtgaagtattgaaacaatcctgttagatggcaggggctggggaacatgggtgggggctggagtgtctataagacactgccttacagagaaacatggattcaaagaatgaattgcaagaagggagaaagagccacacaggaatgttgaatgttctgggcagtgtcctggggcgagtggggtggggtggggacctgacagaaagttt

SEQ ID NO: 35295 - DNA, 1172 bp, Mus musculus
ctctccgccaggtcctgcggcctcagagacaccagcgtctccccggggcttgagagcacccacaaaggcactagccccgaggcgacctcaagtcctgccctcgagagagagggtttagatgctccacgcccgcaggttcacaccccagaaccgcgggctccagctccggggcctcagcaacgggaggccgccccgctgacgtcatcgtcccgccccccctcccccagctcgcgcctccgttccctccccgccccctttcccggcgtccgccgcgacacaagctcctcgccctctgattttgcttctcccttcaagatggcggacacaatgagccggcggagcgccggttggccctgaattgactccggagaagaacggtcagcgaggtcccgtcgtccgggcgagagagcgtcgcctgaggaagaggacgcggcagccccactgtcagccgtccttcggttcgtctccagcgcggcgcccgcaccgccggggttggccctgagcagcccgcccgatcgctcgcctctcggccccgccccggccctgcgccgccgctgccttcagcagcagcagccgccgccgccatgaagctgaccgacagcgtgctccggagcttccgcgtcgccaaggtgttccgcgagaactcagacaagatcaactgctttgactttagtcccaatggcgagacggtcatctctagcagcgatgatgactccatcgtgctctatgactgccaggagggcaagtgagtgtgatagtggccgagttccaagtgcccctctccttccctctgtcgctggtccccgactgagcccccacccccaaccccaggcatgtggtgcaggcgctcttgccagggccacctccatcccgcagtgctgcaggagatcctctttaagatgatgatggttcttagttcatgtgtctttgctctcttccgagcgcgcttttcccgcttgccaaaccccaccttgaccttgacctttaaacgccatgtccctgcaccctgcagccggacggatagccctttccactcccctggcgactgtcagaatgtgcgggtggactctgagctcgatgcagaacggcaggagctgtgttctgtccatcagtggcgtccagctctctgccttcacagcagtgacctggattcagccctggcacggtgcccg

SEQ ID NO: 35296 - DNA, 1209 bp, Mus musculus
tctccctctcggttaagagagacgacagtggtttcattttgggatcccagagtcttgttaggtggcagcaaacccttttcctagttggctactgcttgatacgcagatatcctactccagagcagactgcagtaacgtggcgtagtgcttgaaaaggaaggttgcctagagccttagcctcaaggaatttgtttctcttggaactctgtaatgttgtagatacggtgattggaacgtaaggtgacttttttacattttagtcagagttttgtttgtttactttttaaccttttgtaggtaggctgggtacagttcctatccctttcttagttttaactagaaaaagtcagtgattaaggaatgggctccttcatttattaactcgctgtctgtcctcttctctcatagggcctcatgcatctacagggcaaacctgtctgttcctttgatccagaagggttaatttttgctgcgggcgtcaactcagaaatggtcaaactttatgaccttcgttcttttgataaggtaaatctttgaatcccttgagctatcttggggttgcagaaaatttaaggacaacttggacatttgagaaccctttctgggctgggcatggtggcacacacctttatccccacattccagggcagatgcaggtggatctccctgagttccaggccagccaatgctccacattgtgagagctgtctacaaagactgccttcctgtggtgccaaggcaaacggcagctaacagagcagcagtgactcaccctctgctgtccactcgggaagaatcatgatgcgtaggatagacaataaggaaaaaatgtaaaggctagaaaaggagctctaatagaggaaggactgatgtgtgtgaagtgtggggactgctatttttctgttttgcagggaccatttgcaacatttaagatgcagtatgataggacctgtgagtggacaggacttaagttcagcaatgatggcaaattgatactcatctccaccaacggcagctttatccgactgattgacgcattcaagggtgtggtgatgcacacatttggggtgagctgactgcttttgaatgatggctgtttctttgctcataaggcctgggccaggaatgctgtttgctggatggtagaaaccaatagttacactcagtgatgaggtatggacttaagagtttcttggacatgaattttac

SEQ ID NO: 35297 - DNA, 2624 bp, Mus musculus
cttgaaccccttcaattttgaatgtactcgctgctgaggagccagtgaagtccccactttctgcacatccttctcaccccagaaatgcatgggaagccgcggttctggttttgagatgctagggcagctcagcaccccttgccctcactctgcatgtcttgttactgggtctccctgtgtaattaattgtggcattattccacaaccatcatgtttcttaggtgccaaacatttacaaaaataagtcttcatataccttggggtcaaagaaagaaacaggtacagaaggaccttgtttgtcaggaggctatatggtattctcttttttttttttttttggtattcttgtataggtgggtggggcagatcttgggcttagatgttgactaacaaaaggcccaagagtctgaaagggagggaagggggtagcaggtaaattctgagagctgagagatttagcagcttggtgcagttcccccatcaagatgatcccacagtctcctgtggggggtcctgctgagcttggcttgtacaaaagcaagcagtagtttatttttgtacctgagtcacatcacgttctcctgtgggccagtattgtggagcgagtctgagttgtttacactgatgccttccttccctgcccaccacaaattgtgtacatagtcaacagatgaaacccctcctcttctccagctcctacccaagagctggctctaggcctgtgttatatgttatatttagcctttttatatatgacccttgatctgtttgtatttgaacactgtgtgtgtccactttaatacatttgtgcagacatgcacattacatacgtgtatatgcctgtctctcatctagattatcaagggagagggaaccttgcagccaagaatgactctgtggatagtgtgtgccacaagtgttattcttctctgttaaccttagggatacaacgggaagcagagcttctagtgtttgctgtttcatggcagctaagtgggggccttgggtgactcccttgtgctctttaagccacacttcggggccctctctacagtattagattcttttttgcctgattatgctctgtctgcacctgtgtatgtgtgacagtcacttttgcatggcttctgtgcctggcttgtggcatttagggacagggtgctggaaccacagtgtttagtttgtcagaacttgttggccaaccataagtcactgtcacctgctgtgtctacactgttgccccttttcttgcttttttcctgagagactttagctaggcccagactagatgagttgcaggtgaccttctcttcccagctcggcagctttagagtagaacaaacggccatcaaacattgatgcaagcactatccctgcagatccagaaatcaagactcaacaggttgtgatttgcccaagagtacccagctgctagcgtgctcagaccatcactgcttctgttcagtcgcagatagccgtccagtcaccaatgcttttgacttgttccaactgaaaagttggactgtcactgaagtctgttaagtattgctgaacaatcctgctataaaattctgccttcccagaatggaccgacagaaggagccaggcaatcagctccatgtttgaaagaactgttgaaggcaaatgtctgtaatcgtagattaatatggcagcttgcctgaactgaacgcaggaaaactgtcttgagtgtccaggggttgaagcatcacactcttagaagacataccgcctcacggtctctgctgggccctgaggccacagacctgagttatgttccgaattggtaggaaaaggtgcagctggagtttatatggtcacagggtaataagaaagagggagaaagcagagatggcagtttggggatgtgtccctgggatgtattcactgccctctgatatgacagctggcactgcactgttcaaccaccagccactggggtattttttaataaattattccctgttgtaactgacaattagtgcttatgaaggaaaattggaagatctttaagaaccagtttgccacccaagtggtaccactgtttaaatcttgatgttaaatgttcctttagatatctctgtgcataaactttggtgtttacatagttgttattctactgtacatacaattttgtcctttttgtacttaacatataaactttttttgccatgttatcagtcgtaaacaggattttatggtttacagtctcttccattgagtttctgtaacattccctggctcacttctgacagaatgggttgttcccatgtcctggttccggtggaaatgcttggcctctgggcaacagaaacacacacccctcccaggcacagtcccttaactccaaatgccaattaaattaccacaggagcagtaatgagtgactagaaaaggtaagcttgactcaaccccattcttcagagaccacctcactgcctgccttgtgtcccacacagtttacctcaaacttggatcagattggcaagctcttgttagaataaattgcattctcccaggccttgtttgatcagaagtgagcatctggcagtaggacctgctgagccatggcttggctaatgcattggaagtcattggaattctag

SEQ ID NO: 35298 - DNA, 1134 bp, Mus musculus
aaagcctaaggcccagggcaaaccaaggcacacataagcccaaggcttgactgccttaccacctccttttcctaggtctggtggggatggggctaggagaaggtgactcaggccagtggggtaacagaccctgcattgtagatcctgcggttacctaagagaagacagatatcaagagtgactccagaagtggggtttccctgagagtggtatgtgttgggccctggatatagtggtgacttctgtcttgacccatgcagattgagatcggcgatggagcagagctgacagctgagttcctctatgacgaggtacatcccaagcaacacgcgttcaagcaggcgttcgccaagcccaaaggccccgggggcaagcggggccacaagcgcctcatccggggccccggggagaacggggaagacagctaggtgtctggactgggaacagggccgggcacgtggactacagggttgccactctgccacccctggacttccttcctccccagcctgggctctaaggaattgctttcctgtgggacaaggagggcaggtggctgaccatatctgagggcctgcctctggaccagcactgtgtgaccttgccctgtcactgtccctgcctctcatctgtgtgtacagggtggctggcgaaaccccaccttggcacaaacctagcctccagaaaatttcgtgctgtggttgcagcccagcccaaaagcctttggctacagtgggtggggacggttggcaggggccagatgtcacaggaagggatggttgaatgctgtattttgtaaagaataaaatatttttaaatcaatactgagcctgggtgcctttccccgttcagagggggtctgatggactcctggcctcaggtgtgtggcatgctttgagtgtaaggacagaagccctacccatgaggttatgaagatctgggtgtctctgtttcctgtggttgatgtgacaagttaccacaaactcagcggcttaaaaaagtggtagtttgagcccaacctgagcagcatagcaaacaaacccctgtttcaaaaacacaaaagaaaaccttgcagatttattcttagagatcttgaggccatggtgcacacagccggctcctggcagagttagc

SEQ ID NO: 35299 - DNA, 1494 bp, Mus musculus
cctcagagcctgggaatctcgtgctttgccactgagagtcttgcagcagccacagtgcctttgcctctgtatcctcccagtgcagaagcgtgagatagttactgcgtgtttctaaggcagcatcagcaggagcaggtttgttgcatggtccaggactccaattgtcttgatgcctctgccattaagtagcacttttctcatgtcaggctgtgaaatttactctgattccgggaaccatgcctccatgatccaagggattcgcaacagtcgagtgccaaaatatatcttccgccacaatgacgttaaccatctcagagaactgctgcagagatctgacccctcagtccccaagatagtagcatttgaaactgtccattcaatggatggtaagtatgtgctgagggtaacctgaagcctgggatgcagagctgggcttgaactgtttgaaagtgtgtggctctgggcacgtagctgcttgacagtgtctgaggtcccagacactcaactccagaaacaaaaacaatatgtttccttttggtttggcatttttttgcactgggactctgtaattgagagatgttacatggatgttacatggatgttacatgatgttacatggataggtaactgggttttctgtgctggctgttgctagattatataacctcatgggacaagaactgggggaagttcattttctctctggtactaaaaatgaccccttagaatgtatggcactttgctttggcgctcaccattgtcactgacattttccttggctttcctcaggagcagtgtgcccactggaagagctgtgtgacgtggcccatgagtttggggcaatcacgtttgtggatgaggtccatgcagtggggctctatggagctcgaggtggagggatcggtgatcgggatggcgtcatgccaaaaatggacatcatctctgggacgcttggtgtgtgcacgggctctgtggctctgtcctttcacgctgagctttgggtatacaccaaggccagtcactggctggtctaacttacaccaggaccggaagcagggaggtaacctgtaaagcctgggctgttttgtggtgaattttgttctcttgagatgggatctcagcctgtaacccaggctagccttgtttctcccatcctgtaacccaggctagccttgtttctcccatcctgagtgaagctttccatctgagagaatgctagcccagctttgccaaatccctggggacgtggaggctcacagactcccacagctaaatatgacagaaattacatttcttgtcatctgaggtcattccacccatacttgactcttagtgtaatgctggattcagaaggaggggggacgccagtgctcttctgccgggcattgggaaatgctgtgctctgtgcccagcacagagagtgctctggctctccatcccgctcctctccccacgctggcaccctgacgccggggcttcaggcctggccgcaca

SEQ ID NO: 35300 - DNA, 1184 bp, Mus musculus
atttggggggatactggggaacccaagaccctccagagagacctcctggggggagcccaaatcagccacagtcctggaaatgattaagaacagttttccatcgtaggggagctataagaagccacagacctccttgcaccccactgcctcagaccctcctagaactgatcacaggaaactcctttggaacatcagtgtgtcccaaaattccaaagcctagccagggcaagagctaggggcatcatgttgcctacagtgcatcctattcctacccctatggtatgtgttaaataaacatgagttattaagtgagcattgcagtagctttgagagctgtattttacatacaagagaactgaagccctaagtatggtaacgtagccgaggccagtcggccagctggtcaggttcagatgtgagcatgggccatcaaagtcaggatcctgctcttttgtcctacaggccaaagcttctcactgagactcgctgcgacatttcccaggggctcacacccctgctgcagccacaaacacaaaggagaggaaggcaggccccaagcatgagctggggcgaggaggggatcctgggacagaagttgtccctgggcttcaggaagcagtagtggccacaagtgccatttgagtgtcacacacaaggagtctgatgtcttgggtagaaaaggtatcacatcctagaggcggtgggaaggatgggattcaagagtcacccagaacaggggtcactaggaagctgcgatgtgggtgttgaggggacaggcaggcagggaaggcgtgggcccataaggctggtgtgtgctagcgcagaaggaaccccttctctgcagagccctgctggggctaccatggttgctatgagacagccgagtgctaccttctgcccaatgctgctgtcttttcctagccacagtggatctctgtcttgctacagactagggaagatgtctcaggccgaggcttccctgctagacttcagttcgtcctcctcttgcccaggcaggcatgtgacgtggtgcctggcttagccaccttgcccacttccgtgttacctactttccagctcatggagcaggcccaggaggtgccctcctctctggaatctattccctcgcctaagagggcccaggattctccttggaataagacctgaccacagggaagtgcttt

SEQ ID NO: 35301 - DNA, 1235 bp, Mus musculus
ctcttcttggtttgtttttttcttttcttgtcttttcttttcttttcttttcttttcttttctttctttctctttttttttttaacaaagtgttatttttcaggctaaatgcaacaatggattgtataaaccaatatttcaccccctttcctaagacagagagagagagagagtgttctcagtttcttgtttcaaaaagcaaaccatcgatgtattttgttttcaatggaaaagacaaaccccatgttcttgaccaaatgcattttgcacgtgtgtgaagtctgatttcccagcaggccattctggaagggtgggttgtcactctctgggcatcaggaccctggttctaccatttcctacctgtgacccagcccacctcagtgccgccttggcacagtcccgtcgctaggagctgcgcctggtgggcactggtggtctttgtgttgtctgccctcctaccaaccttctgagagtcctgcagacctccctgccaggtcctactggaggtggtgctgcaggggagtggcaagcagtagcattagccatctgggctccgcccctgagagggctgcgccctggccctttcataaactgcccaccacttctgtcctcatctctgtctctgaactgggaatagaggcccacagtgcctgtgtaaagccttcccagtcccttagctttgctgtagactccaacgaggttcacccccagcccccttgtccaggtgcacacctgccctggcccatgttgcccgtgcctttaacctgcaggcaacctacacctattgcggcccaagagctggggcaggtggggcaaggactggctagtggggggtaagaggcccccatcccaggatccatagcacaaagccacgggctccataatactcctccggtttcatcgcttctcagccttgcttctccctaggcaccatgaggaacaggaagtgctggggtcctgatgggacgcacacccgcagggggcagtgactgaggccacatcttacctcacagggctggttttcagggattctttagggaagcagtttaaaatcttgccacagttgagaaattggcaaaaaaaaaaaccaaaaacaaaaaacaaaacttccattctgtacatggcatgtttctctctctctctctccctccctcccttacccccccccttctcattttttaaaagaaaacccagaaacatggatcagagtgtaaatgagggtataccagagggtg

SEQ ID NO: 35302 - DNA, 1506 bp, Mus musculus
ctgtggtttctgccctccctccctccctccctccctccctccctccctccctccctccctccctccctccctctgtacctctcctgtccttccctcaaacacatccagcccgtgcctgctcccgtctattcctctccttcctatcttttggctaacctcatggctcctgtctcacccccacctcttccttcatctcccctctgtatccctttctccagtctagagacggccaagtctacctctggggggacgcctggctcagcccccgcagacctgcccacccctttctcgccacccctgacggccctgcccacagctcccccaggcctgctgggcacaccttatgccatctccctctccaacttcatcggcctcaagcctgtgcccttcctggctctaccacctgcttccccagggccaccgccgggcttggcggcctacactgccaagatggcagcggccaatgggagcaagaaagctgaacggcagaaattctccccctactgaggccggccggctgaggcaccggcaggggcaggcaggaccgccggcaggggctgcctccacatccttcctgcccaaggagactccaccatggggtctcaagcgccagtaatgccagacgcatggatgcaccccctaccctgccccatctttggagatcctcctctgagaggggacagtttctggcccagggttctaggagtatggcagccccagggcaggggccccacctctacagacctatgcttggatgcagagaatggccaggggctctctggagccctgctgtgggaggggttactcatgtcccctccatccctttgggcttcatcctgctgtcccagtgggaattggaggagagtgaggggcggccagggccaagcttctcctcatcccctgtagatcctgctgcttctactgatacccttttgactggaatagactggctgggcttgtccgggggagggcaacccaaagagagggctctgcctgcctgtaggtgtggcctggggggcaggggcccagtctcagcagcagacactctgtacagttttttcaatccctgtttttgaataaatattctcagcgaccagaaagctgtgcagtaatactagtgttggggtaacaaaacttccagggaagggatgaaactgaaaccccaaagaaccccagtctgaatccacagtccctagttgacccacagtcccttcctcgtgtcagttctggggtgaaaccaaagggccctttgggggtcgtgtgttcaatctcctgcctttagcagcaaaccaatcaggtagttttctgagcagcttgggtgatgagtttgagtcgaactgcccagcttctccatggtacagatagtaggtaactcggtacgcttctccactggttactcctgctatggtgtaacccaaatcctgctccgcttggttcatccttctggctgtgagttcttaggaccctcatctctgtgaccatgcctgcctttctcctctttggacc

SEQ ID NO: 35303 - DNA, 1107 bp, Mus musculus
cagaagagggcatcagatctcattacagatggttgtgagccaccatgtggttgctgggaattgaactcaggacctgtggaagaacagctagtgctcttaacctctgagccatctctccagcctattattattattattattattattattattattattatgactttaatgtttttatttgtctcgtgtgtgctgtgcacatataccacagctcacatgtagagatgtcagcagacaatctgtgggaatcgagtgggttctggggattgagtgcgcactgtgagaggccaccaccgagctcctgggcacttttgcattcttctccttttgggcgtcatggctgccatcagggactgtttgccaccatttggcagatgggacaaagtgacaagtacagatgctcacagctgctgagcccacgttcaggatccttccttgcccccttgtctgcgctgccctttcatgctgggggaggggaggttgctaagcagccggccctgcccgcaccctgtgacttccctcctcgcttcgtggcagggagtgtagagactgggcggaagctgcatgtgatccctcgagccaagaagggtgctcagggccagcccgcaggccacagcagccacgtcctctgcatggccatctcctctgatggcaagtacctcgtaagactgggttggccctgtgggcaggtgggaggtttgggtgtgtggtgtgtgccggtggccattaccttcgttcccacaggcctctggcgaccgcagcaagctcattctcatttgggaggcccagagctgccagcacctgtacaccttcacgggacaccgggacgctgtgtcggtgaggctctgggtattgaccacctgcctagcatggaagcctgctgggtgtgccctcctggggccaggcgccaggccccaggctcatctacagaggcctgtgggtagtgagtggtgtgtgtgtaaaggccgcgagtgcgttgaagagatggggagcgatggagggagaccaggttcagctggaaccacagagggcctgaggggtatgtagctgtttgaggacaggcaagcatgttcctggctctgggggaacaggttcctgggtcatgtg

SEQ ID NO: 35304 - DNA, 2008 bp, Mus musculus
gtggggctctgtgggctggcgagggggctggacgttgccccctcacagcctctctttctaggggttccattgactgtatccatctcatcaacgaggagcacatggtgtcgggcgcagatgatgggtaagagtccctttctgatatgtccgactgctgccgccaccagtgcttcctgcctgccaggccctggacttagctcattttggatcagtggccacatccctcagctggtctatgtgattggtcctccctgctgtatgcctttgtctggctctggcccctcagactatctttttcacccacagctctgtggccttgtggggcctctccaagaaacggccactcgccctccagcgcgaagctcatgggcttcacggggagccaggcctggagcaacccttctgggtgtcatccgtagccgccctgctcaatacagacctggtggccacaggtgggtgggtgctcggtgaggtggggagggggactgtgggtgagctggtatggggcttgcttactgactctctgacctccaaggctcccataatgcccgtgtgcgactttggcagtgtggagagggcttccggcagcttgaccctctctgtgacatccccctggtaagtggtcctaaatgcataaccctgtctttgcaagactctggaggcccatggaatgagcaatttctgcttttctcacccagagacgtctattcagggcaaggccacttactgtcacagagcctgtcccacttttctcctctgttccccaacccctactccctccaccctgtcctggctctgtgtacaagctgagtgtgagtgggtagagggtggaggcctgcactgggcttggttctctgtagtgggtattgacttgagaaccaggctgggctgtgtggagttgactgtccacactggagtgacctgtggggttatgttatgatatgtcacacactccagtgcctgaggcagctcttggcacacttgatgggcactgtctcctcagtccttaccatctccctgcttggctgcggctccactcctacagtttcagagaggaggctggggctcatgggaaagggttggcacacctaaccagtgcaccaggcccctgcctgctgttgggagccgtggtgacgaatgttctgatgtcttaccatgtccctctctctcaggttggttttatcaacagcctcaagttctccagtgctggggacttcttggtggcaggcgtgggacaggagcacaggtatgtgatgggggtggggccgagggcaaggtagcactggccggttgggagtaggagaggggtggcgtgcgtctgcctcagtggtcattcattctctgcaggcttggccggtggtggaggatcaaagaggcccggaactcagtctgcatcatcccactccgcaggctccctgtgtcccctgttgccggctcctgacactctcccttatttaagtgacttccaggccccgcccctgtcctcttttgtattaaagcctcctattttagaccttgttctcccttgttcctctggtttctgggagggtgaggggagggggtaggtgtgtggcaaggaccaggaggtggcagagacctgggagggacaggactctagctagctgctctcagctgaaggcttttgttttcagagcactgggtgggaacctcagccggctcttgcatgacctcattagacagctgctcacccatcagccaagaaactacagctctccattccttgggaaggctcaagccggggtctgaggaccaatggaagctagtggagcctacagttcaggctgaccacatttccctactgtcccagcccaggaagctggaagggataccctgccccgcggtgggacaaggtcagaatcggggaagagagtttcagtctgacagagctagctagcaaggaccctgctgggaagatgtgtcaaaggaatactgcctgcttttacagattgggaattctctcctgttgtggggtgcagcagtggatgag

SEQ ID NO: 35305 - DNA, 1215 bp, Mus musculus
cggtacggctgtattattcatgagtagactctgcatgctcagttcctgtgctagagggagagcccttgctgtggccctgaaggaaaggacagttagtgtgtggtagttgactaacctgtgctctcttgtcctggccacaggagctgatacaagtgatgcaagttctgtgagcctggatgttcgccctggcagccgggagacttcagccaccacactttctcctggggcaggcaaccgtggctgggacgacggtgacaaccgcagcgagcacagctacagtgaatcgggtgccagtggctcatcctttgaggagctggacctggagggcgagggacccttgggagaaccccgactgaaccctgaagccaagcttctggggccccctcgggagctcagcacccctgagaggggtgaggagtaatgataagccctcaaccctcctgtggtgcatttgctaaggaactgagcaaactctctagccctcttcttccttaacctgcctagcttgggctgggagtaccaggagcctgagttgtcctgctccaagcctaaacctccttcctcactgcccttttggctcccagggccgaaggagccagagactgttatctgcaccagcctcctgggctgccaactttgcagactcttattggagcttccagaacccagaataaagtgaattactttcttgtttcacctggatttgagttggtttttgtctgtcgtatcttggggagtctttgtggatagactgtgaatgggcaggatctcccacgtccgaaaagaccatgcctgagttctccaatcagagggatattagaggaccttcattccctgccctgtcaccccagtggaaagtcaccctgcattgcagtagccccaggggctttccttgctgctggatagcagagtaccctccaggtctcaggagcagggaactcacaggttctttgcatccaagagctacaaggctttgagtctgcagcttcagtgtacctgtgttcccgctgggacctccccagaaggtgaagacatccatgctggtcctgcccagtgcccttgttcctaggcatgttcacatatactgtgtgtgaggctgggtccgtgtgaacttcagactgtgacggtggttgggcatggctgtttgtgtgtagatggttggctatgtgcatatgtggttgttttttctgtgtgtatggttgcatttatagcgct

SEQ ID NO: 35306 - DNA, 3025 bp, Mus musculus
cctaacttaagtcccacattggttttttaagttggggaaaatcatgagaaagtgagtgtttccgatctcttattctctccacagtggccatctctgagcagatgtccctttccacgtgggcacaaagtgcactgcagtgtgagggtgaggtggcgttgtggctggaaaagatgtgcttcaccgggacaggactgaaccccttcagctgcctgtcttggtggcctttcctcttctttccctccccattagaaagctccatgttaatttatttcttatggacaattatttattattttcatttggggacaagggtggtgggtggaggttataaagaagatagcagatagtaaaggaagttcttaaatattccagacccccagctgctggtcaaaaacagaaagggagagaagggtccgaggcagatggtgaattaattgaccatggaaagagaattagaattaaccaaaagttcgattaaacagctatgttgtggggagatggcctctcaggaaaatcagggtgccctgagactggctagttgggggtggtgagactcattccatagaaactgaaacttgggatcatggactttgctactgggaagtaagtaacctccacatttggaactattgtcctctgatgatttcacaggccagttctctgctgaaaagtgaagctgtgggtaggtagcctgggttgaggtaatagactgttgattttgagttggggcttgtcttggcctccctagcatttcaggtgatcagtatgggcctggtttctggtccctccatttctctaagtatcacagggaagcccttcctctgtaggagtcttacgtctggctttttttttttttttaaagagtacgaacacgagtcattctggtctcccttcctttgtttcaaataccacggcaggggtgtctagtgcttaaacataaacactggctgttttctattactggtgtgtcctgcgtcctatagccctctgtctcccaagcttttccatgcagccctttgattaataactcctgtctggctttacctccttcccttggctccaacctggttgggcaatggctagatctgcctcctagtccaaaagtatcttaagcactgcctgtgactcttgactagcgacttctcattgttagggggaaaggagggagcttaaaggcagacactgggattgtcccagagacaaggagagagatggttgatggggtgtgtgtactgtccagtaacaccaaagtggacttgtgctttctctgttttcatgtgcaccctgtcagacttaactcttctactcatagaagccttagatctacaatttagctatgcaaattatctgtaacaatttaaaaatagcagtttcaaccagtgctttctcagtcaaatgtagtccaagaatcgatagtcaaggcatttaattggcgtgggttctgaggttggggctggtacagtgggagcgagcgagtccagatctctataacttgtagaacgcattcagagcttgggttacatggatgtccctcagacctcggaacactgagctcccagagttgtctctgttacatggactcctctcagacattggaatactgagttcccagagttgtatgtctgtgtgtatgccctgctagccaggaagagggctgtttctgtgttcacaaatagtaaattagtagaaacaatttcagtagggaactggaactggtttttaagcagccaggaagtaaatgggaattctgagaggaacacgtgactgctgtacactccagcagtcatcctgggcttggagcgtacttcatctttgcagcagccataactctagacaggcctcctggctaaaggtttctctgtgataacatgcagcttatgttgtataagggtgggggtgagatcataggagattgaattgcttactagctccatgggctttggcaactcccctccctccaacaaccctaaatatcctgcttttcaaatggacttatggggaagtgtgcatgcgcaccaagcatgagcatgtgctgagggaagcaggaacctcacaatctattgtgcttagattggaaacccgaggtggtagtgggtataccagctatgcttgtaatcctagccctcaagaaactgaagcaggaagaccattttgggctatgtatacagtgagaccatgtctttcatggaatgttttaagggtctcaagaagcccagtcactctggtgtattctaaatccctgttctctttaacactactaaatgatgcagatacttgctaccttaggtctgctgtgtcccctctgggagggatggggtagctattgaagaaagtaagtgaaccacattaggtcagagccttcttaatggcttatctctttagtccttaccccttgagtaacgctacttaagtatctgtattcctggcttaaagattttgtctggaactcttgtaggaattaatgtgtggatcatatatttataacttacaactaaaactgaagtttcccactctgggagcgtgaagcaaggagctggggtctgttttgctgattagttgaaacagaagatcaaccatagaggtgggactgcaagtcgcaggcagtcagtatctttaggtgtgacatccatggctctggaactgagtccttgtctacaggggaaggtttttctggggcgttacattccttgttcctacacagaccttttgtttcccacttccctttgctttccacatgcccaggtctgaaccatggttttctgtgcactctcagctaggttgctctttcccagtattactgctgggagaagtccccttccccgaggatgactttctggctccactgctgactagttcccaggaaatcagcaccttaaacggccaatctgccaagtgctgacctgcccactgctcaccttcagacccttctgcccctgtgtatccaaatcggtgtaatccctcaacgtctgttctgtgccactagcttggctttaagccgtttatgaatacgtgagtcctatgatga

SEQ ID NO: 35307 - DNA, 1187 bp, Mus musculus
cccatggactgcactattgatagaacatgcttgtttgcctataagcaggctttttgacagtgttggagacaaccaaccttctcttggtttcaaaataaggtttactgtacgtcagttgtatttgcacagagactagtaattaaactcaagtcctctgcctctccaggagccttttgagcacgagtcattgctcctcaaccgaaaagatcacaagctgaccaaagctgagaagaaagcagcaaagaaaagctatgaggaggacaaacgcacatcagtaccctatacccgcccatcatatgcacagtattaccctgccagcgaccagagcctgaccagcatccctgccttcagtcagaggaactggtgagttgctagaggaagagtctgggtgctctgcaccagacccctatcattctgttcctatttcacagggagaatctacagactattccttggctgctatagaaagaaggtcctgctctagggtcaggtgttacagcagttcagctgccccagtgctctgaactgctctggtttgacatccttggctgaagaaatgagctgctgattttgcctctcagaagagctttctgggagaacggtataagatggctttcttatgggccaactttgagtcacatgggaatgtgtacacacaaagaaggtatcttcctcagaaagcttgctgacaggtagggttggtgagatggttagcagatagagtactctgtctgcaagcctgaggacttgagttcaattcctggaacttacatgtaagcaggaggagaaaactaagtctacataaaggtgtcctcccacatacatgctttggcaagtatgtacccacataaacacatccggtacacacatgcacaataataatcatttttgttcattatttattaaacatttactatatataaagtattcatccataacctggcagattgcatttaaatacaaagaatcaatgaagtcattccaaatcaaagtgtaaaaacactcctgagaaaggctaccagatggccaaaatgtcttgtggtaggaaataccaccaaatataatataattttaaaagctcagaaaaaggaagtttcttcagaaatctgcaatcagaagaccaaatgtgttgcacacacctataatggaagcatgtggaggcaggaggagaattcaaggttatcctt

SEQ ID NO: 35308 - DNA, 1240 bp, Mus musculus
aatttgggaaggtaaggcaggaggatgccttgagtttaagggtagctagcctgttctctagagagagagggccctagtctcaaataataacaaaaattcctttgtacacattttatcatgcagttctaatctttttttctcagaagactgttcattctaatttgaacaagcagttcagttgttgattgatcaccttagtttgagaatctttgggtttaaactttaaaaaaaaggactggggaaggactagcctaggacttactcgggcagttattcctaagggagagcttcctatagcctcagctgtgctgtaggggtgctaatgaggtgctaaggagatcggacagctctgcagctcccaaactcccactgcttccccagctctgttaaatgttagggttttctgcttttctgctgcccctgtcttctaagtccagcttggtgtgtgcacggatagcccggtcttgccgttgcagactcctgggctccctcacttggacttgcagctttctgtgctccagtaggaaactgtctcctagtgttgacagtctagctccctgtgagcttcagtggtttcaattgccgtttcaatgcttgactggggctctgtagcagcatatggctatttacttgatgtgtgcgtgtgggaagtgtacgcacctatgtagaagtctgaggacaagttgtaggagttgcttctgttcttgcattgtgtgagtcctgggatttaactcaacaggcttcaaggcagcaggccatgtcatcgtgtgttacttagtggcagcaggccatgtcttcgtgtgttactcagtggcagcaggccatgtcttcatgtgttactcagtggcagcaggccatgtcattgtgtgttacttagtggcagcaggccatgtcattgtgtgttacttagtggcagcaggccatgtcatcgtgtgttactcagtggcagcaagccatgtcattgtgtgtaacttagtggcagcaggccatgtcttcatgtgttacttagtggcagcaggacatgtcttcatgtgttactcagtggcagcagaacatgtcatcgtgtgttccttctccaccactcccttttgtttttattctgatgtgacagacgtaaactttactttcttttctttttttttttttaagatttatttattattatatgtaagaacactgtagctatcttcaggcacaccagaagagggcatcagatctaatcaaattcagtatatctttg

SEQ ID NO: 35309 - DNA, 1207 bp, Mus musculus
agtcctttagtctctgcttagtgaggatttccttgacacccagtgtaaagtagcagctcctcctggcactcaccaggcttcacactctctatattctttttcctcttgctgtacctagaatagtgcttgggactataaataagtaagtgtgtgtgcatgtcctgtgtctctgtgtggacaggcaggcatggacgtaggagatggttctcagcagcctgaaaggagcagcatcaggaaggcacgagcaagtgggagttctaagacatctagtttttattctgtagctgttactttcttgtcaaagcagccctgagatgcttgagctgggcagactcatccaagtgtgtatttaggtagcattctcatagagaagattgagatttggatttggttagtttgccttgctttaaaaagctccagggattcctcttcagtatgattttcttgggaaggcttgtgttcctaagtgcagctgtggtgattctgatgcctcttgacctcctcttaggaccctactgtggacatgagtcggtaatgcccactgaggacttctgggagccatgtcagacgaatccgcctcagggagcgatccagacctggacccggacgtggagctggaggatgaggaagaggaggaggaggaggaggaggaggtggcagtggaggagcatgacagggatgacgaggaaggcctgctggatggtaagtacctctactgaaaacagagattcccgggagaacatggtatttctagctgtttttcttttttttggagggctggggttaaagggtgttgagacaagatcttgctctgtatagccgaggctggcctggaactcactgtcaaccaggtttaccatgaactgctgcaatctttatgcctcacttttctaagtactgaggttgtaggtgtatgtattatgccaaggctctagttggattttgtagatcgtctgtaatgagaagaacaagcagaggaaagggccacagaacttctgtggtcattctcagggggtagatggttgttctttcaaggaaaccttgttttagtggtaggaagatgagcatttagttcatctttgacaaaaaggtaggctcaaatccagagatggagaaatatgtggtagagtccctgtgccaagtctgcagccttggaagtatgagctctcaggtatagtagtgtcccgtgagtttcctgaaatcacaa

SEQ ID NO: 35310 - DNA, 1102 bp, Mus musculus
atggcaacaattttagactgttgtagctttctgttctttttcatttagatttttaagagtttcactgtagctcaaattagccttgaatttccagtgtagattgactggcctggaaattagtgctttccagcctcagcttctcaagtgctagactacaaagatagacctcattctctgtatatatcttaattagaaggtggtgtttgtttgtttcatataactgttggcaggctgtatatggatatactttggtacttgtcagtactgttgaacagaaacacttaccaacgtcttatctttttacttttctgtgtcttctttccccctcttttgcaatcttatatctgtttactaatagatcagtactttggagattttaaatttggaagaccagggtgcacttttgagtgatgatgaaatatttgctagtcgccaaacaggaaaacatacctgcatggctctgcgcaagtattttgaggctcatctggccattaaattggaacaagtcaagcagtcacttcagaggactgagggtggtattcttgttcacccccagcctccatacaaggtaagaggataataatttatttatgtgtttatttatgtttacttttgagtatggtgacatctttcctgtgatggaacaccatgaccaaggcagcttgggagaaaaggtttttttttggcttatgcttccatatgactgttcatcatcataggaagtcaggcatctgaggtacaagctgatgtagaggccatggagggatgttgctcactgacttaagtctattaagactgattcatgagctgagattcttttttgctacaatctgatgtattctttctgtcatttgttttagaagttttccacttgaatagatcaaaactgtggtaggtttcttacctatttcatgcctggaaacatcatgactgactagctagtactgaaggtctatatgagtcatgccaccataaaaatcactttgcctgtgctgtccattacaggtcgggccattatggactttttctatgctgcccattacaattactatgattacgttgcctttggcaattaggttttgccacctgaccctgctacttt

SEQ ID NO: 35311 - DNA, 1163 bp, Mus musculus
ttcttcttcttcttcttcttcttcttcttcttcttcttcttcttcttcttcttcttcttcttcttctttcttcttcttcttctcctccttctccttctccttctccttctccttctccttctccttctccttctccttctccttctctttctccttctccttctcctcctccttcctccttcttcctcctccttcctcctccttcctccttcttcctcctccttcctcctccttcttcttctttcttcttctgtgtgatgttagaaataaaggactggagtcagaggcaggcggatttctgagttcgagaccagcctggtctatagagtgagttccaggacagccagggctgcacagagaaaccctgtcttgaaaaaccaaaaaaaaaaaaaagaaaggactaaacattatgtagcagtgctttacatagggacttattgactcaaaagttgtagaaattgaaagctattattaaaagtttttggcaggcattgaataagtagcagatgatatgtatcataattatacataattcttcttataggcatgctcatatactcatgagcagattgtagaaatgatggaatttttgatagagtatggcccagctcagctatattgggaacctgctgaagtcttcctcaagctttcctgtgtgcagcttttactacagcttatttccatcgcctgcaattggaagacctattatgcaaggtaggactaaaggtttcatgaagttcataagatataacacataacacataatgcacgtgtaacaagctattgttggattgaagttttagatttgactctgagaaggaagtagattaagtatgagagtgatttttattttcttattatttaacttgtttttttttttaatgttgttgtgtgtatgcagttgtataagcttatgtgcctcacatgtaagttcttgaggagctgactaggtcaccaaataccctagaatttagagtcagaccgttgtgagatgccatgagggtgatgggacttgaacctgggtcctctggaagaacagccagtgctcttagcccctaatctactagatttttctataccagaaattaaaatgtataactatattggagtccaatccaggaccttgcacatgctaccactgaggtacacatctaggttgtgtt

SEQ ID NO: 35312 - DNA, 10644 bp, Mus musculus
aatgtcagttcttaggcttgatgccaagagctttttagccaataagccattttgcccaccctgtctgttttcttgtaaaataacataatttcatttttttttattgctgagtaagatttctttgtgcataaggtttgtccatttgtctgttgatggatgcttgtactgatcccataacttggctgttgttaatagtgcacactaaagataaatgtataaactgttcctgtaatatcttgacatgagtcttctagctattagttttatgaggaataatgtaatttttcctatgttataggtatcagcattattttgggcgtggctgagggtgagttctttatccatgatgctgaaattcagaagtcagcacttcaaattatcatcaattgtgtatgtggtccagataaccgaatatccagtattggcaaatttatttctggaactcctcggagaaagctgtctcagactcccaagagtagtgagcatactctggccaagatgtggaatgtggtccagtccaacaatggcatcaaggtgcttctgtccctgttgtccatcaagatgcccattacagacgcagaccagatccgggccctggcctgcaaagcccttgtaggcctgtctcgaagtagcactgttcgacagatcatcagtaaacttcccctttttagtagctgccagattcaacagctgatgaaagagcctgtgctgcaggataagcgtagtgaccatgtcaagttctgcaaatacgctgctgagctcattgagcgtgtatcaggaaagcctcttctcattggcactgatgtgtctctcgcacgactgcagaaagcagatgttgttgctcagtcgaggatctccttccctgagaaagagctgctcctgttgatacggaaccatctcatttctaaagggcttggagagacagcaactgtgctgacgagagaggctgacctgcccatgactgctgcctcacattcttctgccttcaccccagtgactgctgctgcttctcctgtctctcttccccggacccctcggattgccaacggcattgcaagtcgactgggcagccatgctactgtgggtgcttctgccccttctgctccccctgcccatcctccaccacggcccccccagggttcattgcctttgcctggcccatcatatgcaggcaattcccctttgattggtaggatcagttttatcagagagaggccatcaccgtgcaatggcaggaaaattcgagtgttgcggcagaagtcggaccatggtgcatacagccagagccctgccataaaaaaacaattggatagacatcttccttccccacctacgctggacagtatcatcacagagtatcttagagagcaacatgctcgatgcaagaaccccgttgccacctgtcctcctttttctctctttactcctcatcagtgtcctgaaccaaaacagaggcggcaagcgccaataaactttacctcaaggctaaaccgcagggcatcatttccaaaatatggaggggtagatggcggatgctttgataggcaccttatctttagcaggtaaggagaggttcccggaattccttgggatgattcttttatttaaatcagtgtttggtcagtatcatccctgagtcattagttaaagtcatttgctggcctgaagattaactgagtgtcctttatgtgctgtatgaactaatcagtcagttatgggttatttagattctcggcagtaagatctctttgctgtcgtcacaaccagtaggttgttttagccatttctcaaacttgccttttgtgccagccatgtttccttctgtgtgattctttataaatcataggtacagatcatgggtctacacactttccacaagtctttttttcattgagaatttaaactattgaatgtcactctaatgctttagaatccactttttatttgaaaggcttcacattttgaaacaaaataccatctagcaaaattttgtgtttcagagttcccggacatgctttattctgatttatgctcttcccccaacccctcgtttagatttcgtccgatttcagtattccgggaagctaatgaagatgaaagtggcttcacctgttgtgcattctcagcccgggagcggttcctgatgcttggcacttgtacagggcagctgaagctctacaatgtgtttagtggacaggaagaggccagctataactgtcacaactcagccatcacacaccttgaaccgtcaagggtgagggttccttcctggctgctctcattttaagatggattaacaaagggaactagagttaaaagagtcttaccatttattggactttattttagatgagtcgttaactagaattgatgttgactcatttcagaaggaaaatgagatacttggccatcttttgatagggggggtttagctatgtgaggtgatacatggggaacagaggaaggacttttgggagttcaaagccaatttgagttaaagttctctgccagcccgagtacacaggacctatttcaacagaagaaaaacaaaaaagcccagaccatcaaggtgggttagtgggggaggtgcttactgtgcaaatcctgactgcctcagttcattctctgcaaagaacccaggtaaaggtagagggagaaactaactctgcaaagtcgtcttctaccctaaccctaccacacttccccatacctgtataccatacatacatgcacagtcagtaaattatgaaaaaagaaccagctttaggcccctagtggtaaatacatttttctagccccctataggcacatgtaattaaaatcctaatgatttttaacttctctgccttataggatgggtccttacttctgacatctgccacttggagccagcctttgtctgcactttggggaatgaaatcagtatttgatatgaagtatgtatttatttattatagcactgtatcttatattttgtgtcttacttaaccactttatttccttccatcctattttaaattataagctgttttgaggaaaggaatattgtcaagtgttaatttttcttccttgagatccacatttaataagaatttgtcttccttcacaaataatcttgtgatgccttgatattcctattatacagtggactgttcactaaccccaaatggacagttatttattatgttcacatgatagctgtattgatttcaaaagcacatgtgctatattctctaatcaataaattctcattatttgggatctgctctggtggactgatagagggactttttaatctatgtatacaaattgttttcttcttcagaaaccaagaatctccaggtaagtgtggtttgcaagaggttgaaaattaccttaattttcaggtgattgaaaaatatgtcctgacaatctattacctcagtaattttgttgtctgtaggcattccttcacagaagatcactatgttgagttcagtaagcactctcaggatcgggtcataggcacaaaaggagacattgcccatgtaagtatttaagaatctatttctatcaagctgattttactcatttgttcacattgaaatcttctgaaggtaatgtgggaatttgtgtgatagtccatgtctataatctcagttattccatagactaagacagggaaactgtagtctcagagttggcctgagcaattaccaaatctcttcaaaatacattttaaaaggctgggagctgagttgggaatgtagctcactgaatctagtattttagacaacaacaacaaaaaacaaaaccagagactcaaagcaccaaaacccccaaaacaagccaaagcaacaacactacccctataaccgaatctacagtaggtaaagtagtgataaatcacacacagagccaggcaggatggtcgtgaacacctgcgactcctcactttggcgcaagggaatcgagagagttcgagaaccagtactgaccactagtgagactgtcacaaacaggaaactgtgaggaaatgtgaagatgtcaagtatgaccctgggggttggaaaggactattggtatggcagtctgtccatctcttttttctttctttctttttttttttttttctggagacaggattgttttatgtagattggcctggtctaagatccttttgcctcagcccaccaatttctaggattataagtgtgggccagccatacccagctgagaacagaggtttattgatttcttacctttttttagattaaataaacctcttcctttagggagccttattagtgagagatattaagtcgtaagtgttgcagagtaagacagagtagtgtttaagcagaaccccaaaggtgtggcaggcttttccctgtccaatcacaggccatctgttgccctaatagttaaactaattggacagggaagatcctgccacacaaaggagggtgtgactgtcatgcaagtagctggaagaagtgagctaagagcttgaggaggaaataagcaggatttttccctttggaaaaataacagtatgtagaaaattataaaaaagaaataacacacattcccatcacctagatttgtaattttaatattctgaagtattttctgtataaattcctttttaagaaattatttgaaatggggttgtgaacatcattatgacatttttatctgtatactatttgtcttctaacaataaagatcataattgtataatcaattccaaataattcccagatatatacctattatctagtccacacttaatgttattatttctgatgcacttggtttcaaaggctctttctttgttttgttttaaccaggacctagtcaaaattaatgtaatgtcattgggttttgtcttgctgatattttaaactaagaatcttttttctgtgtccctgactttgaattttgaagtgaccaggctggttgttttgtccatgatctgagcttgtttgtttgtttatgatgtctcctcacttatatctatggcgggccttttttaaactggaaatattacagcttgtcttagttgatgggagagatctggtctctgtatcagttgcaaattatagacttagaattttgtagtatgatagggctaaaatatactctggtattttaaaggaaaaaactgggtatttcacttttgagtaatattttatggttagtcactgatctttgatgacaacttctcaggtttaaccttggaaacattttgtttcttcaaaacaggagaagaaaaggttggtttgttatttaaattcttaacgtgttctcattttactgggggaaagggttttccaagctcagctgggcactggagcacctaacctttcttcagacagtgcgctatccagcacggtagggcttttgtaattaaggtttgagaatgtggagaggtctctcacagtctctctttaaacctgccactgtaaattggtctgatttttctcttcctgccccttcttctctaaagatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaacatgaatatcagtggtgttttccatccaaatgggctggaagtcatcatcaatacagagattgtatccttaacactcaagcctgactttccaagtgttacttgatttgttagcaaaaatatttcaatattgcttctcttttgttctgtagaaatcagttgctagacatgaggagaattgactgtaccattgggaattggaagagagctcatgtagtatttatgtgtgtgggattatttgcaggtacagcaatcagtaatacatgttggcatttaaactatcagtatctactaggaaggaaaagaagtgataattgagagtttacatgaggctagagaagaactttgtgggttgaggggatgcagtgcagagtgcttgccaagtatggtcactcttacccttataaaacaagatctctcaacttttgtataaagtagtttcccttaatgacacccctcctagtgggaccttcggactttccatcttttacacactgttcctgctctggatcaatgccgtgttgtttttaaccacactgggacagtgatgtatggaggtaataagcattgcccttcattctctttaccctgtcctacactgacacttacttggtattacacttttagaagttttcacttgtgaaaacaattgaaaaaagaacaaatagtgacaaaagagaagatgaacattttgttgatttaggctaaaaggctactaatttttttgtttgtttgtttgagacagggtctcaggtagcttagatcttgaattttgaattattttatttatttttaagtttagtatatctttgagttttcctgaatgcatgtttgtacatcatgttcatgcagtgcccatggaggctctgttgcctatcctctaggactggagttagttacccacagttgtgagctgccatgtgagtgctaggaatcgaatccaggtcctctgaaagagcagctggtgctcttaactgatgagccatctctctagctcctaaggctactaatttttaacacaacaaatttgtacagaaagaaattttatgcaataatttccacattgttatcttaaaaaccattgtatttgtttccttgggatattataaaacttcagccataatacttattgagagattgaagatactgtttgctgcagtgagttgggtatgtaattgaggatacctagagaagaactaataaatgtagaataaatttggaaggatacccattgaagtattgattgacctttgtagttccctcatttgtggatcagcagtatttctgattcttagtaaagtttcacgcttctgtctcccctgtgattagcaatgttgcaggcagatgatgaagatgacttactggaagagaggatgaaaagcccttttgggtcatcctttcgaacattcaacgcaactgattataaacctataggtaagtctgaatattgtttcttcatgtttttatatccttccttaaaatcctccatttttctagtaggacttcttattgacaagtactgaagttatagaaatatctatgattattgacccttaaatatatattttaagttatgtatatgtctgtatataggtatgctcatgtgaatgcaggtgcccacagaagccataggcatcagatctcctggaattggttataggtggttgtaaactacctagtatgggtgctgagaactgaacttgggtcctctgcaaggatgccctcttaactgctgagcagtctttctagtccttaatatgggcctataattaaatcctgtaaacaaatagcaggtttttaggtcacaggactaatttaattttcagtcatgttctatttttcagcaactattgatgtgaaacgaaacatctttgacctgtgcacagacaccaaagactgttatcttgctgtcattgaggtaagggaggcttgcagagactctcttcgtttgttctggtatttaaggtgacttttggcattttatctgataccaatgcattttaaagtaagtaatattcttgatgatagattattgataacttactcaattgataggggttgggatatgtgtagtccaagagaaacaatgagaaaaatccatttataaattcccagctcttggactcaagttgcttttccttcctctgaggagtctttgtctcatcagagtaaggtaaacttgttccagtggggtagtggcttctactttgcttataggtaccagtgcctaaactttactcttcttttttcccccactctgttctaggcataacattttgagtcagccaagtaattttggtattggaagctttgttggttatagctatggtcaagaaaaaggtcaatagttagctatagtgtggatgtggcctctgaccacggcttatttaagaatggttgttccattccagaatcaaggcagcatggatgcactgaatatggacacagtgtgcaggctctatgaagtgggcaggcagcgtctggcagaggatgaggatgaagaggaggaccaggtcagtgatctttgaattttctgttaaagctttgagaagcctgtgctctgctttttgttggaggggatttttaagataattcttctacatgttgccatatttggaagacctgttaatatgtctgaaacttaaagcgaaattttgttaatacagaacctttttttaaaaaaaatggatgtattatgacacttgtttttatttaaaaaattttaaaataaaaaggagatagggaagctactctgtcatcagtgcaaggttttaaacaagcaaaatgtgacagtgcacacccagtgtcttagtactcagggtgcccaggtggaagccttgtaagtcagcacagtgagtatttcaaggccagcctgagcctggtcagaccatatatcaaaagcacaaatctcacaccagaatggtaacaatagcaacaaaaaaatctaccgcccaatgacccatgttccatttacaaggtgcaatctaacaatctctgattttagttccatgcttgttatagtgtccatttggggcttcaagataagcagctcccgtagggtcagcacgatggctcgttggttaaaattgcttgctgtcaagtctgatgatctgaaatcagttccctggactcacatggaaaaaggagaaaaccagtttttctaagttgtctaagtcctctaacctccacatgtgtactgtcgcatgcactcccatgtgaacaatggtaacagaaaagatgagcagctctcatattccagtgtcattgtcatccagtcagtcacagctgctggagagtgtatgaacaggtaaagatcattgtgatggttttgagaaatttaagcataatatgacctgtttgtgatatacttatgtcccacagtgttagccttgcccttctcacaaggcaggtttatagtgtagatgcctgttgtattgggtcagttctgaagagcatccccaacttgagagcagcagcagcttttcctgatgctaactcatggcgttcttagcgcatactctctagtccacttcctctgtcctagtgctcagagcgtttgctgcagagctgatacagagtggaaatccaaggaccataatgagggcagtcaaataaccttttacagatcttaatttcttcacctggagtcatgattgtttgtaagggactttaaggtccttgggtgagatgtggcagaggatgagaagaactgtgccctctctagttgtattactgtggctcctgccctcatcactctcctgttgtgatagtcaggctctgtgctcagggctgatgaagtatctttctttactgcccatcccaaatagcatgtactttacatttacaagaatatttttaagtataatcttttttctctccctcccttttgtgcatgttctttctcttgtgaaactagagattgatgaacatatatatgttaaacacatcccagtctctcatccttttttaaactttgatataggggctaatcaagttgcccttggtttgttcaaacaacaacccttgtccccaaacaacaaaaccaaatcccaaagcagatttacaaaacaaacaatagtaccaaaaccacaaacaaacaaatccaaaagccagtagtttcttgagtgcagtgggcttaaggactcatttttttctaacagaccttagtactgcctaaacaaagatgttttcttgtgcagctttgaaattcaggtttgtgtttccctgctaggctttacagttagaagtgcattgtgcattgtctgctctctgaatgctaggcaagtactttaccattgagctggctgggatatatgtaactaactataaatctgaagcaaactcaggtgtattttaagttacttgtctaacatcgttatccctgccctgcgtatttttgaagtttataagggtccgggcagcagtgtgctttggagatcattccctgtgccagtgtggctgggtgtctgtctattcttcaaggtggaacttgaaaggaaactagaattgcccaagacactgggttattgtgttggcttcattctcgagtgtgtgggttagtgacaggcagaggcactgagggtagtgtgctggctttggaatcagactgtcagcttaatctaagtattgcactccttgcccaactgtttccagggagctcgtgttaggaaaaagaccactctcttctgcggttctgcttacctttactgtctaataataatatgagaaaggtgctgggatgaggacaggtcattggtaagggtttctgactttttggttctgaaggaaaaatagaagttacctcagcatggatgcgtgtccaaataggcagtctcggtgggccctggcaaggagctccggtgccccatgtgtagaagaatgtgaaagttttgtagctcggaggggctttgttgtgtgcatagtgtgtggcatgggttagtactgctttcaggctcctcagggtctaggctaagttcactgtgt

SEQ ID NO: 35313 - DNA, 1370 bp, Mus musculus
actgagtgaattcagaacacctgccctttgctgcctcccagggctgtcagttaaggaactgtatgccctgcattcagaggactatgatttaaagtctccctggaatctgagggcccttctaagaacaacaacaacagtgaccacacgaccacacacacacacacacacacacacacacacacacacacacacacacacacacacacacacacacacacacacacacacacagagctacagggactaggccctagtttgtgtccccctcctcctaggaagggcatagctttcctcaagggaaaaacaaacatgtctctgggtatttcacaatatattttctttgtataatgttctttacttaaaagaacaagaaatagttttttataaaacttaaaaagaaaaaaaaaagtaccaggcatttctaacgagggtctgaacttatccaccagtctcctatccccgcacttcattttctttggaagaaaatgatgtctaaagaacatatagaggcatttttacatacgtatttaaatgaagaggaaaatcgtggtttcataaattgataaggattaagaatattttattataaatataatatatgatttttaacctgttttgttgcctcatatgctgtcaagttaatttgttttcctttgtgccagagcgggaatgggcggcatggcctgagcactgggaatgcctaactccctgcctcggtggccaggcagcagtcagtcgtgtggaccctggttttgtggagttgagagaactttaggggtataaattcactccctctctttcctctttgtgattcagtttttcaagcctttttttttttccctttccctttctccccaatgtggaaattacaaatcaaaggtctttttctttaatgtaaagtgtatttatttaaaaaaaattacaaaataaactacaagtctgtctttgtttatggcctttccttgttttcttttaccaaagtgggatttccccttcctcctctcagttctggccagacctcagaggacttgtaaggaaggcagagccctccctccacagtgagagaacaccgcctcccacagcaaacccctgggacagacggtggctctggcacttgagcctggcctgaagttgctgaaggctttgtgaggataacaaacaagggggcagaagggaccggggtagggggtacatctctacccccatgtgtgggacttttaaggagcattctggctaccccttgtctgagattaggggggacttggacagtttttcagtcctaacagttcaggggtactttgaggcttggtcaggctggatttggagaaaaactggcaaggtctaaaactgacaaagcatcaggggctcat

SEQ ID NO: 35314 - DNA, 3069 bp, Mus musculus
ttataagaagaaacttatgtttcccgtgtatgagattctgtctgctgtattctgtatttttttatattttattttatttttttgactaactgtatggaaaattgtcagtaaagcctttgtcagaggatgaatttttaatcccgccagagtcctggtttaatcaggttttttcgtaaagaatggaaggcttcactcagagcatgccgtatgtcatgtttttgtcaccactgcttctaaaagttgtgctgtgctggtcctgcgcagctctttgtgctatcggggcccagctcacacttgtcaaacttagctgctggccagcaggcttacaaggcatggtccctgtttatactagccgaaagctgagcccgttcagaggaaaggcctgggcctaagacctgtgccaacagctacaggtagttttgttgtttttccctgccctaagtgtgtgctttagtttgggcgatggctgttggacagagcacccaattataaaagcctgtttaatggagggtagttttcagttgtgtagtcttgcatttggggggaggaacagtgcaatattgatgcaaacggccgtgggcatgacgtgcccaggctccccctggttccgtcttttagtcttactgtgtagtttagggtctcccctatcagtcatctgcctgactgccaggggtcttggaggtaagatgttggcaggcagggtaagcggcagccagacttgttaactcttcaatgtgcttccttcgctctcagggctatgtcagagcagcctgtgctgcagtcaaacttcaagctttgtggcaaacagaccccccaactacactgctcagtctgcaagggtgtcagtgccaggaagatgcccttgatgagtgacatagtgttccgtgttgtgacccagacctgaggtaagaaaatagagaaaagtcacagttgtgatggactagagcccaaatccacatcagctttggtatgaaggaaccagactgataagtcctatgtctgggatgggaaagtgactaggccctgcctttgtggtctctcaagtagaaagccagatcaggcaacaacggttgtcaccacagatcacagtcaggctcacaatgtgacggcttggtagtccaaaccagtcaggctgaggagaatggaaccctggttagaggttctagccaggccagtgcttcaggtctggcctaccctgagccagcacctgtgacccctgggctctgagatggaccttgaaggctgtatggagttcatgcctgtctacagagacagaaatttaagagactggagaagaacagggaattaccactcactgggctttggctggtattcatgagaaagtaaaggctctaaagcagtggctctccacctgtgggtcacaacccattcggcaaacttctatcctccaaaatatctgcattacaatttgtaacagtagcaaagttacagttatgaagtagcaacaaaataacatggttggagtaaccacaacatgaggaagtgtattaaagggttgcagcactaggaaggctgagaaccacttctctaaagcattaacatgcgtgttcatctccctatgtatggggccactttctctggagctcggagcaagccagtcaacctgctagactagactacttcagttctttgtcataccagcagaaaccagagctcatcctgacagactgctgcagtttttcttacagatcctgaacaatgaaaagcatcacagaagagttgttgtagcacagctgggtccctgtaacaaagcaggtttcacccgggtacccttcccaggcagaaccaggtcactttattacccctttggaaaagggcaccctttggctctggcgatcatctgtttcttagtgaagaaccacacccactgtaaccttcttccttgggccatcttacccacttccttttagtccttaagatgttaacaggttctgtggcctctcagtcagccctgctagcactagaggtgggtcaggcggccaaggccttgtttgatcatgacattgtagccagtgagaaagctgacagcaggtacccagtgcctgagatgttgcatcaaggcaaaaaacatgagcagagaaagcccctaattggaaggtttcatagcttgtcttaagtgactcgggttgtgaaccctaggaagaacatggaaggtggatgttttctcctagcctcatgaggcacattcctaagggagtgttgtcaagtcaaccaaaattgtgctttcctattatatgtgctcatctctaccttgggaggactgcgtgctcccaggagctcctggcagagctgcaacacagagactttgctgttttctcttcagctgcatccaggagcagccatcagccttctactggctggtgtcagctaaccatttaatgccatggcatgaagcaaatgagcggctgagccttggcttgcttaaagtaccaggatgtacttctttggtactgggtcccttcagtgtaacaggctgtgttcttggtgtaggaggctctccctacccctggagagttttcactgtctgtgttacttgtttactttataaccagtacacccttctctcagcaaagggagtagggtttctgtagctgtgatgcctatgtaacagaaacagaagctacaatctgggcaaaatcagagagaaaattaactttgtatttatttgggaaggagagaggcaggctgagcaaagcatgagcccctgatgctttgtcagttttagaccttgccagtttttctccaaatccagcctgaccaagcctcaaagtacccctgaactgttaggactgaaaaactgtccaagtcccccctaatctcagacaaggggtagccagaatgctccttaaaagtcccacacatgggggtagagatgtaccccctaccccggtcccttctgcccccttgtttgttatcctcacaaagccttcagcaacttcaggccaggctcaagtgccagagccaccgtctgtcccaggggtttgctgtgggaggcggtgttctctcactgtggagggagggctctgccttccttacaagtcctctgag

SEQ ID NO: 35315 - DNA, 1743 bp, Mus musculus
gcccgccgaccccctgggctatctgcccctgcacggtggctaccagtacaagcagcgctcgctgtctccggtagccgccccgcccctgcgggagccccgcgcgcggcacgccgccgcagccttcgccctggatgctgctgccgcggcggccgtgggactgtctcgagagcgagccctggactattacgggctgtacgacgaccgcggccgcccgtacggctaccaggccgtgtgcgaggaggacctgatgccggaggatgatcagagagccactcgaaacctcttcatcggcaacctggaccacagtgtttctgaggtggagcttcgacgggccttcgagaagtacggcatcatcgaggaggtggtcatcaagaggcctgcccgcggccagggtggtgcctatgccttcctcaagtttcagaatctggacatggcacacagggcgaaggtggctatgtctggccgggtgattggcagaaaccccataaagataggctacggcaaggctaaccccaccacccgcctctgggtgggtggtctcggacctaacacctcgctggcggccctggccagggaattcgatcgcttcgggagcattcggaccatcgatcacgtcaaaggagacagctttgcctacatccagtacgagagcctggacgcagcccaggctgcctgtgctaaaatgaggggcttccccttgggtggtccagatcgcaggctccgggtggattttgccaaagccgaggagactcgctatccccagcagtaccagccctcacctctccctgtgcactatgagctgctcactgacggatatacccggcatcggaacttggatgctgaccttagggtgcgggataggacccctccacaccttctgtattcagaccgagaccggacctttttggaaggggactggaccagcctcagtaaaagttcagaccgcagaaacagcctggagggctatagccgctcagttcgcagccggagtggtgagcgctgggggggtgatggggaccggagcatagccaagccctgggaagagagacgcaagcggaggagcctctccagtgaccgtgggaggacaactcactccccttacgaggaacgcagcaggaccaagggtggggggcagcagtctgagcgaggctcagatcgcacccctgagcgtagccgcaaggagaaccactccagtgaagggaccaaggagtcaggcagcaactccctcagcaacagcagacatggtgctgaggagaggagccaccatcaccaccaccatgaggctccagactcttcccatgggaaaaagactagagagagtgaacgcaatcatcggaccactgaggcagagcccaagactcttgaagagccaaaacacgagaccaaaaagctaaagactctgtcagaatatgcccagacactgcagctgggttggaatgggcttctggtgttgaaaaacagctgctttccgacatctatgcacatccttgagggggaccagggagttatcagtggcctcctcaaagaccatccttctggcagcaagctgacccagctaaagattgcccagcgccttcgactggatcagcccaagctggacgaggtcacccggcgaatcaagcaggggagccctaatggctatgctgtgctcctggccatccagtcaacccccagcgggcctggcgccgagggcatgcccgtggtggagccaggcctacagaggcggcttctcaggaacctagt

SEQ ID NO: 35316 - DNA, 1218 bp, Mus musculus
tgctcagcctggagctgtcctttgtgctggcatgtaggaagccctcggggaactggagctatgttccttctctaaaccacataggctgtctgcactgtgtgtcttatggtggctactgacagcctgaggtggccttcctggtgaagactgtcatctcaatcttgggcgcagtgtgcatttgtcttcccggccgcacgtagggctggacatcctaaggatggtttgacgtgcagcacagttgggcctgcagcctctcctgcccagccatttactctcctgctctccctgcagacaagcagattgacctgagcacagtggacctgaagaagctccgggtgaaagagctgaagaagatcctggacgactggggggagatgtgcaaaggctgtgcagaaaagtctgactatatccggaagataaatgaactgatgcctaaatacgcccccaaggcagccagcgcacggactgatctgtagtctgcccaattcctgctgcacctgaaggggaaaaagcagtttatctgtctcttccccaaataaccattttgtaatttattttttaagcgggctcctgacaatgagatgtgaacctagagctttcctagtgatgctggctctgcagttccctcttgcccatccccgagtggggacaatttccccatccccaagtggggacaatttacttccttctttgctggtttactctaggacttcaaagtttgtctgggatttttttattaaaaaaaattgtctttggagagttgagctggcacagtattctgtcctatagattactggtttatctttccagtctgaaaagatccctcagcctgccagtgctgagggcctgaaactcccataacaggacttaagagcttgggcagccaatgtcttgtgggtttgggcttctgggtgtctgatacttcagcctggtgaggttagacttgacccctgacccccacccccatccagtccagtagcaggggctgaaggttcttgagctgctgttaagtctaaaggacatttacatttggctcagcctatgcagaaggagaactgtgagctgagtacaggtggtcagaccatagcgtatctttaccccgcctggtacttaaactattcattcatcggggttccagtctagcatcagaacaaggacccttgcttacctatatttttggcaaagttggcaggaatcggtttacaaagaagcagtgtg

SEQ ID NO: 35317 - DNA, 1213 bp, Mus musculus
ggtgtgattggaaccagaagtagttggctaggtgccccgagatggccagggccaagtcaaggtcaaggaccctggcggagcatcagcctcttgtagctttaatttccatggtagtctctcatcggaactctaactctgcagctgagcatatatcaagtgcctcgggcctgggacagctagatctgggcagactaacaaaccgaagccttggcaaagagaggttttcaaggtgacctaacagttgtctggaactggagagttggttatgaatgtgtgctgctcttgtggaggacctgagttcaattccagcatccacagcaccctgcactgcagctccagggaacctgatgccttctggcctctgacacatgctctcatgcatgcagatttttttcaaggctttcattttgttttgttttggtttttgctgcagtgctactacattggagccacagatgatgctgccaccaagatcatcaatgaggtgtcgaagcccctggcccaccatatccctgtggaaaagatctgtgagaagctgaagaagaaagacagccagatctgtgaactaaaatacggtgagtgtgactcggaccctgtgccttctaccatctctgcataccctttctggacttaactttctagccagaagagtcatcaaaagcgggtttgtagcataaaggatgattctctgtgctgcagggaacagacttgcgcatcgaacataggtggaggtcaaagggtgacttaacatactttgaaggatgagggttgacccagaggccatctgatagagcagtgcagatagagattatagatagtggtggagtacgtagaggtcaagttggacagagccttggggggaaatttggcttttagtctaaaaacttgggagctttagaagtttttgagcagagaagtgatgtggtgggaacttgagttcaacagtcatggctctaaaccccaggcgtgacagttacagcatcaccatggcagagcccatctggttgcacagaatcctagtctcgagaagagctaggcctctcctataaagtttaaacgatgccagtgtttactgcactaatgttcgggaattttgtacttgtgtgaatttgatttggtatcctggttggttctggtgtcggtttgtttgggtcacgtgggttatggagtaagtgtctgactctggtgcctcttggggaggctaggggtgtgt

SEQ ID NO: 35318 - DNA, 1128 bp, Mus musculus
tgttaagtagggcacagtggtgactttatagggaattctttcatgtcagggcactgacgttactcttggtattatggtgggggtatggtaatatttcaccagggtgcttctaagttactttttaaaataacttgtcttgaggcaattgttttccttttatttgcttacattcccatcagtgatggccataaaactgccttctccttgatgagcaggtatgttgctcccctgttcccttaactagttggccttctggcctgctatggccaagttctggccccagctgcttatcccttctccacaattctttccaaacagaaaaacccatggtcacagtgtttttctcttagaaacaagtttaatagaactgtcagcaaataacctataggaaaagaaagaaggcccatttccgttcacagtatgttggggcccaggtaccaacagtgtagggctttctgataccctcaggatcattcaggcagagtggagactgttgaggatgtaggtaggccaatccaatagccccagcaccaagggcacacacacctgttcctgagcccagactcactggtaagcttgtttctggaccgtctgggttcacaggtatgagggtcaagtctagcttgggatgtgattcttaggtagggcagctttaggtttgtttccaggcacgtctgaacctcagtccacggaggcagccagtcatcacatgcagacatctcctttctccacttgatggcacaggaggtagggaggggaatgtagggttaagttccttgaccttgctttatgcaaagtgaaatatatttgtgttacttctctccattttccccaactggatgaaatggacctattctgaatactttttattgaaaaaccagccagtgtgagggaaatgggaggtcagagatcagaatcctttgaaaagattgtgaaatactgattttcattgtttaaagcgtatttgtaaatacctatttgaatgctgtgtatttgtacaggaatttgagcaaaaaaatgtatagagtatgtctaattggtaataagccctataaatgtgtttttaacctctggcattctgtgcttatttaaaacaagaaaacttctaaccatttcttttgtgtattc

SEQ ID NO: 35319 - DNA, 1174 bp, Mus musculus
ttggtcttcctgtggggtctcccttctcctcagcttcttccaccctttccctaattcaaccacaggagtcccaaacttcagtccattgtttgggtgtaagtatctgcttctgtctcagtcagctgcttgttgggcttctcagaggacagccatgctaggttcctattagcatactatagcatcagtaatatgtcaggcctgggagcctccctttgagatggatcccaatttgggctggtcactggaccacctttccctcagtcgcctctccaattttgttcttgcagttctggggtccccggttcacttagccacagggctccagctattcagtgcttcaggtaggtacatgggagttttgactgcacttacccaacacaggtgcccagtgagtgtcggctatgggaaggtatgaaacaccgctcggggtgggggagtgtagtctgaggtcctggggactgccagagctggcttgggggtctctgggcctgcgatgaggcccggggtggggtgcatctggttctcaggctctcgggcacccagttactgctgggaactgcaaaagagctgagaactgagtgggtacctgagggctggactgggtccctcatgactgggtgtacagagaggccttctactgggagattagactgcggctctataggcgaggtatggctccccacagaggatccagatgaaaagaggcagtccatggttttaaggcatttattgtcatgttggaaagtgtataagtaaaaccataccccacttctcagggcgggcttgaggttaaataccttttgcagggaggagtgtctgggtaggagagtttattggctaggtctatcaggcctttaggtgcctcattaagatggagatctggcttgagcctacaagtcatatcttctacctgtggaggggcttgggacattgcccttacatgagtgatggccataaatctatggagggctgcagcctcctgtcaggagcctagtgtcctgaaccaggcaaaacacctgccatctctttagggtcacctgggtttctaaccttagctcaaccaggaaccaggctgcctttcatggttctacacagttcttttagatagcaaccattctgggtcagagtttttgactgtgggatggcaatcccgtccctgaacttgatgccctgt

SEQ ID NO: 35320 - DNA, 1928 bp, Mus musculus
gtgatggcttttaaggtccatccatgctgaccttttctctctgttatgctaatggtatgcaggaagagatgaccagtgccctggccactatgcgggtagactatgaccaggtgaagatcaaggacctgaagacctctaacaaccggctcctcaacaagaggaggaaaaagcaggcaggcagctcctcagcctcacaaggatgcaacaaccagtaactcatggtgccttggagaagccaggctgacagactgtaatgtcctgaggctctggccaggaggggctggagtcgttcttataacaaaaggacaattttgttgtcttatgtgtcacattgaacttggggataaagagcttggcccaagaatcccagcctaagtctcaggctctagcaagctgcaggtgacagggatgggagccctctgcgacagctggagcaactttgcacaccagcttgactgaggccacagctctgttctgcctcaggaagcagccttacttctaggccactgggtgttgtggcggatatacccgtttttctataaaggatgtgtcctgctgtgtgggcagatgggtctggccttgaggaaggtattgggccattggttgctatggtgaccagaggccatgttgctgtctgagaatactgaacacaggaggaaggagggacaatcaagggtctaccttcttggggaggtctgtctctctcacactggatgtccctccccaggctctctcctctggtctgctagaggctgcagagtcctgattgcttgctttcctgggtggtccagccctgccttactgtagcaagagcccatgtaacactcagagagccactagagtccctgggccaagcatcctctccattaccccctgatccaaaaggtaacttctcatctcaactgaaggtgtggatatgtatgttgggggtgggtatccttaacctttttccagtttggaaacctcactgtgacaaaagcccccacctcttcctgctcaccagatctcaggtaggaaagccagtctctgctgacagcacgggatctcaggtaggaaagtccgtctctgctgacagcacgggcaaccttgggacttacttttgtgaaaggtcgcacttggctccctgtttgttatctaggaccttttctggtactctggatcagacctggctggtgaagggctgctgagccgtgcttacaaggtctggtcctggctttagcagaattggagcagagagggttttccttggctgatcccagacttagccagctctgccctgtcctgcccagggcagcatccaggtgctgagtggttgattggtgacctgacaagtgcctggcacccagcctacttcctagatcctagatcctggcccttctcactggctgggaaaccttagatcttatcaattacaatgctgctgggttttatattctgatatcaataaacacatttttaacatttttcaatgattcctgggtttctttatgtctacctagttggtcaaagtgctcaaaggacaactctacacccctactggtgactttagcctgcctggagagggtgcctctgacttggtaaacatgctaggcagactccaacacctctgtctcattcattgtagaaaggtcagaaggaccgagagatggcagctgccgcatgcctccagctctgtgccgcccctgtgcactgtgtgtgtgacacccacccccggctctgtgtgtgccagcgtctgcccacagtggccacccccagctgcgtgccagcctgctgaagggcgggcagagcgcctgctgcagcgccgagctattttcagaagctgccaggtttcatttggcagtgagaatatcggcgaggggaggggtagtatgctggaagactatcttttcattactccagcaagagagcaccctcaccccttgggagcc

SEQ ID NO: 35321 - DNA, 1099 bp, Mus musculus
tgtccccatctgccaaccccatctgtgctttgcagcgaggaagatttcttctgtgtagctcctggggtctgagttgggggcacatgcttccctgaacagcctcaagtgggcctggcctgctgactttgtgggcttgcttctgggcttggtgatattggctcatgagcatctgctttctactccagcatctttctggcctttcatggtattcaccccaactcagggacagaagtttctgcccaggggctttctatggcacctgatcattcatggtcttgtctgagcacctgcctcacttttctctctgtgaaggtatctgttccacgttgttagtgatccagagctttccataaaacagagctggcttatcatatatagggatggaggcatggaatctggaggaggggactctgtccactcctggtaccttcctctatactaatgctttctttctcttctggatacagcctgaaaacctactctatacatccaaggagaaggatgctgtacttaaactcaccgattttggctttgccaaggaaaccacccaaaatgccctccagacaccctgctacactccctattatgtgggtgagtcttttgcatgtggcttgcatccccattgctgtagaatgctataggatggttagccagagggttgtggaaaccaaagagttaaagcctggtgaagagggaggagggagcagagggaggagggagcactcttgtctgcatggaggcgggtgatggggggggggctggaggctgcaaaaatattcttccaaacttcagcttctgcttttgaaaatagatccaggaaaattctggctgtggcctgtgagctgaatgacgtcacagcagctctaaatatatatgtgataaaaggctgccatcagctcgggacggagcccagccgcagttgtttttctccggttttcatcttcatattcagaaagtgggcaggccttttctcctacattagagggatgcagggtactagtaactgccttgtgggaaagggtcccttgagccaggaattagatggggctagggggcatccacatacttaatgattcctgggaaagctcctggcaggctc

SEQ ID NO: 35322 - DNA, 1155 bp, Mus musculus
tccttcgctgcctctcgccacctctgagcgacccacacacacacatcatacccccgccttggcctcctagcctttcgctcaccctcccattccacattccccaatctagagccttggccactctctcctgaaggacctgggtcccttcccccggagcctgtgccttggggcaggggaaccccaaagtaaggtgccatggtgtttggcactcaagatttagctcacccttgaactgtccaagtgcccgcagtccctagactcatccccgtgggctaggacaggaggccactagtactgatgccaaaccaggcctccaccgacccacctgcctggagatttcctctatgtaggcaaccctgccactgctgggcacctctaactggccctttggccccacccaagcccaaacttaccttctctgggggaaaaaaaaggaaagatggtaatagtgagagattcggggggcaccccctccccattggtttctggccctttcaggctacaaccccccagccttgcaggtgtcagaacagtctcacaatgacatcagtttagacacatgccatatacacttggatctctgagagcagaaacccaactctcactagacatacctgtgatggaacacacaaacagacacgcaccatggggggtggcccacaaagccttacacaaggcgagatgtcaatgaaggggttggcctgtgtgttccatctctgctcacctctgcctctactctgagatgcagcctggctgatcctcccatctctaaaactgaatgtcaaaccgtgccaaatgctggggggggggggagacctctctgtttcacccctagccaccagtgtccccaagtgcccctcaccctgccaggtgctcattgtaaccatcgttcaccagtgtccggcccctagtaggaccacacatcactgcctgaactcctttggcagaagaaccccaccagacattgagacattgtattttgccttagcagggatgagttggtctctcctggctgggccatcccatccccaatctggttcttgcacactcaggcctaattccctctgcacacacacacacacacacacacacacacacacacacacacacacacagtccctgcccctaggaggccaaattacccctcccttgctg

SEQ ID NO: 35323 - DNA, 1142 bp, Mus musculus
ggctcttagacgcggcacggggatgggaaacgtgggatttggaggcaaacctctttggtaggaggatttggccttattgaagaaggttgcagagtatgttggtctcccaaacccagtgtaacctgccttttctcttctggctccaggcaactagccctaaaggctctcaatgagcggctgaagagagtggaggatcagtcagcctggcccagcatggatgatgacgaagaggaagctggggcaaaaacggacagtcctctgcccttagaagaagcttccacgcccccagggaaggtgaccgtcccggaatccagtctcatcaccttggagacagctcccctactctagaccactttgagtgcagttcttctactcccatgccttcccgatccgtctcggctactgcagagcactgactgctctgaggagagggaagagggtctgctgggggttcctgtggccttccgctgtgtctggacaacactaacacaggacccttgttgctacctggttctgactccagacaaccacaatgccaggtacggggtctctgagcagcagccagtgcagatccccatttgcagtaagattgtacctcagcggtacaattcctcaccaaggaagtggctgcagggacactggtgccacggctcctgggccagcccttatgtctgaaactggttgccaacagccccgagccaaggcaaggatttgtgtttgccaaaaatgttctggggacccagccagtgtgggtctgaacatccccgcccacccccagactgcattctcatcagggtttcttgtgcccttctgctgtggcagtgacaactgtgcctagccggggctgccacagctcccaggtattttctacaggaccatctgagcgggcagccaaacctgcttcacagtatcaataaagcggttctttgaggtctggctcctgggctccgtcagaccaccttgtgcagccctctcatctttatcagatgcaaagttaaatgtgttttctgggttctagggctcagttccatgacacctccacctggctaagaatcccactgcccatacctcttgtctattaatacacacctgctgctgggcagtcttgcctgagccatcaccttagtccctttctccttttc

SEQ ID NO: 35324 - DNA, 1147 bp, Mus musculus
cacactggccctagtgctggaggtagcatgggccggggagcttaagcccacagcgccgcccatcttcactggccgaccctttgtggtagcatggaacgtgcccacacaagaatgtgccccacgccacaaagtgccactggaccttagggccttcgatgtgaaggctacaccgaatgagggttttttcaaccagaatatcaccaccttctactacgaccgtctaggcctgtatccacgttttgatgcagccgggacatctgtgcatggcggtgtgcctcagaacggcagcctctgtgcacacctgcccatgctgaaggaatctgtggaacgctacatccagacccaggagcctggggggctggcagtcattgactgggaggaatggcggcctgtatgggttcgaaactggcaggagaaagatgtttaccgacagtcttcacgccagctggtggccagtcggcaccctgactggccatcagacagagtaatgaagcaggcccagtacgagtttgagttcgccgctcggcagttcatgttgaacactctccgttacgtcaaggcagtcagaccccagcacctgtggggcttctacctctttcctgactgctacaatcacgattatgtacagaactgggagagctacacgggccgctgtcccgatgtggaggtggcacggaacgaccagctggcctggctctgggctgagagcacggctctctttccctctgtgtacctggacgagacactggcgtcctccgtacacagccgcaactttgtcagtttccgtgttcgggaggcccttcgagtggctcacacccaccatgccaaccacgccctccccgtgtacgtcttcacgcgtcccacatacacccgaggactcacgggactgagccaggtacgtgttctcccttcctccgggagccactgcatgcttgtgttatcggggaccagaagtactgttccatatctgttttagtcttgtggaagggtgatgtcacccccattctgtagataagaccgaggcccagagatgctgagaggtagccaggagcctgtagcaagtccatgaaaagtgcacagaactaaaccaggcatcctgactttggggtcagaatgtgtaacctttgactttgtgggttcatgcgtg

SEQ ID NO: 35325 - DNA, 1494 bp, Mus musculus
gcaggacgtggatcatcccggaattcggctttaacatgtcagtatcaccctcacttctcacatgctgcccgtttatccaccctgcgcctgtggtccccaaagttacagtgtcgctcaagtcttcccagtgtttccctttcccttagagcttagtgcttgttaagccacacccaccataatcgagctttcaaaacccccactcccaaaagatccatggcccatggcccacaaggggtaagtgcagactctccctgaagacccgaagcttcgctccacttacagtggtggggtccgcaatgaaggggttaaacctgtctggggggggaaccctggcgctctgagctaggggcggaccctaaggttcctccttcctggccttacttagaaggtgtgggagctggggagggagtactgtgtctgcggagccacctgagccaggtaagaggcttaaagcctggtgtttgagatttggggggaaggggggagagggctgtcctcaggctcagggaaatttgggaaagggagtcaggaggcccgtcctacagtaaatgagtaaaggagtgggacccactgtccatccactgcaagaaatcccccaacatagaccctcctgccagcagatcctagaataaggcaggtaaacaatggagtttctagctggagcattatggtctacacctttcatcccagcactagaggcaaagacaggcagatctttgttgcctacaagtgagttccaggtcagccaggtcagttacacatagaaaccctgtctcaaaaaaacaaacaaacaaaaaaaccaaaaaaaaaaaaaaaaaaaaaacagtgcagtggagtttcagcagggaggcccaggtccccaaagtagtggccgttggacacctgtagatttaggaaggaagccatggtccttatcagggtgactatgaaactcagaccagaggcaagcagacttgcaaaagccacattctatgtaatgggccaagctccacggcagtaccatcagagccccatgtgtagggacagaaggacccaaggccaaagtgtcctgaattggacggattggaacggagggccacaggttccgtgtcccgaggagggaaagcagtaaggggttgggggggttgagcctgtttggggtgggtgtgagtgtcccaggagccacttttgtggctcagataactgaaaaagctcagggttggaggagagctgacctgtctgtatagggggaggaggggtgtgggaggtgggggtgactcctgggagaggtcttctgaaaaactcaggtgggggcaagctaaaagtatgatggctggtttgcactgtctgccaaggccagcaagctacagtcatgggctactaggaggctgaggcacttaagtcactattttgaggcaaacacaggctatacataccctggagaagtgggggggacggggagagggaacccaagcaaaacaaaaaatggtgagcaagtgggctagggtggcaagc

SEQ ID NO: 35326 - DNA, 1494 bp, Mus musculus; identical to SEQ ID NO: 35325

SEQ ID NO: 35327 - DNA, 1548 bp, Mus musculus
tatacacacacctgtcccaggcatggcagccaatcccagtcatgggccctctcctctacagggtggtgaatgtgaggaggagacagtccgcttcggactggaagtgctctacatagacagctgggctcgccaccgcatctacacagccttcaaagatgtgttgggctctggcatacactatcacctccaggtgaggggacacggggagggccacctagcctgactgcttcagactggccgtagctaattgccttgttttcagaacaatgagcttctccgtgacatctttggcctgggccccgtgctagtgttggatgctgctgccctgaaggcctgcaagatttcacgctttgaaaaggtttgccccttggacacctttatcttgccttctgttacccaggggcatagctctgcaagtaggctctcggttcaccgtgctcccttctttgcctctttgacagcacctgtacaatgctgcagccttcaaagcccggaccaaggcccgtagtcgtgcaagggacaagcgggcagatatcttgtgaatcagactggccaacgagaaggctacccataccataccatatttttaacagaagacagtgcaagaactggtccctgccagtgattgtcactttatttttttaatgatgaaaccaaaaatagacaaatgtgggagggtcaagggatcaggacacttagactcaagccctttgtatgtgcactcagctctgtggctgtggcctcttcctgtcctgtctcaggtaaaaccaaatgtgtgccggtcctggagggctaacggtcctagaggactaacctaggaccaacgggcagggtgggtggtgagaaaggaccatccctgttttatagaccttgccccactcccccacccccacccccgaccggggctgcttcccttgggggtctggcacctggcctccatggcatagggtaggcaaagctgcctataatggatgtgtgtgctggtttattaaagataagagagaattaaacgatacttagccccctgtggcctttatcctgagtcttgccttccctccctccctccctccttgtctcccaccccaggcttgtctgcagctaagatctctacctcacctttgtcctccatggcaggacacttagttccccaggtcagcgctgagagctgagactggaccccccactgggaggcctggcagagtgggtggctgagccagggcagctatttctagacttctgaacctcctatctgggggtggccagagggtgctgacaggaggtgccaggaaaagactggtgccccatcctctgacctttggctatccaaagcagggccctggcaccagaaggcttggtcaggcctggcctgaagaggtcaagagagacaggaagctgtggagttctatcaggcttgtacagaaatctcaccaaggagtagtgtaaatgaagccatcagtgagagaacagagacctgctaaaagcctctttccccctccccacagtctcacatacagatggcatctcagctgggtgcccgagcctcactgg

SEQ ID NO: 35328 - DNA, 1343 bp, Mus musculus
gtcccctccctcggctctagacttgggggaggggttgccacaggcctcccagtctaaaacccacctttgtctgaggtgccgggagtagccatggtacccccttcctgggcatccgttcgggttttctaaccgttgtcttgttctggggtgagcggggagcgcatgcagagatcccaaggcctatgtctggagggtaccaactcctccagcctagacccctggctttgtccaacaccagccctgacccaagtccaaatgtttacagggagcctcctgcctaccccactctctgccgctcggaggccccaaaggaaaaagcacaagaagcgtgagagataccgccattcctggagacaaagcccacctgctcattctcgtagctttaaagaaaaagaaaaaggaaaaataaggaaaactgcaaatctagaaaactttttagagaaacctatttaaaactgtcaggtcctgaccagcacccccaccccagcccagccccagccccacccctttccagcgattccgtgccttgagtgtgtctgcgtgtttacacccatccctctttgggcggccccctgctctgccctccacggaattggattccaagggctgttccagacaactgccaacgtcactgagggccctgctctgaagccctgggccctggctccattaacctaaatgtagctccttagcgctaatctaggaaccgccgctgcctgctgagggccaggcccctcacgccctcgccccaggcccgggtcctccagcgttgaacacttccttgcttttttcacatgttttatggaattgttcacatgatttgaaataataaaatgtagaaagaaaacaccaaaaacttccgtgttcttttctcctggggactgagcaagaagaagatatcccacaccttagtgccacacctgggatgggcccctggacatcagctttctaggcagagttccatcccagttctctagctttagtttgccctctggactggtcaacttacatgttagaggctatgcagccttctagtcctaattttgcagtttgtggcctggggcagccttcagaccttctgaaccttgggaactcttctagagggttcttgaaagttcggaggagcagagatagcacagataagtaggctgcactccttggcttaacagactcagaaaactaggggtggtggcatatgcatttaattgtagcctacaagaaggtgaggcaggagattgaccaagagttctagaccagcctgggctatatattgaaactcaaaaaaaccaagttgcgggctggtgagatggctcagtgggtaagagcagcggactgctcttccg

SEQ ID NO: 35329 - DNA, 1101 bp, Mus musculus
tgtttgaagaaaagatcacacagagctccctgaccatctgtttccctgagtacacgggtactctttgaagactagctcatgggggtgtggggtggccatcccaatagacaccactggggctctggtggcccatggatgccccaatctggacagaaggaaaaacacaggacctgtgggacctcactcaggaatgcactgtgtctacacacaaaaggcttgttaccacccatgggcctctaccgttgagcatacgtacataggaaacatccttcatacagcacacgcacttacacatgaccgtgctgtgcacattacatgcttgtctgttgtgggcacagagttctgctgtacatgcacatacacaagtcttcattcgtcttccttaggggccaacaagtacgacgaggcagccagctacatccagagcaagtttgaggatctaaataagcgcaaagacaccaaggagatctacacgcacttcacgtgcgccaccgacaccaagaacgtgcagtttgtgttcgatgccgtcactgacgtcatcatcaagaacaacctgaaggactgtggcctcttctgaggggcagtggacctggcaggatggtgagtcagggggttgtcaaacaacaggggtctggggaattgggggaagtcatttgggagtactcagcctggagagaaagggtcaggcagggcagtcagggaccagaggagagggaataaaaaagggtcctggcactctcctggacagagctagaggggtggtcagtgttctttggaaggagttgcttccttgcctccatggtattctagcctaatctagatgcaggagacccaggcaccccgctgctcactgaccaggttcactcttgttcttagacttctgtctctcagacctgagagtcctaggcccaggccagccccactggccctggcgtacattcagtgaccgcagtgtcactgatatacacatcctgtaacccagcaacagaagctggcctctgggcacagctgtgtccctggtaacaaggaggtgggggagaagaaggtcattgtttagagaggcaagaagaggagccacatgtaacccaggctgtgtctgtc

SEQ ID NO: 35330 - DNA, 1170 bp, Mus musculus
taagtccctagcactgtataaaactgggaattgtttgtgcctttaatgtcagtacacagaaggtggagatcagaaacgagttggaggtcatccttagggttacagcaggttccaaattaacctttgctacatgaggctgccatagaaaaaagagcttgctttaagttttttcccacgactataaaatataaagtcttaagagtcaaatcttttctttgcccaaaggtacagactttgcttctcttactttcttagccatagtatggagtgtaaaagttttgggttttttgagtcaaggtttctctgtgttgtcatggctgtcctagaactcactatgtagaccaggctggcctcgaacttacatcccatgtagaggattcatgagtttgaggccaccatttaaactaaataacaaaaccctactcctctcacacacaccccaacccccaaaaagagagacagaaacagcttacagtgttacggctaacacgaacagttgtgctggcgctctgcctaacctttctgtttatcaccaggcaccacagtgactaccacctcagcagctgtagtatcccaaagtccccaactctataatcagacctccaacccacctggctctccggtaatcttttgctcttaaatacagaattgataactttgttgctatgttgctattaatctttcctggtgtgtgagccaggattgactaattacatacattttacccaatttctttattaggctttttaaaattattgtatgtatgtgcatgcgttttaaatataaagtatcaagcaggtcatagttatactttgtaaatgcttccgcttgacttatagaaagttgtcagcatgttttttgctatagagctgccctagaccctgctgcagagcatctgtcaggggagtccttcctcctagatgattacagtgacttagttctcttaagaggctttacagttgaaattacattgaagctaatgttctttccagactgaggaagcacagcctagcactagcacaagtacacaggcccccgctgcttcccctactggtgtagttcctggtaccaagtatggtaagccaatctcatgggactcttgacagttggaaggtcataatttttgcctttgttgttaataaagttcctctccctttgaaacgggtgtca

SEQ ID NO: 35331 - DNA, 1200 bp, Mus musculus
gaggcacagatatggtgcatagccatacatggggcaaaatacctatgtgcataagatttttgaaattttttgaagaaaaattaacttttagtgcccagcctggtgctgtatgctagtaatataaacactgaggaggctgaggcagatagactgttgatttcaggccagtccaggatatataacaagacccttagagcccaaagactgagctctaacaccaccataaagaaagccagaaagtaacagtattagtaacctgtctttttattctgaacagttagagtttctacttgaaatctcagaaaaacatgttgaaaaggatacttcattctttggcctgcctgcctgccttccttccttccttccttccttccttccttcctttctttcttttttttaagatttatttattgggggtggggctggagagatggctcagcaggtaagaaaactgacttcaggtcctgagttcaaatcccagcatggtggctcacaaccatctgtaatgggatctgatgccctcttctgggctgtgtgaagacagctacagtgtacttacatgttataaataaataaatcttaaaaaaaaaaaaaaaaaaaaagatttatttacaggctggcgagatggctcagcgggtaagagcactgactgctcttccaaaggtcctgaactcaaatcccagcaaccatggcggctcacaaccacccgtaatgagataaaactttgggccggagcaagcaggaactgagcgagctgagttgtttatagcatgcggggttgactggagtgagccaaggtcctaacaattcccaacaaacacatgaaggctcacaaccatctgtacagctgtggtatactcacatacataaagtaaataaataaatctttaaagatttgtttacttttattttatgtgcattggtgttttacctgcaagtgtatctgagggtgccaaaagtcccccggagctggagttagagatagttgtgggctgccatgtgggtgctgagaattgaacctaggttctctggaagagcagtcagtgctcttaactgctggacctccaccctgacatttcttaatttctaatagtatttcaagtgttaacttttttctagccacatgtacttgctttttatttattgttcttgggagaattgcattcgctcccccttggagtcccttctgtgtcatgattc

SEQ ID NO: 35332 - DNA, 1129 bp, Mus musculus
attaagtatactagtggaatatgaggtggaatttatcagaatcccttatttttgtttgtttcctttgtgttcttaaagtcttcactattttggaattttctcttaatcatcttttgaaccaaaaaacactgaaggaaggtatatttgttgtaaatgttattccatgtagttttgagtatttatagaggtcaactgatagaaatgtatacttttttggtttgtttgtttgttttgttttgttgttgttgttttcgatacagggtttcgctgtgtatccctggctgtcctggaactcactctgtagaccaggctggcctcgaactcagaaatctgcctgcctctgcctccccaatggtgggactaaaagtgtgcaccaccgcgcccagctttcaaattgttaaagataggtgtgttaaagaattaaaggtagctgttaatcacctaatgtgagtactgcaaattgagtgcaatgcatagaaatgaatactattaaccagaactctctctagccctaagctgtagtattctaacttacttttcgtttttagggctggaattaaggaaggcatgtttagtgtatgtgttgcttattacatgttcaaatatttgggtttggatgcatgagttaggattcacatgtggaggttagaggttgtcttctgcgttgcccgagacagattattcactgttctgaatacgctaagcttcaggagaatctcccgtttccctttccatttcgcagtaagactgctgcatgtgcagttttccctggatcctgggatggaacttcaatccccagcaagcactttgctcattgagcatctctacagccctgctttttgtttgattgtgctttaaattttattacctcccaccatttttgcggtggggtacaagtgctgtggctgtgtggcagttgtcttctagcatgtgtgatctaggacttgaacttagttgataaggtttggttgcaagggtctttagctattgagctctcttactggcccactgttgacttgttttttaggcagtcttactatgaaaccatagccagcctagtattacctatgtaattgaggttgttttgtaaactaaatgcagtcttccttgcctaagcttactgctgctg

SEQ ID NO: 35333 - DNA, 1191 bp, Mus musculus
aaacatgtcggacacagcagcgacgcctaggagaacagagtacagtgccccagcctatctggctccttcctgtgagctggatagggagggctggtgtccccccatccccccatcgtcttcctagatgccattaccaagaaagagacctttgccatagccacctcatgcaggctcaggcagtaaatcctattcctcccagggaggcgtggcagcacctcataggctgcgttgggagcatgcttttcacagcagcagattttctgctcttagtgcagcgatatggggaggcttttcctctttgtctaccatcagaggctgaggtattgctcagccatgtgaagtagctctggctgggatgaggaagtagactacagttccccagctccctgagggatgctctcagcaggtgcccttggtcagaccctaccacagcctgaacaggcagccacgctggtccttgcccttgctcggcactccatggtggtcctgcccttctccctgcatgcctgtgggtctgctctggtatgtgaaggttggtgggctaactgtgtgcctactgaacctggcaaataaacgtcaccctgcaaagcctctggccaccctcttgcctttgcttcctctgtcctcttggggaggagcctatggaaggcagtgcgggagggacgaggctgtgggacgatcagtttttgggtagcggttgatgcttagtgtgttgcttggagtgagagtggaggtcaccttctccagtgtctacctggatgatgttgatgggactcctctggacgctaaaaatcccacgagagtggtgtgtttcagctaaaaactatcccgagctgagcgccgaagggctgacgcttttccgattcttgttgacaaagagcctttgtcttaacttggacttagaggtggaatctactcagggccaaccactataggaagtgaccttgcgcgtgggcacagtggggagagggtgggattgcacaacagttctgtgcttcttgatgcctacttcctgtgaatacctgtgctttccacttagaccaaaaagatttcattctgtcttccccggctggagcagacctactttataaagttatgtatgcttcttctgagggagtaatactgctaacgataccgtaaaaatcgctaaggagcctcgcttcaactcaagatggcctttctcagggagga

SEQ ID NO: 35334 - DNA, 1191 bp, Mus musculus
acaccctggaagaacgcaatgctaccgtggagtccctacagaacgccttaaacaaggcagagatgctgtgttccaccctgaaagtaagtcctcagagtcagtgggaggtatggccacagccacggctggtttggaacacgcagcgatctacctgcccctgcctcccaagtgtagagattaaaggcatgcactgccatgcccagcctaggctcacatttctgatcatatcttctatttctgcctcaaccaatgcctttgtttatgttatacagtagtaaataaagtgaaggcacatctctgcttcccagaccattctcctccagaccataaggaaaggggcgcaatggctgtgcttgtgggctttgtgtccagtaacaaggcctccccaacatttcacatggggcctgctcaatggagacctgagtaggctgggccatgtttccaaaagtgtctcatactccactgatgaggccagtctgaagaatcttccattaggactccagtccttggcggggctgctctctggagccagatcaaacagcatcctagggaggagcaaaggcctttgaagtccgctgtgctgagctgaccgagcagatcaaagcctgtagagcaagcaggcctagacccagatgaattttgtatcagcctgggttcgtgagcctcttgctctctgagggccacgaggcgattgatctgaactcatgattgatattctagccttgtaggcaggagcagcccttgctgggtgccatctgaaagggatgggagccatccttgtgaacagatggggccctaggattttcattttctgttcctgcttggaggccgagctgcatcacatggcctagccagtgggagggaaggggccagcaccaggttacagagcagtctctgatgcatccctggtcagacctgggaaggtctcgtgctgaggacagctcctgccttgtctctcctattctggcacttcttgtctatgtgtatagatgagatataggtttgagctcttggcttcttccatatgcgagcatgtacagtgagacccttggcagatcacagtagttctgagtcggtaagccagggaggcccatctccagggtgaggaaactgctgccctaaaagtctagcaaaaaagcatgggccaagagaaggctgcggttcaaagcctggcttggattctcaacgttt

SEQ ID NO: 35335 - DNA, 3654 bp, Mus musculus
tttgtctcctgggatttcaggtgtaccagctggacacaggtcattacctctgcaggaataagtactatggccgtggactctccatcgagggcttccgcaatgcgctctatcagtacctgcacaatggcttggaccttcgacgtgacctttttgagccaatcctgagcaaactgcggggcctcaaagccgtactggagcggcaggcctcctaccgcttctactccagctccctgcttgtcatctatgatggcaaggagtgccggtctgagctacgtctcaagcacgtggacatggggctccctgaggtgccaccaccctgtggccccagcaccagtcctagcagcaccagtcttgaggctggcccctcttctccgcccaaggtggatgttcgcatgattgactttgcacacagcacattcaagggcttccgggatgaccccactgttcacgatgggccagacagaggctatgtgtttggcttggagaatcttatcagcatcatggagcagatgcgggatgagaaccagtaggccctgtgctgggcctaggacccccctcctctccacccacaggcagggaccattgctctgaacttgctgtgaggacacacagacttgcttttaaagggttatatttctctttggtgtaaactaaaagaaatgtttttagctgtagcctggaatccatatatataaagtagaggagggcagaacatttgtcctctcagccaggctccttagctctgtggctgtgactgctgtgtccaggctgtctcaggaaggaagaggtggccccagtgggcttgacagcaaagagaatgaatgccttgaactttggtctcccttgcctaaggcgtttgggatctgtggctgtggggctctgctgatggtgaggtgaagccctcggctggcacacggtctccatgcccaatcatcccttatttcccagaactggggaaggttaagtgcccacgtcctgagggccatcttagtttcgtgccagtgctgtaacagatgcctcagggcattagagggctagctgcacagacggactcacccttgggtctgattttggcatggggctagatcggtgaaactgagctaaggccaactcagcagagggcaggccctgggctccctaggcacccactggcatgtaaccctgttcctctctccacaactcgagccagcctcttgctgggatccctgacctaaggaggcctcatagcctcctatcccactaagatgggcacagctgtttgctgaggagagccagtgtcccaggaggcctaagggcgggactttagtggctctggcccagacagtatttgcagttctgggctctgggtggcatcccttcctcacctggggcagctgtgctgcttgtgggtgggctgctgctcccagggctcaggaaccgtggtccgctcagggtcttgtcttctccaggccaagctcaaggcagcagccctgtatgtggtgctccaggctctaggcctggagggagaactttaaacttgtttgcttttagggacatagggccctgggcacaggtgcccagcgtctgctgagagctttgattaatcctggggtttgtcagtaagtccatttgtccacctgctagcccctgtctcatggtgagctttctggagtatagccttgttggttagtatatattgatttccttcatgcttcccccagcagtcttctcctttccttttctgaggtgagtctgctcctgtgcccctcctcagcaggttctgctgttacaaacctggtggccaaatgattcatagtggtgtttacctgctagcccagtggccttcttgtgggcctggggtatggccttcagcaccaacggtgggtaatgaaggctcagggttgaccctgacctattgcttttatttctgctaccagtcctttcatggtagagacctgctgctgcctgtaacatagtgtccgacaggttacactacaccaatcattgccaaggtgagcaacagtctccaagtctatcacttctaacatgtctctgttttggcatttgaaggtaatcctgccaacctttgagagaaactgttaacgaatggcataatttccaggttcttagagatgcagcctctgaaaagggttctgtgacggatccaagtcagtcttctgaccctggtgccattggtgggcaggttcccattccttagggccgggaggcacggcttggcccatctctgcttactaacacctgtcttctgtccagtagtagtgttgcttgtgccatgcaggcagcaagtgttaattagcgtggacaccttttctttggcaggatagaggtcaagagaggagtttggggccagcagagacctcctaggaatgtgctgtacttccgatttaccagattttgggaggtgctgcccccattctgctgcttctcaagtagcaagggagttggtaggcactgctcctgccactgcaagcgaggaaaggctgggatttgccgctgctcaagggcagggcctcacttttcagcacttttgatatctggaggcccagctctgttatctgataggtggtggcaagtgtgtgcgaacacttttaccactgctcttctgcctgtcccaggctagagccctgtctttttcctgacaggtcctgccttcccaatcatcaatttgggaccaaagtgcaactagggatcatgggttgggagctcacattacccctttccattgtatttcccgggccaagcccataccagcccggggagatgggtgggagtgaaatgggatgggtgctgctggaagaggaagggaccagtagagcaatgtccttgcctgggattctacccctctcagctgtgggccgtgcagtggtgtggggattcattctctcctaggggcaagggacctgggctcggacagtatccgttcagtatccgctgctcattcgctcacatctggccacgtgcacgttccctagatgcaaactgctttgaactttacagctatataagttggttgtgtgtgtgtgctcattttaaaaactacattttaacgaggaaaaaggagaacctggggaaatttcctttgcttctgtggaggaaatgtaagacttggaattctggaaattgttatctgctcctctttcctggaagctacacaccctaagacctgcgcctggatgcatacgtggctccactggcgcttaggcgcgcttgcattttccccaggtcttctgtgtggtggagaggagtgcttggcccaagccggcccttttctgtacacccagcgctatccgcccgcttgtgtctggtcgtatacgtcaaaataaagcctctagaaactgaactctgtccaagtctgtgtgaaaacttcatcgcctccggttgggccgacatggctagtctagggatcgggctgagctgggtcgggacaggtgcagcgggacagtgctgacactgggggtggggggtcgggggaggcagcacgggaggggttggatataggggtcagagcaagtgttgaggggcggggtcatcagggcgaacctggagtggcctttgggggggtaggcggcgtcggcggggcggggcggggcggggcggggcagatggcagctgccgcgtggcggactgggttccgataggaagctaagcctcctc

SEQ ID NO: 35336 - DNA, 1156 bp, Mus musculus
ttgtcttgtctatatgacatctgcccgacaggcatgtgactcagaacttgctttagatcaggcccacagctctctggcccacgggaatgatggtattggaaacacctgcagcctgtgacttgcccagcaagagggagacagactcgcccctaacctcccaggcagtagtgtgctgctcctctctgcctttgtgagctgaacgttcttaggcaggcgtcgctgcattcttaatgcagcggtgcaggaggacaggcaggagtcctgtctggagtccctggtaactctactctcctctgccccagagccctgcccttcgaccttgctacagcagcacatggcggacctgctgcgacaagggtctgatgtggcaccgagcttcctcaacagtgtccttaaccagctcaactgggccttctctgagttcatcggcatgatccaggaggtgggctgtgatgggactccgtagcttggggaaggggtgggcagagaccaaggctccccagtggcaaggcttctgactgcttcctggctacctgccggtggtttagattcaacaggctgctgaacgcctggagcggaactttgtggacagccgacagctcaaggtctgtgccacctgctttgacctgtcggtcagcttgttgcgcgtcttggaaatgaccatcacgctggtacctgaaatattccttgactggtcccgccctacctctgagatgctgcttcggcgtctggcacaggtgtgtccatcaggacaaggaggggggaccctggggatcactcaggtggtgcgcctgcccatccaccaataggcttctgccctcacagctgctgaaccaggtgctgaaccgggtgacagctgagaggaacctgtttgaccgtgtagttaccctacggctacctggtaaggatctagatgtcccgcacctcagcacacccaggccttagcttctctgccaggagctcacgctagagtccccattcaggaccagcacagccctgctgtgcacccccagcctcagcttgccttaagtaggaaaaacaggggcaaaggtcagtggtgtcagccaggcctgaagcctctgccgcagaagcaactgcgtaagtggaaccacttcatcttccttccctccccttagggctggagagtgtggaccac

SEQ ID NO: 35337 - DNA, 1231 bp, Mus musculus
tgtctccatgatgggcaccactgacatccctgattggtgagtgtgcattaaaggtccctgccttcctcccaccccgtgttcccagggagatcctgcggtctgcatctgttggtcttttataggtgtatggtggagactggcttcccttatagtaatgactacctgccagacctgaatgtgttggaagagatgctggataaatcacccatcaagtacatccctcaggtacccaggtatccttgtgccacccattcctccagagtccagagctcagctcgccacagctccttgcctcccatacacctaggtaaagacaccagtgttactgatgctgggccaggaggaccggcgtgtacccttcaagcagggtctggagtattaccatgccctcaaggcccggaatgtgcctgtccggtgagtgtcacaggatagttgggcagctggtggcaggtaaacaggacaggaccctccaatgtcatgtgttgctgctcatacaggctcctgctgtatcccaagagcacccatgcgctgtcagaggtggaggtggaatcagacagcttcatgaacactgtgctttggctacacacacacttgggcagctgaagccctgttgctctttgtgagctgggcagtccgtctcgaactttgctcttggtaagccccaggatctggcagaactgcctagaggtttcctgggctctggactccgaatgagtgggcagaggactatggactctaatcataataaaggaggacacagagcctggtctgtgctggtactttgtaccaagccatccccagccccagcctctaccttggggttcagaaaccctaggtccttggtttgatatccacagtgtattcatccctgtcatgtgacagagagaagccatgagagactcaacccctgcctgtcctagccaaacgggactggtgtagacctacatcactctttctgctctggtcccatgggctgggaacttctgcactgtccttgcattcccaggagtgcctctggaagatggtggcaccctgcccacacacagtacataccttttgaagttgttctgggatcagagcacttagcctagagtgtgctggtcttaagccacacagcctcttgcaaggagtcaacaccttccctagagacagaaactaagaagcactctatacagacagagagaaaaggccgctttatgtttgagaagtcttgacatctctaagggctcaa

SEQ ID NO: 35338 - DNA, 1192 bp, Mus musculus
aagaagccagaccaggccatcaaggtgcttgtggtgtggccgggccacacaggccctgccgggcagccctgccctacatccggtggacctgggaggccctagtgtctaggaggcaggtcagggttctgtaggcaccctgggcattgagtgtcctctgttctcagggggaccagtttgtattttatgaagactggggagaaactatggtttccaaaagcatccctgtgctctgcgtgctggatatcgagagtggtaacatctccgtgcttgagggcgtccctgaaaatgtgtcccctggtcaggtcagcagcaacatggcctttgccccttctggagtcggggtcccctgcttgagcgattacgtcttgctcatacctactttgtggttttgtttgcaggctttctgggcccctggagacacgggtgtggtgtttgtgggctggtggcacgaacccttccggctaggtatccgctactgcaccaatcgcaggtgagaaagcaggcagaccagagggcccttacggcccagctgaccatagagctgagtgtctctctgacctttccaggtcagccctgtactatgtggacctgagcggggggaagtgtggtaagtgtctggcgtccgcacgtgctttcctgactgttagtcttccctggtctatgtgatactcatatttctgtggcctagaactactctcggatgagtccctggctgtctgctctcctcggctgagcccagaccagtgtcgcgtcgtctacctgcagtacccatctctagcccctcatcaccagtgcagccagctcttcctggtgagctgaagtgggtggggtgggaggacggttagctcttgatggggaatgagggctaaagggatggtgtcatctcccccctcggggccctctcctgtcctccgtggaccagtggcctgacccttcaaggtaagtcctggaagcttgggtactctcagggctcaccacctcaaggggtcctccagccacagagatgctcgcgcgtcttagttcacgtctccaagtagccgggctctacaaggagcaggggcagagttgggggttatatagagtccatcccctgcacaaggagagctctgggtgaaaagccaagggacatgcctatctgagacaagtccaggctcccataaaagaggtaaattagcccccatctctcctaagt

SEQ ID NO: 35339 - DNA, 2412 bp, Mus musculus
gctgcaggatgtaacatggaaaacagtagctaaagattacattcaaaggactttcagaaattaaggttaagtttttacatttaatctgctgtttacctaaacttgtacgtataatttttgggtgggtatgggaaattgctttgctaaaaataagatcccagggtgtttcaaacttagagaagaccaagggacagtattttttatcaaaggaatcctattttttcacactatgtcaacttggttgctctgatatcccagagcctgactgagggcctcctggtcctggctcgggtgccagggccctggtgctgggttcgctctcccgctgttgccaggggctggaagctggaggggcctcttgggccatggacatcctgacctctaccccatgcacgctagtggcctaccaccaagggggtcttcatttctgtgggaaagggactccaaaaggcattggtggctatggcctccaacctaggtgctccaaggtgggccagctgctcgtaggggcacctgggaaggtcgaaggactccacctcatcaacctttcttttcccttctctgtggtttggtttggtttggttctgttctttcccttccctcttaaaaggaatatcacggtctttgaaacactcagtgggggacattttggtgaagatgcaatatttttatgtcatgtgatgctctttcctcacttgaccttggccactttgtcccaacagtccacagccctaccccatataccctgcccctcttctctggcgctccagtcctgggccgtgggcctgtggctggggaggagtgccagcaatagttcatagtaaaagtctgtgggctctcaaagctaattttttactaaagtttttatacagcctcaaattgttttattaaaaaaaaaaagattaaaaaatggtgatgcttagcagcagtttgtataagctcctagtgtcaactccatgggactgatggctttgctcatttggaccctcccctccttcttttcctaatgggttaaattctggattacatagaggcttcctttgccttttttagcagaacatcgtccatctgtctgcatctctgtcccatgactcaggggcacccactctgctttgattctcctcctttggaagaaaccattttgagcatgccttttcttgatgtctgagttatttcgggtaccttttagggaggaatgccttttgcaataatgtatcccttccctgatggagggtgggtgggtggacccaggctccctttgcacacggagcagtaccttctaagccatatcgactgttgagcagagggtgtgctgtctcaggaaggaaaggccagtagttcagaagggttgcttccaaatggtggttcttctgctttctccacaaggcctacccttcctgctcagcccccaggagggttctttgtagtgagcactccccatgcgggagtctgccgatgagtgcttcatggatggctggtgactgggccttgtgctcccaagctctggtccgagctggagtttccctgatgtcccagagtcaagagcagggatctgatccgatgaaattatttctggtgacctcatcaaaaataaataaataaataaacaaataaacaaatcccagtattccaggtgagggctttgggaagccctccagataactcttgttgctcttagcaaccccaccattgggcattgccatgtagagaggaggcaggcccaaagtggcctgttgtcatagcaactggaggcagtggggcagtgaacagaataacaacagcaacaatgcctttgcaggcagccccctccctgagccggcgatggccatcagactctgagacagagagccaatctcacattcaagtgttcaccaaccactgacgtgtttttatttccttctatatgattttaagatgtgttttctgcattctgtatagaaacatatcaaactaaataaaagcagtgtctttattacaatgtcattgcctctgactgtctatttacctgggatcttctggttcctgggcgtgaatggtgggagaggatcaatcatggtagagaagggcagctcagggaacctctgcagaagctgccatttctgtgccgccgggacctctgccaatacgcaagctgcttctagtgctccttctgcctttagtcaagactaactttagtcctcagtttcctcatttgccaaggtagggtataactgggagtctagtggatggggtggagcgtgatgggagatgtgcctcagaagaggcagcctctctgaaggctggggtggagctatgctgatggaaactctactgtggcttttatcgtcttttgtccaaaaatacctatgggcttgggattggctggtaaccttagcgagcggtttctaaccagggtgctttgtgcttgagctt

SEQ ID NO: 35340 - DNA, 1170 bp, Mus musculus
ccagactggccttcaactcatctctccttagatctgcctcttgagttctgggattacccgtgagcatgatgcccagtcaaagtccgtatgtccttaaggaccgtgacatcctagtgtgtgttagtgtgtcccagtgctgtgtggcatgtgacaggatgtcatgtgatagggcactactgctttccttaggaggtgatgagttggatttcccagcaggaattgtaaatcattcctctagcttatcacacacctcaggttagagcttggtttattatggtgatcattttaggccaggccatgatggtaacatttataactcacacttttgtctcttctaggtgtctgcagcagggaaggaggccttaccgtcttggctacactgggacccacacagtcatattttggaaggccttcctcttgacactgataaaggtgtgcattacatctcagtgagtgctgcacgcctgggagccaatggaagccacgtcccccagacttccagtgtgttctctatcgaggtctaccctgaagaccacaatgagccacagtctgtacgggcagcctcatcagaccctggtgaggtagtgccatctgcctgtgctgctgatgagccagtgactgtccttacagtgattctggatgctgacctcaccaagatgaccccaaagcaaaggatcgatctgttgaacagaatgcagagcttctcagaagtagaacttcacaacatgaagttggtgcctgtagtgaataatagactatttgacatgtcggccttcatggctggcccaggaaatgcaaagaaagtggtagagaatggggctctcctgtcctggaaactaggctgctccttgaaccagaatagcgtccctgacatccgtggtgtagaaacccctgctagggagggtgctatgtctgcccaacttggttatcctgtggtgggttggcacattgccaataagaagcccactctccccaaacgactccggaggcagatccacgccacacctacacctgttactgccattggacccccaaccacggccattcaggagccaccatcgcggatagtgcctacgcctacatctccagccattgcacctccaacagagaccatggctcctcctgtcagggatcctgttccagggaagcccacggtcaccattcggacgc

SEQ ID NO: 35341 - DNA, 1221 bp, Mus musculus
ggtccttttctttgctcccaggtgccagagctcttagattctgcctcattgaggtcattatgcctttgctttgcagagcccctccttggcgttccccaagtggctttcccacccagtgtccaatgagcagcctgctccccgccttgaggtaagctctctaacactgggtattaaccacatatacatggttctaatgtctagagcacaaaaaaagtgggcctctggctatcctggggctacctggaaatgtagctcagtggtagaatacttactacccaacaccacagacatttgggtctggacctagggcctatggttcaatgtcttcttgggagctctgtgggctttgagtcatccctggtttaagcatgggtcttgcttaatgaccatcaggctataactgttcttcaagttatctgggaatgttactggtttcatctgcagtgctccatagcttatatatatctaagggcatttctggggaaagattcatgaccatgttccttccttctggagcagggtctcccagatcccagcagagtgtcctctgaggtgcagcagatgtgggcactgacagagatgattcgggctagtcacacttccacgaggatcggccgcttcgacgtgagtaacagtgtccctcccccttgcttccatcactttgagcggctcaacactgatcgtttcttgtgttgcaggtggatggctgttatgatctgaatttactctcctacacatgaacagcagcttctacgtgagatgttggctttctgtgcccatctagatggggtttggccaccagaggccgttccctgtgcatccaagttctatctgggcaaaaatctgcagattgggaattcttgatacccatccagttgttttagcatgaattcctagtgggggcacttctgtctctgactgtctgacatgtaaattcagtctcttcctctcagaattcaccggttctaattagaatccttgagctcctcttgcttgtcctgccaacacgaacaccccagtctgctaccatttccccccattgctgagataaacctgtcacttgtagcaaggaagccactgttgttttgacactcatgacctgggaagcttgaggaagacataccctctattcattcctctgcttctgctagtagcccttgtccttttgtattgtatccatgaaaagaaaatgtcctagagccaggcatggcacacaccttt

SEQ ID NO: 35342 - DNA, 1129 bp, Mus musculus
cgtttgcagggtggagtctgcctgtacaataccgtgacagtcatgttgattcacacctgcacacacgccggcattgctctctctttgatgtgtcccacatgctacaggtgagtcagggaggatcgggccttcttccacgtctacagaactgagctctgcagctttgaggctatcttagaagactaaagtgttagggactctagagggctaactcaggagatctgatgatgatgtatctttgatctctcctgcctgctcctgtggtgtgttttaatgccccggggcttgctagatagaaattggtttggtatctcagtaaggtgttagatcgccttgaatttttagatgttgcttggttgcacggaggctgggagggatcctggaattgagaaggtaggacctctgccctctccagaaccaaaagaccagtagtcacttctgggctggactggaggatgcttgccttgcagccttttagattacagatattgcagtggcctggggctttccctattttccctagaccaagatatttggctgtgaccgagtgaagctgctggagagtgtagtggttggagacattgcggaactaaggcctaaccaggtgagcctactttacttcttctcaaagtgtgttttcagtcacgagccagtaaacagcttacacccttgcctcaagtgtaatcagcagccaacggcgcacgcctttaatcccagcacttgggaggcagaggcaggcggatttctgagtttgaggccagcctggtctacagagtgagccagggctacacaaagaaaccctgtcttgaaaaacaaaaacaaaaacaaacaaacagtgtaagaagcacaaagacaggtcagatacagcttttcagggcttgctatcttgatggagtcttttgagtcatttccagatattcagctttggagcaatatcccagccttactccattgggttgggaggccagagaccaccatttatataccctgacctctcatgcttcccatatctttgctaattaaagtgtggtccttaaaccaggagcctctccatcttctaggaatatgctaaggcactgctctggacctgctaagccataaccttggttttactaagatccctaagtgt

SEQ ID NO: 35343 - DNA, 1113 bp, Mus musculus
ggtgaatttctgagttcgaggccagcctggtctacaaagtgagctccaggacagccagggctatacagagaaaccctgtcttgaaaaaccaaacccacccccccccccaaaaaaaaaaaacctgtctcaaaaaaacaaaaaataaaataaaataaataaaaaataaatcctaagacaaaaaagatctacttgtaaagcttagatcggatagcgcatgcctataatcccaaaacctgggaaatagaaacagtccaatcataaattacagaccaaccttggctaactgtctcagacagaggaataggattgggaaaagtgggcaatacactgtagtggtagagagttttactcctgcatgaccaaaagtagtaaaagtagctacagcattcaagacactgcctatctgctctctgttcctttgtgcagatatcagtcccagcaacaggggcagtccacttggcaactactctgttgaaaaatccagaggtaaagctggcaggactagcagcccgagatagcctgcgcctggaggcaggcctctgtctgtatgggaatgacatcgatgaacatactacacctgtggagggcagcctcagctggacactgggtgagccgggctagcagtcaagggggtcctgagagctagaatactctttaatgaagccagctagcccaggactactcctaaggttgtgtagtctggaacaagtgactcagccttgctgtgccttcattccctgaaggtgctactgtggctttgtctattataaactgagggtcctacatatggcttccagagggtaggtgatggttggttgactgactgtaattcaggggaagaatagtagagctcaagaggccaagtgatgtttaattggttgtcacttggagtcttagtagtaaagacttcctgtgcttagggcttttgtgaactatggcttacagtctggtgtgttatgttccagggaagcgccgccgcattgctatggacttcccaggagccaaaatcattgttccccaactgaagggtgaggtacagcggagacgtgtggggctgatatgtgaaggggctccagtgagagcacacagtcctattttgaacacagaaggcac

SEQ ID NO: 35344 - DNA, 1381 bp, Mus musculus
gggtggtgctaacttatggcctatgcctggacaggtactgtgaccagtggctgcccttcacccagcctgaagaaaaatgtggcgatgggttatgtgccatttaagtacagtcgaccagggacacagctgctggtggaagtccggcggaagcagcaaatgacagtggttagcaaaatgccctttgtgcccaccaactattatactctcaagtgaagatggcccatggggaagcccttccctccaggagtgtttctctagagggcatggcatagtgcttagtcagaacagtggagtacaactcccacgggtggaagctgaatgaggtttgctgggtctgcttagggttggggagagaatcctatctagaatctttcccttacaagccattccaattttagggcccaattttttttttttttttttttttttttttttggtttttcgagacagggtttctctgtatatccctggctgtcctgaaactcactttgtagaccaggctggcctccaactcagaaatctgcctgcctctgcctctgagtgctgggattaaaggcgtagggcccaatttttaaatgacaaatcaccttacttaatgtcctgttttagcccacagtcccactaaccttaatctgcctggtgctgactttggaacaaaggtcatcctgcctttgtgtggagggtaacacctccgcccacctcactatggcttctctaatttcaaagaactattactgtgggcagtatggacttaggtaccttctccactttgcatactgctgcctttccttagatagaaatgactcctgacgtggtgttggctgagttgttcctgtgtgcaaacatagagatggctaagcaaacatgggactcacccttccacattctctagtcaacccagcctgctgtgcagcaagacatggctggtttaatacttgggctgacctcggtcagttgttgtgaataattatactttactaactcttgaaaaataaaattaatttctttcttacttgctatggtctctagcttccttgttctttcgtcactggatttctggggtgtcttttttttttttaaagatttatttattttatgtctatgagtacaccattgctctcttatgacacaccagaagaggccatcagacccctttacagatggttgtgagccaccatgtggttgctgggtattgaactcaagtcctctggaagagcagtcagtgctcttaactgctgagccatctctccagcccctctggggtgtcttcttagcctctaagacaggctctaagtaggatttccttggaaagggccagctatatgagaactaaggaatatagaagtggtgtgctggtctatccctgtaatcctagtacttc

SEQ ID NO: 35345 - DNA, 1186 bp, Mus musculus
ctccgccatgactggccagcgccccaccgggagtactgtcaccgtagttcttactgcgcaagcgtatggtcttccggggttaggcctgtcagtgcgcacgcgtaatacaaggcaaggaagatctacttcgcttgcgcgaagtgttggcagtttggggaggggtttttaaaaccgcgcaggcgcacccagccccaccctgcttgcttaaaggatgagtgattcggtgaggataaaatagcaactcgctcttttatagccccggtgttcccgtcatgctccacgcgtctgccatgattggttaagcgtctagctctcagggcgtggatgcgttcttgagcaatcgtggctgaactgagagtgtgcgcgcgtgcgcggggccgcgactggcgccagctcgagcccgcagggcgctcggggccgcgcacgtcgctccccgccctcccgccaccgcccgccctcgttcgctcgcgctccccgcccgccgcccgcggtcctccgtcggttctctccatagcccgccgtctcccacggagctgcccgtccttggctcggagctcgcggactcgcggacaagcgtcctcagcgcgaagaggccggactcggagtcctcgccttgaggtgagcaggagcatttccctccagccgcctcggctccgggcccggctggtcggctgatcggcaagcacttttccggcctccggcccgtcgcctgcccgcggtcgcgccccacctgctgctctcggcccgcagcccctcgccccggcccctgacctggggccccgcgcccgaggcggcggccccgcccgcgcagtccccggaagcgcgccccgccgcctccagtcccccttcccccgcccggccgggcctggtggagccctagccgcccgccctcctcgtcgcttcctctcagggttgcgccgggctgggcgggggctcccggccggtccgcgaccgcgctggggtagcctgccactgcgaagcgcgtgtggctgtcgggagttggactaggcaagaaactcttttacaactccattttgccttttgcattgaacgtggattattaatcccgttctataccgggtgaagacagtgagggtttgggtggattttctgttttgagtgccgtattattggagattgtgtaagtaaaagattgttttgaaatcttagcggttatgactctatg

SEQ ID NO: 35346 - DNA, 2084 bp, Mus musculus
aacaaaacagggctggagaaatggctcagtggttaagagcacggtctgctcttccagaggtcctgagttcaaatccgggcaatcacatggtggcttagagcattggtaatgggatctgatgccttcttatgatttgtctgaagatggctacagtgtatatgtataaataaaataaatcttttttaaaaaagaaagaaaaagaaaacagaaaaggacaagaattagctgaaaacacttttttctcttttcttgttttcttttctcttctttttttttttttcttttcttttcaactaggagccggtaaaacctgaagaaggcagagatatggcaaacaggattggcgcttttgggtacatggagtgttcagcaaagaccaaagatggagtgagagaggtttttgagatggccacgagagctgctctgcaagctagacgtgggaagaaaaagtctgggtgcctcatcttgtgaagccttgtgaacgcagcctcatgcggttaatttgaagtgctgtttattaatcttagtgtatgattactggccttttcatttatctataatttacctaagattacaaatcagaagtcatcttgctaccagtatttagaagccaaccacgattattaataatgtccaacctgtctgaccagccagggtccttctgacactgctctaacagccctctctgcactccacctgacaccaggcgctaattcaaagaatttcttaacttcttgcttctttctagaaagagaaacagttggtaacttttgtgaattaggctgtaactactttataactaacatgtcctgcctactttctgtcaactgcaagaactctggtgagtcactacttcagagctttccttgttaacagactccattgccagagctctggggtgggtattcagttttttgaaatcttgctcagccagaaaggcccaagtccacgcagctgttgcagagttacagttctgtggtctcatgttagttaccttatagttactgtgtaattagtgccacttaatgtatgttaccaaaaaataaatatatctaccccagactagatgtagtattttttgtataattggatttcctaatactgatatttgtcattcccacagaaagtgtattgcttcttttctttttctttctttctttctttttttcttttttttttttttttttaagaaagtgtatttggaaataaagtcagatggaagaattcatttttaaaattcccattttgtcactttctctgataaaatatggccatatcccttattcagccctatatatcattctagtacccctttccagactggactaagtaggaatttggtttcccgcctgaggcagttatactttggaggtggcatagcctttctcacctggactgcagggtctggctctaagtcacagtgctcctttctccacactgtatccaagttgcctcccagaggagccaccagttcttatgggtggcagtgggtgggggtgggggggtctcttctctccagctgactaaacatttttctgtaccagttaatttttccaactaatagaataaaggcagttttctaaatttcctgtattctcttgtgtgttgctttcgccggaaagactcccctggagaggcttcttgaatggcaccagctcctcctactccctccctcttctagactaaccttttgtctcctcccaagaacatggaagtggtttccctgtgacacgttcaaatctaaaaagtggagtggaagccgggtgtggtggcgcaggcctttcatcccagcactcgggaggcagaggcaggtggatttctgagttcgaggccagcctggtctacaatgtgagttccaggacagccagggatatacagagaaaccctgtctaaaaaagacaaaaaaaaaaaaaaaaaaaaaaagtggagtggaatgtcatagaggggacatgaggggctgggttttctggactaagaccaaactgcactgggggcaggaatctaggaccactagaagcacgtgttctgagaggagctaggttagagtctggagcagggagtcctgcactgctgtccacccttac

SEQ ID NO: 35347 - DNA, 1752 bp, Mus musculus
ccatcttcctaggcgggactctagactaattaagaaacggttgagtaagacagagctggaagatccccgcctaagcaagcagcttccttccagactagtgctacaggagctagaccagacccgccctaggcacctccaggcgctttagcccggccgcaccctcttccctgttcctcgatggggggagggtagaggccggataaggcgggaccctgagacttagagctggctgccagccggaaagaaagcgatgccacgtgatctcagcaccatccagttaaaaggaggtgcagggccctgtgagcgctagtacggattccacgtttgagtcccaacatctccagtatgtgtgctgctcggctctccgcggcggcacagtccaccgtgtatgccttctccgcgcgcccgctgacgggcggggagcctgtgagcctgggctccctgcggggcaaggtgctgctcattgagaatgtcgcgtctctctgaggcaccacgatccgggactacaccgagatgaacgatctgcagaagcgtctgggacctcgtggactggtggtgctcggtttcccgtgcaatcagttcggacaccaggtatatggggcgagatgggtggccttgggctctaggctcccacgggcgggacaccgcttactttctcctctggtactacagctggaatgcaggcctatcctcggttatacaaggagggcaacttcctggtgactcatcgggaaacctctgttttgcagttaaaaagcacattctttccgaaatcctagcacataaataaatgcctttgtcttccctaggagaatggcaagaatgaagagattctgaattccctcaagtacgtccgacctggtggcgggttcgagcccaattttacattgtttgagaagtgcgaagtgaatggtgagaaggctcacccgctctttaccttcctgcggaatgccttgccaacacccagtgacgaccccactgcgctcatgaccgaccccaagtacatcatttggtctccggtgtgccgcaacgacattgcctggaactttgagaagttcctggtgggccccgacggtgttcccgtgcgcaggtacagccgccgctttcgtaccatcgacatcgaacctgacatagaaaccctgctgtcccagcagtctggcaactcctaaggcggccctggcattggcttggtgattactggctgcactctggggggcggttcttccatgatggtgtttcctctaaatttgcacggagaaacacctgatttccaggaaaatcccctcagatgggcgctggtcccatccattcccgatgcctttccacctaatgaaaggtggtttcactactaagaataaagtgctgaatatcagaattgtttgtgtgtcctgtgtcattgtcaccttttggatagcctcatagtcagggataaggaactcaatcccagagcctaaacgtccctttccccgccccttatgcttttctttctccctgtcccaggacatggttaaggtcagtcttgagtcgccgttacagcagaggccatactccagaaggaggaagccagtagacaagggcagactgcctaacggttaaggccaccctaaccccaaacgtgaacttctcctttctgagtttttggtggatgaggaagtgactgtgtgcccctgttcacacaagactctagaaatctagatctttgcccacagaagtctgttttgcacagctgcaacagccttgcacagtgttacc

SEQ ID NO: 35348 - DNA, 1204 bp, Mus musculus
ggaatattgtgcttgttcctgttgaatcttttcttatgaaaaatacataagaatcttgtttcaaaaaacaagcaaccaaacaaaaagaaacttctggggaaaagaaaaatgagatctgccctgatttcctttttcagatcctgagagtcagaccttgaaggagcacttaatcgatgagctggactatgtgctggtcccagccgaagcctggaataaattgctgaattggtatggctgtgtggagggccagcagcctattgtcagaaaagtgagttgacaagttgttagacctgctaggtgtgtatgtgagttctccttgggtacactgacttctctttatttcccgggaggatgaaaacggttacatggttgaaaatgaagcaggtgagactttgtaatgtttttggattttggtttgtttttgtttttgaaacagggtttttctgagtatcccttactagtaagtagttctggaactttctatgtagcccaaaccagcctcaaactcagagatccctaagtactgagattaaagatgtaccaggctttagaccttgtttatgtttcctgagacaggatctctgtgtatcccgggctggtcttgttctggtcatctcctgcctcttgtatgctggaattttggcctgaatgactattctacttctctctgggatatgaagtatttgtgagtaactcaggatgttcctaagtggcctccaaatacaagagctgcctgctggtttggaatgcccatagtacttggaacccagctcttcagttgggctgtgtggacataatcgaatgcattgcaccttgcaccgcttccttttccccaggactgggagtgaacctagggccgaatagaatacatgactcactgagtgtcctagcactgagctatatccagccctcttttttttttctttgagatggtgttgtactgagttaaccaggccaaatttgaactcacttatagctcaagtaggcctagaactttgaccattttgagccttttcattgaggctcctggatgttgagataactagtgtgagccaccatgcttacctaacaacttctctttttctttttctttttcttttcttttcttttcttttcttttcttttcttttcttttcttttcttttctttctttctttctttctttctttctttctttctttctttctttttagatttatttatt

SEQ ID NO: 35349 - DNA, 1467 bp, Mus musculus
attgaggcagaaggataaagagttcaaggtcggcctgaactatacagtaactttaaagccatcctagactacatgaaacagtttttttaaaagggagcaggtgggttggtagtcatggtggttctgatttgaaataatgactccttaagaacacagctcttgtttcttcttcttcgggaaaacaccaaatggtggatgacgccggtgcagcgagagggcccggaggacccggggcccaggattaggaggccgcggtggcttccgcggaggattcggcagcggtcttaggggccgtggtcatggccgaggccgtggtcaaggccccggggctcgtggaggtaaagctgaagacaaggagtggatccccgtcaccaagctgggccgcctggttaaggacatgaagatcaagtccttggaggagatctacctgttcttcctgcctattaaggagtctgagatcattgacttcttcctgggtgcgtccctaaaggatgaggttctgaaaatcatgccagtgcagaagcagactcaggctggccagcggaccaggttcaaggctttcgtcactattggggacacaacggtcacgttggtcttggtgttaagtgctccaaggaggttgccactgccatccgaggggccatcatcttggccaagctttccattgtccctatgaggagaggctactgggggaacaagattggcaagccccacactgttccatgcaatgtgacaggctgctgtggctctgtgctggtgcatctcatccctgcccccacaggcactggcattgtctctgctcctgtgcccaagaagctcctgatgatggccggtatagatgactgctacacttcagccagaggctgcgctgccaccctgggcaactttgctaaggccacctttgatgccatctccaagacttacagctacctgacccccgacctctggaaagagactgtcttcaccaagtctccttatcaggaattcactgatcatcttgtgaaaacccacaccagagtctctgttcagaggacccaggctccagctgtggctaccacataagggtttttatacaagaaaaataaaagaattaagtctgcttaaaaaaaaaaaaaatgcagctcttaccagacagtggtgccccacaactttaatcccagtcctcaggaggcagaggcaggtggatcctgaatttgaggttagcctggtttatacactgaatttcaggacagccaggattatacagagaaactctgtcttgaaaaataagcaaagcagagagagagagagagagagagacagacagacagacagacagacagacaaggatgaagctctgtcatactgaggagagcataccccccaagcaacatggaaatgtatgtattgtctatgtatcagcagtcctgaatgggcttttatgattcctttctagtaagaaaagctagtagctgagagacaaggcag

SEQ ID NO: 35350 - DNA, 1105 bp, Mus musculus
gatgcagtagagtttccttaagtttgtcttccagacaggtgggagaacaagtcaggtatggtcagtgggtcttcatatgcaattctgctggtagcagagggcaaggtgatacctgctgggtgtggctgtgcccactttttctcctggtcctcaagggaagcaaaggcaggtagaacagatctgaagttgaagccagcttggtctttgtaatgaggttcgggccatccagagctacacagtgaagctgtctcaaggggaaaaaaggaaagaggggtgatacatagtattaaatggcaatttatatgcttttaacatttctctagaggaagtgctgacccaatccagaaggtaaaggatacagcaatatttgggagggaaggaggtggctgcctgagtgttgcagctgtgctgacagcagagccttggctctgtcagctggccatatctgggccatgcactgcctctggaggaatcctacgtctccaggatgtgtcttcctctagggtcatttcttgtctcctgtcaccttgactgtttctcctttgcagtaccgtgtgactgtgccattgatgggggccatttctgacctgtgtgaagcactctccaagctgtctggcattgctgcagaaaatgtaagaaggagtcattagtggtccctcccaccatcaaatcactttatggtcctttgggtttactctgaaagttttgggagatttttgttattggacagtgcaaatgtcttggatacctcatagctcctggtcttactcacggtcctttccagtgcagggaaacagtctttctctcactgtggtggtgccgcccattgtcagagggacaagagtagggcttgctttcatcatggtgcaggtatagagactggctctggaaagccactgggatttctaggccatgaccagtgtctgctcagcactcccttctcatcgttcctcccatttgaaggcaatgtcatcaaacagccgtgctggcaatagcctgctgctccctttccgtcttggccatacgtcgccttgggaccactcgaatggtggttcttggtaggcaacacttgagcaaggagtttctgccgctgtttctcagtttt

SEQ ID NO: 35351 - DNA, 1158 bp, Mus musculus
ctaagtgatgcaaagctagctatgcaagcccaccatcactgtccgttgagtccgatttatactccctccaaacatcacgtgtcctcccacaggtcttgcctcagcaaaacactatgtgagtccatcttagctaaactccatgtgagtctgtatccgctgacatatccagaaacttccacttcactctgccagagtctaaaagaggcaagaaggcaccaaaacaccaccagaagttttttggtgcatttctttctatgaagtcacgaccagtaaggaatggcaagatataccaataccatccagcttcatccaccttctgttgggtcctacttatattccttcttaacatcatgcatccagctgggcagtggtaaggaatgcctttaatcccagcacttgggaggcagaagcaggcagatttctgagtttgaggccagcctggtctacacagtgagttccaggacagccgggctacacagagaaaccctgtctcgaaaaaccaaacaaacagaaaaaccaaccaaacatcttttcacgtttttgctgtagaaacatccatctatttatacgtaagtacactgtagctgtcttcagacactccagaagacgaagtcagatctcattacggatggttgtgagccaccatgtagttgctgggatttgaactccggacctttggaagagcagtcgggtgctcttacccactgagccatctcaccagccccgaaaacatccttaattctgtgtcttcttcagtgaaacattccttcatgtctgctttagcaaaacatcctttcacctgtatgccccagcaaaacatcatttggcataactgactttccacagaagccagaagttcctacttcagaccagtggatctctgagcttgagaccagcctggtctacagagtgagttccaggataatgagggcaatgcagagaaactctgtctgaaaaaactaaaccaaccaacaaaacaaacaaaaagagaatgtctcttaatctcaaaaaagttttataaatttaggtctaaaaatggtgtttgctgaggcctgctccttttaacataactgtagccatcttgtatttcatagtccattttgctcataaggtgaaattaaattcaggttctcagagtctttttcccagaagtaatta

SEQ ID NO: 35352 - DNA, 1102 bp, Mus musculus
ctgacttggatcccacactctcagattggggtcccttgcccctttctcccactccccaaccttcccagcctgactgcctcctgtcaactcaatctctaccttgtccctagcctgccagtgtagtcctgatggagcactcagtgccctctgtgaagggactagtggacagtgcccctgccgacctggtgcctttggtcttcgctgtgaccactgtcaacgtggccagtggggattccctaattgccggccgtgtgtctgcaatgggcgtgcggatgagtgtgatacccacacaggcgcttgcctgggctgccgtgattacacggggggcgagcactgtgaaaggtgagcctagagcagctacggtggttggtggttgggctggctgcttgcagataacactcattcatttccctacaggtgcattgctggttttcatggggacccacggctgccatatgggggccagtgccggccttgtccctgccctgaaggccctgggagccagcgacactttgctacttcttgccaccgggatggatattcccagcaaattgtgtgccagtgtcgagaaggctacacaggtgagtgggcaggactgggtatgagatcagggtcaggtagctaagctaagtaatcatggtttcctcttgactggacagggcttcggtgtgaagcttgtgcccccgggcactttggggacccatcaaagccaggtggcaggtgccaactgtgtgagtgcagtggaaacattgatcccatggaccctgatgcctgtgatccccacacggggcaatgcttgcgttgtttacacaacacagaggggccccactgtggctattgcaagcctggcttccatgggcaagctgcccgacagagctgtcaccgtgagtaggactgtgggaagagatggttgggtggcttctgctgaagatagagccccttgattgttgtgtctgtcttggcttgcccaggctgtacctgcaaccttctgggcacagatcccaggcggtgcccatctaccgacctgtgccattgtgacccaagcactgggcagtgcccatgccttccccatgtccaaggcctcaactgtgaccattgtgcc

SEQ ID NO: 35353 - DNA, 1216 bp, Mus musculus
taggttgtcttagtcatgcatatgacagatagttccacattgtcaggccttctttgttaaaaatagctcattaaaatataacttatgggctggagagatggctcagcggttaagagcactgactgctcttctagaggtcctgagttcaaatcccagcaaccacatggtggctcacaaccatccataatgagatctgctgacctcttctggtgtgtcttaagtcagctacagtgtacttacatacaatagacaaataaatctttttttttaaaaagacaggaaaaaaaaaagaaaaatcaaaaagaaaaacaacaaagatgaggcaaggttcttgatttcttctgcaggtgaagtggctggccagaccctgtctctgatggagcagctccggggggaggcacttaagtttcataagccaggtgagggggtaactcgaaattctggggtgtgctggtggttagcattacagtcacacctgtaagtcaggatccttgcctgacagctgctcctggtcatcagctctattctgatcctggcaggtgagaactacaagacgccaggctatgtgatcactccatataccatggatctgctgaagcagcacctggagatcactgggggacaggtgtgtgggggtgtggccaggcagacacttgactgcctaggctgcctcatctcatctatttcagtaggtgatctgagctttggtcccattccctttatcccattcctttacttaggtacgtacgcggttccctccagagcccaatggaatcctgcatattggacacgccaaagccatcaatttcaactttggttatgccaaggtaagcatttgtctaggtcctggcaagtaatatgatcactgtctactcccatgactgcattccagaaaggtatatttctgtcttgccttttgtagctgatgacagaggccctagagaaaaactccatgtaacagctattgtcaggaaatactgggttaatggggaaaattaaaatggttctttagatagggtttcactgtagagtcctgatggccttgaattgtggcgatcacatgcctctgcttcccaggtactgggattaaaggggtgcaccgctatgccccatggaagatgcatttcttcaattccttatattaacttttcaatttattttttggcagtcatcaatagaagacattaattaaaaaaatattcctaggtggctgaaa

SEQ ID NO: 35354 - DNA, 3198 bp, Mus musculus
ccatcgcacaggggacaaatggtacacattggcatgatgaagggtgaagtagcagggctgtggattgggcagagagactggttggctagtctaatgcttctgttccacaggtgcatctaccccacctatgactacacacattgtctgtgtgactccattgagcacattacccactcgttgtgtaccaaggagttccaggctcggtgaggaggctgaagtcatgtagtgggtatagctagggggattccttatgtgtttagggtgtatatacatatgagtggggctgtgggtgccacagtatgtgttgagatcagagtacaacttgtggaagtcagctttcttcttccaccatataggttccagggatccaacttgattttccagagttggcattaagtttctttacccactggaccctctcgttggcctctagtgctttttctgtggtctttttatgaccccacagatggctaacccttttcttccatcctagacggtcttcctacttttggttatgtaacgctctgaaagtctattgtcctgttcagtgggaatatggtcgcctcaatttgcactatgctgttgtctcaaagcgcaagattctccagcttgtagcagctggtgctgttcggtaggtgtggtcatggggtctgccagaggttgtagctcttgtggcatgtgctgtttaagatcttctgaccaccctcttatccaaagggactgggacgatccacggctcttcacactcactgccctacgacgacggggttttccaccagaggctatcaacaacttctgtgctcgggtataattcagtaggcttagtgggtgaaagcaggctgggtgtggcccttttacttgtggtatgactgatgagttttcctaccaggttggggtcacagtggcacagaccacaatggaacctcatcttctggaagcctgtgtgcgtgatgtgctgaatgatgcagccccacgtgccatggctgttctagagccactacaagttgtcatcaccaactttcctgctcccaaggtgggcctacctctgtgtgtgtgtgtgagcatgtgtgaatgccgagtatctgagataacagctatctgtctcctgctacagcccttggacatccgagtgccaaatttcccagctgatgagaccaagggtttccaccaggttccttttgcttccactgtcttcattgagagaagcgactttaaggaggtaagtggggtttactgctaggtctatttttaatagcctctccttcctgctttacatgagccaatccctaacaaacatgaggttgggagaagccttgttcttggatgatgtttgcagcttctgtatcttccatgcttcttttctttaggagtcagaaccaggctataagcgcctagcttcgggccagcctgtgggcctgagacacactggttatgtcattgaactgcagaatattgtcagggtaagagacagctgcagtctttctgtacagtgcctgctagggccaagattgtgtgttgctaacagtcttcatgttggtccctggtctgattccatcttcctcacttctagggctccagtggctgtgtggaacgcttggaggtgacctgtagacgagctgatgctggagagaagcccaaggcctttattcactgggtatcacagcctttggtgtgtgagattcgcctctatgagtgcctgtgagtgaacatagctggaattgagactgtcacaggatgggaattgcatgctgtggctctccagcaagggcctgactttcactctggctacagattccagcacaagaaccccgaagaccctgttgaagtgcctggtggattcctaagtgacctgaacccggtaggctcatagaatgtgaggtgagggtggtgggcttctgagctggacagccacttggattctctgtctgcaggcgtcactacaagtggtagaaggagcattagtggactgctctgtggctttggcaaagccctttgacaagttccagtttgagcgccttgggtacttctctgtggatccagacagccatcaaggacaggtgcttaatttgacccacctatacccttctgtgtactgatggtggaagctgttcactgtgataaacactctccctacatccccttagcattctccaaataagttgggagggacattcattactttccagttaagtccaagcacaaaattttatagggctctaactttttttaagatttattttattttatgttagtatgctgctgctgtcttcagacacaccagaagagggcatcagatcccattacagatggttgtgagccatcatgttgtgaattgaactcagaacctctggaagagcagtcggtgctctcaactgctgagccacctctccagccccggccctaacttttttactcttcaaagtagcaggcaagcttagagtttgtcataatcctcatgaaactaaggcacagcacaggcatctagtcctttatctgaaattacagagttattgacaaccttggtacctcacctccatgatacctcacctcctaggtgatgaaggggaagtaagaagcccggttcggggttgttggtcatttttcttctactgcctttcagattgtcttcaaccgaactgtcacactaaaagaagacccaggcaaaatatgaactgaatacatgtggccctacctcatcctggaggctgggggtgcccttcagcactccacactccgtttcaataaagaataactaaatccctctggcgtctctctgttgtctgcctttctaatatctgaggaccctggagaaatagtttgttagctggcagtggtgggtctcatatgtcttctggaagaatgcacttccccagaaaagagccagccacaaagtcactactgcacttggttctcaaaggcaggtgcatggctggaattagctcagcacttactatgataaacctgagaaccccagagatgctgttgcacagtcaccagtcctatggagggatctaggtttgtgtctttgtggctagagatcaagagacacatgaccccccgtgtgatcatttagaaaaaagccctgtcaactatttaagcatagtgagataaatcatgaatgctgttgtggcctttccagtttggggaccccagcaaactccctggatgtctatacggtgctgagatgagattcctggc

SEQ ID NO: 35355 - DNA, 1099 bp, Mus musculus
ttttccacctccgcgtgggtgggaggggcttgcctttctgttcttgataagggctgtttcttaaccttgattaacttgatcaatgctttgccggtttttttctttgtaatttctaaaatgtccagcaaaaatttctaaaatctgcctgtcactataaaaactatgtaactgaagttcttctcagcttttttttttctttccacattttgtttcagtgctgtgatcttctatctaggaaattctaggtttgtgatggagaaatacacagctctttttttctaagacaaaacatctgctagtttatttttacaattttgttacattaagcctgaggaaaagcaagctaaaaggatttttattccttttagtagcaaccaaactttgatagtaatgacttttttttaatatactgtatttttttaagaacaaagttaaaacttaaaaagaggctgaggatggaaggaacttctttgttctatcttcttcagaatgttagaagtcttaagaactcaggacaagcagcagacatacatgcaacatggtgactggtgagttaaaaatcattcatacgctggaagtatgtgtgcagtccgttaccccccaaccccttggtaatactgaaactttacaaatcttgtcattctttcttggtgttgtctgctagaagctgctacctactaggaaactgctgatgagggaaacggtattagtttgttcattggacaacagtccctaaaatcgaagtcagtggaatattcatgattaacattgcaaagcatcagctaagaacctaaatggttttccaaaacaaacagaatacaacaacaacaacaacaaaaaaaaactgtcctctttgttgaggatgtgtctgtgaactttttgtaccatttaagcttgcttattctagtttactttttttttcttttcttttttttaaaccaatgtttccatcaactagtatttacctgttaggtaacttctagttttctgggataaggtgttatacttctccaagatcttacacagttcacatcattttacaaaagcttatattgatgtctcaaagaaagacttaaggaatggttgaattttgttgtga

SEQ ID NO: 35356 - DNA, 1092 bp, Mus musculus
acaatttattttggggagaaagggaaggtttaatataaaacttaagtattttgtgtgtgtgtgtgtgtgtgtgtgtgtatgtatacacacacacacatatgtatatatgatgttatatataatacacagactatttcattctcattgccagttattgtgtctgtgtatttcgtgatttcaagatatacaaacagtaggattggtaaggtggctcagtaggtaaagccacctattgccaagcttgatgacttgattttgatccctgagaactacatggtggaaagagaaaaccaacttaagtgggttgtcctctgacttctacacgcatgtcttggcatgtgcatgcctataccccaataattaatgtaaaaaatataaaaccaatatgctaacagcagagtgttgactatccgttttaattttaggaaccctaaggactctgcaatatgaataattctctagagaacaccatctcatttgaagagtacatccgagtaaaggcgaggtctgtcccgcaacacaggatgaaggaatttctggactcactggcttctaagggaccagaagctcttcaggagttccagcagactgccaccaccaccatggtgtaccagcagggtgggaactgcatttatacagacagcactgaagtggctgggtctttgcttgaacttgcttgtccagtcacaaccagtgttcaaccacaaactcagcaagagcagcagatccaggttcagcagccacagcaggttcaggtaagaggaaatatttagttggagcctgttaataaacttttctcttctctcacagtttaggatagctacaacacacctatacagatgttagaaatgctggaagttattttattgtagtgtggaatctttcatatttaatatggactgataatatctttagccattgtaaactataaagtccacagatacttatttgctttagagagcttgaatagtacagaaaagtagaggccagcactgcatttgaatgtgagagcttcaagctgtacagatagttgtgagccttcatatggttgttgggaattgaattttaggacctcctcttgctccaactctc

SEQ ID NO: 35357 - DNA, 1173 bp, Mus musculus
caaattcagactgtgggtgctctttccccaccaccatcccagcagggctcacccagggaaggggaacggagggttggcacagccagtgtccttcagccagtgaagaaacgcaaagtggacatgcctatcaccgtgtcctacgccatctcagggcagccagtggccactgtgctggccattccacaaggccagcaacagagttatgtgtctttgaggccagacttactgacagtagacagtgcccacctgtacagtgccactgggaccataactagccctacaggagaaacttggaccatccctgtttattctgcccagccccgcggggatcctcagcagcagagcattacgcacattgccattccccaggaagcctacaatgcggttcatgtcagtggctcacctacggccctggcagctgtaaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtagcaggcacataccagaatacggctcagactgtacatatatgggacccacagcagcagccacaacagcaaactgcacaagagcagacaccaccaccacaacagcagcagcagcagctgcaggtcacttgttcagtaagtaagacttaatctgtagggtattttgttttgcttcctttggttccagtgtaacctactgagtacctgtagtgtctgaattatttaattccattatgattgttgtaacaatgatagtgtatgggggaaggaagagaaagaaacagtagatgaggtggttatcattcttggaattcaacaaaatgaccagtttttagagagtattcgggtagggtgctgtcttagttggtattttactgctgtgaacagacaccatgaccaaggcaagtcctttttttttttttaaagatttatttatttattatatgtaagtacactgtagctgtcttcagacactccagaagagggcatcagatttcgttatggatggttgtgagccaccatgtggttgctgggatttgaactcgggaccttcagaagagcagtcggcgctcttaaccactgagccatctcgccagcccccaa

SEQ ID NO: 35358 - DNA, 1173 bp, Mus musculus
gcaggtagcacccctggccttaaggactggagaatatacttggaagtatactttgtgtcatgatgagcagtgtctagtcttcacatcatgagtgagcaagatttatgggattgcccaagaccagatttttggatccctatgtttttagttagcttcaaggaaaggcaccaaagaaaaatgtcttttgggaagacctgggaggtgccagtgagttgtatttaaaccagtctttgtttgggttcatttatttgctcatagtacagcatggttgctggggttttctacatatttctacttacagaaaagaaacccgttggtgtaatagcgtatgttagtgcattaatagggaagttcagatcacagatgtaagtggacattcctagcctgaacactggtgggcaacatcctctctgaaccctccttttaacaatgtgagtaacaagttaggacatcactgttgccaagactcccattcacccttaggacttgtgttgcagggcgacagttgctacgatttcaggaagatctgatctcctctgctgtggctgaattgaattatggcctttgtttaatgacacgagaagctcggaatggagaaggtgaaccctatgacccagatgtactctactacattttcctgtgtatacagaaggtaggaaacatcttcacatgaacatgtttgaactgggttcccattgaatgttttcactttagcctaatttacttaaataacaagaattcatggcacagctttcctcccagcacatggggcagaggcaggctgactgacctctgacttcctgctggccaaggctacatagatcctgctgtttgtttgtttgttggtttttgttttgttttgttttgagacaggcattctctgcatagccctagttatcctggaacccagagatcagcccacctctgcctctcaagttctttgattaaagatatacaccattgccggcctttttttccttccttccttcctttcttccttccttccttccttccttccttccttcctttcacaaaagcttagatgtttactttagaaaagaatatataaaaatacatataattccacctagaaaaccatgagttaaaatatatttaatgagggccagtgaggtggctcagcccatgaaaatacttgctcaccaagcctggtaa

SEQ ID NO: 35359 - DNA, 1442 bp, Mus musculus
acaggaagggttagaattatgctattacttactgaaattcttcttcagccctcagagtgtgaaaggccgaaatgacaccttttacctgacacctgagccagttgtagctcccaacagcccaatctggtactcagtccagcctatcagcagagaacagatgggacagatgctgacccggatcctggttatacgagaaatccaagaagccattgccgtggccaatgcaaccaccatgcactgaggtgcctcagctataggaaaaaagatccaggaaaaaccagacagactttcacactaaaggagaggcctccacatttttttttaatttgtagttatgatgcttttcaggctacttctgttcaaaatgtaaaagacgatattgccctctttgcatcttcataaaatgggcagacccctggttcatagggatctgggttttctgagaacctggtgtcctaggaagtggttggctttttcttttctctttttttcttttgtctggggcgtggggaaaggaacttggactgtatggagagatacagacccttcccttcctcagggaagatggagctgctgatgcatcagcctgtcactcggaatcggcaaactttactgaccactcagagccacatttgttttttgttttttgttttttttttttgtaatgctcagacataaacttaacatcttgatggaagaagaataaggggaacttcaattatgatttttatccagacaatttctattacacccttctttatgacaagtgacataaaagttaaagtaaaaactttaccatgcgcttttttttttttttggcctaacattgaggccttaaaaatgaggctcctgtgcctgatggaattcttgtaacatacacttgtgtatcatataaagataccactctttctcttatgtattcttattctagttgtttattaagaatgacaagcacgtcttttcaacaagctactggagaacgtgtctttatttgggggaggagctctgcgggggcgggggagtggaaacaaaacttaattgaatgggcctggatcctgctgtggtgggatgcggggaggggtgggacaggaaacaggcctttggccttgggcctgtgagctcgataagcacgtggttacccagctctgccagctccgcctctatacggggcgtggccctcagtacgcacgccctacgcctggcgtcatcgacgcacgcaacgtgtgacggaataatctagtttatattggcgcggtccggacggcagaggcctctgcggcgcggtcctcggagcggcgcggttctcggagccacgcgtctgtcttcctccgtggtcatggcggactacctgattagcggaggcacctcttacgtgccggacgacgggctcacagcgcagcagctcttcaactgcggggacggcctcacctacaagtgcgggt

SEQ ID NO: 35360 - DNA, 1442 bp, Mus musculus; identical to SEQ ID NO: 35359

SEQ ID NO: 35361 - DNA, 1454 bp, Mus musculus
aagaagctgatggggaggctgagctggtgccccagttatgtgtcctagaggaatattccgtcccctgcgcacatgctgcccatgtgacaggcgtcaagatcctaagtcccaagctcatggtctcagcctccatagaccagcggctgaccttctggcgtctgggacagggtgagcccaccttcatgaatagcactgtgtaccatgtgccagatgtggccgacatggactgctggcctgtgagccctgagtttggccaccgctgtgctctggcaggtcagggacttgaggtttacaactggtatgactgagttatcccagtgggtggagaactgagcacagggcctgactgcagacagtagagcagggatcagctgtctgtgtcacgctcagtgtgctctggggaggcgaggcagtaccatagttctcgcaagtattccagtagggtgttgcataggaggaccaagaacacgcctcactctcacaataggatgaaactgtatttattctgactttaagtgcccaacatctgtgaggtcttgtttctttcccagttgatgcttttataaacattcccagttattgggcccttagatgtggctcagcggagggaggcccagcatagccaagcctgtgtggaacacctcacgcactgccctcaaaagctgtaggcgagcaaacatctgaccaaagaggtgtggccgaggttcctgaaagaaaagcagccaggcgcatcctcatttcccgtgtgctcagccttgcccacatttcccgcagaccccccttgctgtatgctcacccctagaatatgtactcggttatagtaggagctgaaatccatgctgagctgcaccaggaacttgcatacctagagacagacgttgagtcgttgagctgttgtcttttttcttgtgttacaacccagaataaagaataatgtgtgaaatgtcttctgtgccttaccatctccgtgcggacagggatgtggaggcctggggtgccggccagactcacagtctggctcagcaggtccagaaagggaaggacactgttgaaaagcagcagccactcaccctgcgggagacaagcgtgctaggaagacaagtccaagccttgtggacgtttatcaggaccaacactcacctcatcatggagtagtgagaagtccagactgctcacaagcggaaaagtgggatacagaccttgctccgttccatgtttgtagccctcgaagagtgtggcaaggcgggcacagttatacatgacaaaagtcccgctctttgtgccctttgttgagatggtgctgtgggccaggaggagctggggaatggtaacatagctgcagagggccttggctctgtacctgcatcctccgtcctggtgtcgggaggcttacctggctctgtggggctgtgcttagcatctcaaatttgatggtagccacggagaggatgtcg

SEQ ID NO: 35362 - DNA, 1757 bp, Mus musculus
cagttacttacctggccttagctggacagccagggcacagagcagagcaaggtcgcactgcaggcttgcttttagtcttgaatgtgaggtttttcgctaagtcaggccatccagaccagcaccacagcagaggtgggctaccacacctctggacttggagactggttcagcatggtgcttccttttgtttcttaaagaaaagaaatccacctttgagaggagttgttccccagatgagtttctttttccttggttgttccttttgatccagtattcaagtggtgtactctgacctgggtcactgtcttgtgttcttatgaacagagttcatgaggtcagagttcagcatggctcttagaccaagggcatgggtcttgtggctcaagagctaggtttgcacaagttctttttctgttcacctagagtgtggccagaagctgctccagggtggggtgtgtttctctttgcctagttgcagctgccagaagtccccatctctatggtctgggagtctaaggccaggagaatccctggtttgtggtctcagttcctgtactagaaggggctggccagaagaaaggaccagttcttgcacagtcaagtgcaagggaacaggcagcttgcctggtgtccttcctatcttgaacctggtcctgtgggcctttgaaaagttagatctgtgatctctggggtttccatggctttgttcagtgcctcccctctgagactggcagagctgtctatacttgacaggacctccttgaactcctaggagagcctatagagaaatctgtgaatattatgatgcagattctttgatattcatacattttcacctccagtcagcaatttcctaggtaccatgtaaagctgtaaaattgaattattcttgaagccaggtgacagctgtgacgcctggggtacatggagctgcacgtcctctcccacctcctcaggtgttttgtctcttcatgtcatccctgacaagtgaggttgggaggtggattgggagtaatagtatagtagagtatggtgagtgaaccctaacaccaatgggagctgattgtgacccaggagtgtccctgctgcaggcccagggtggctgtgatgctctgttagcacacagacctttccatcaagtcctgccagtggcactgccgtgacacagcaccagagttgcagctctgcagcctaactcccccttggtactttctgaactgcacagctgccatcctccactcctcagctgtgaccctgaccattggcactgcaggaggctctgccaacctgtagctggtggcgtctcatctgtggaaacctttgtttttgcaccctcagtggttgtccttgttaacatcagaacatctgaaaggtcaggcagaggtagggtttggcttggtgtttttaccctgcaaagggtagagaaaggtgtttccatgacctgaccagattcttgtctttcttcaaagaaaagttgaggtaatgtcatctcgaaaagttgagtgatttattcaaaataaactcattttctgattataaagcctgtggagtctttttttcacagtgtacaggtgactgcctttgttcttccctgctccttcagggctcttgagggcccagccagacttagcactgcttttcttgctcagtgttgtcctggctatcctggaactcactctgtagaccaggctggctcgaactcagagatccgcccgcctctgcctcccaaatgctgggattaaaggcgtgtgccacca

SEQ ID NO: 35363 - DNA, 1149 bp, Mus musculus
tgccagatcaaattcctacaaattgaagatatgttcagagagtctcccacacagtttctcaatttcacaattgaaacatgacccatttgttaccccggtaataaagataggtatatataggtggcacatatttgtaatctcagtgttcagtgttggagaggcagggacaggtgggttcctgagacttcctgctggccagcctagcctagagtttatctcaaaaggggcagggacggggtgggggatgactaacccgaggaacaacattcagaattaacctctatcctcaaagtatatgcacaggtgcacacacaccaaaaaaggaagaaattttatttaggcagcccgtgttctagatgaccagatgagacgcttttgggtacatttttgtttgtggtgttcgggtgccccttcacccaactctcttgcctgggtgttggaggagggtgtggttgccttgtgaagataaatgacttcaccctctttctgtgcagacttctgctggatgtgtctaggagactggaagacgcatggtagtgagtactatgaatgtagtcggtacaaggagaatcctgacattgtcaaccagagccagcaagcacaggccagggaggccctcaagaagtacttgttctactttgagagggtaggtatcttatctcacaccagagctttcagagcaggctttccccactcggcctgctgacatgagagcacagggatgctgtgtgcacgtggggagtccttgatgagctcctgcacatgcaggcagtgcctcctacagtatggtttcctgcactggcagggcagcgcctccgacagtgtggcttctcagttgtgcaggacgatgggctattcccttacttgagtgatggatcatggtctgtctgttccatagatagacatagagtaagccaggcagtggtggtgcatgcctttaatcccagcacttgggaggcagagacaagcggcagatttctgagttcgagcccagtctggtctacagagtgagttccaggacagccaaggctacacagagaaaccctgtctcaaaaaaaaaaaaaaaaaaaaagaggaagaagaagatagagcaatctgtgggcctggctacccgccagtgtttgtcataaacttctgtgttgacctctg

SEQ ID NO: 35364 - DNA, 1222 bp, Mus musculus
tttacctgtctcttggtggaaggatttcccttgataaacatagtcaagggagggggaagggttctaaaagaaactagaattgagataggaagctgggctgggtggtgtgtagctttaattttttaaaaaagatttatttattttatatataagtacactgtagctgtcttcagacacaccagaagagggcattggatcccattacagatgattgtgagccaccatgtggttgctgggaattgaactcaggacctctggaagagcagtcagtgctcttaactgctgagctatctctccagcccctcatgtctttaatttcaggacttagaggcagatgcaggagagttctaggacagccagagttacactgagaactctgtcttggtgcagggtgggggtgggggattgagataggctgtcatgggagcagggctagggctttgatattttgattgttgaatgatttccactttaattgttcatagagagtaatactttttttcctttctcttagaagacaatacacgctaatgcatttgagaaaacgataaaaattgggggtagggaaaaaagcaactgtttctgcaactttgctggatgttaagatgtctgtggacatgaacagccaagggtcagatagcaatgaagaggactatgacccaaactgtgaggaagaggaagaagaggaagaggaccctggggacatagaggactactatgtgggagtagccagtgatgtggagcagcagggggctgatgcttttgatcctgaagagtatcagttcacttgcttgacctataaggagtctgagggcgccctccatgaacatatgaccagcttagcctctgtcttaaaggtgagttgttctgccagttcaaatgtaatctctcaggtgaaactgaaggatggtctgttgttaatcagtcactctcttgtagcttgaaacccaaacctatgtatgtatgtatgtatgtatgtatgtatgtatgtatttggatattttgtcacatttacttggttttttgttttttggttttttttttttttttttttttttttttggttttttgagacagggtttttctgtgtagccctggctgtcctggaactcactctcgaactcagaaatccgcctgcctctgcctcccgagtgctctggggttaaaggcgtgcgccaccacgcctggccacatttacttgttttaaaatataaacatgtcc

SEQ ID NO: 35365 - DNA, 1190 bp, Mus musculus
ttgttttctgttacctggttaagagaaggttccagtggctggagagatggctcggtggttaagtgcacctgttgctttgcagagacaacccacatggtggctcacaactgcctgtaactccagttccaacagatcagatgtcttctgatgttcttaggcaccaggcacattcatggcacacatacatactgactgccaaaacactcacgtacataaaataaattttaagaagagctccctctataaccaaagatgaccttgaacttccgatcttgcctctccctattgtgttttgggatgacaattgtgtaccaccacccctggctttatgcagggcaggggattgagcccagggtcttgtacatattgtctcccaaatgagatatatctccagcccttgttgtatcttcttttcatttttaaaatatttattttgttattgtatgtgtatgggtgttttgcctgcaggtctgtgtaccacatgggtgcagtacctgaggcggccagaagagggtgtcagatcttctagtattggttcagactgttaatgagccccctcgtgggtacttggaattgaacctgagtcttctggaagagcagcccaatgttcttaactgctgagcatatctcaagccccttgtatgttcttttagtaaattttcagagttagtttgggtataaagagagaactgagtcagaattatacctcaacatgaaaaaaaaatagttaatgtttaagcttctcagggtgcaggggagtgagtgagactttttgttttttttttcaaggcagggtttctctgtgtagccctggctgtcctggaactcactctgtagactaggctggcctcgaactcagaaatccacctgcctctgcctcccgagtgctgggattaaaggcacgtgattcgacaaggcgtcctcagtcttgagccatacaggttacaggtcctgaaaaggcacaagagccaccagggctggcaaggctggcacctgggagctcaggggaggaaatcaggtatagcattgcttgtactctatcaacactttagcccataacaggctctgagagagtctaagctacggatgaaggtgttgcaatgggaggttctgtttctggagtcatggtgttctgaatgtgtctagatacattaagggcctccaggtgtgagcggttttgttttattttg

SEQ ID NO: 35366 - DNA, 11367 bp, Mus musculus
tacttaaactgttactgtaaacaaatcattctctcccacaccttttttaacaatgcagttatggatgttcaagcatttgagaggcttctgggcccctgcatggacatcatgaagaggaacatctcacattacgaagaacagctggtgaagatgtttggctccaacttggatctgatggaccccgggcagtagatgtgatgaatcttggagccttctcagtgtgataccaaaaccttccagtcagccacaagaacacacacagaaaacagacacgacagaaccgctcctgctgctgtctccgccgctgccattgctgtggttaagggcatttagaaatcttgaaagtcagcactgaaagatggatggaggttccacccacacccaccctccactttgcttctgaacgccgtcattagaccacttatgtcatgagtactccaacccaggtttcacatttggttcagaatgtctctccagcaatttaagtgcctgattcaaagtccaaagcgtaacaccctcctttcctctcttgctgctaacgttgcttctgaaagttctaaggtctgcagacacctgttgagtagctgtagacagcacctccgcagtccttctcgagggagaaaatggtagagccttccgtctcgtttgtcttttagaaagtccacagtgtgttcacaatgctgctttactctcacagtggaaggtggtagcagttatactggaggtctctgccccagaggctctgtaccatttgctggcagctacacactttacagctgtgtctaaactcagaaagaggcccagcagatccgtatgggcagattgagtactaagactcacgttagcaggaaacttggattcaacactctttccagtagtagccaggaaaggttatctgggttagggtttttgttgtttgtatttagtaggtttttgttttgttttgttttgtttaacctctgtgctgtttacataaacaaattgctatccttttctaaggagccaggggtggctggttagctcagctggtcagggcatggtgctgatatgaggagccagggtctggaggtgttgtcactttatctgacctgagtacttccctgagtgagccctgcctgtccctttcactggctgatagcgggaagccagcaggaggctgtgctgcacagagaactccttcccttctagcgttactgcatagcgtgcctagaaatcatcagtttttaaactcttaacaaagaagctatttttttttaaggaaattatttctctatttagagaattcaccttggatgtattcatatacatggagtttgtccactgactcaggcatttgtcctaaatatccgttttcaaaactaggtatcattgggggtaggggctgggtgcagctcggtgacaaagcacacggggcacgtgcaaggctctgggtttggtctccagcactgtaacagccacaggaagacaagttatcatgtagaaatgtggaattactgtgaaggcctttctaagtaacagtctcgacttttgccatggtcaccatagccaagaaatgtccaaagcaggtgagttgccacaattttggtaattagtcactttttcttgtgttccatgaggtaaaagcaggactctccaggctgatctgagtagcctacgttacagatctgggaattgtacagtcgtaactactactatgaagcaggcagctagcactggaaaaccctcaaagtgatcccgaattttcctaaggtccttttctatggtattgctttattaaataaatcaggccttgtactttgacagaataacacctgatttcttgcaaaggtaagaggtgcattgggctccaggagtagcccagaagtccaaccccagaccttataaagactctgaaccctcccccaccctccatgccagcgttggataaggctggctgtgactctcctgccagagttattcctgtaggctgctagggtaggccttcgcctgccctcgcccttcccgggctaggcttcagagtcctccttgtcacccttcctgcctcactgacagctgctcttttacagagaaggcatcaagtccaagttctgctgtagccactgattgagtcttcgctgcagtgtggccctgtgttggggcacgtgtgacggggtcatgggagaggtacacggagtctgcgggagctccggtggtggtgaaagatggctgtcaccacagtgccaggccctgacagtattccaggtctctctgcagcttagagaatcagaggtgacagaccaggtttttctcacggttgcagggtccccattgtggcaggcaactcccacagcagatggctgggccctaggaggagtatcagaaagattccttaggtagctcctctcttctgagggtgcgcctttccctccctcctccctggctttgctattgatttgaaatgacagagaatgttcctcagagccgtgaggtccagctgcagtatttctcttcctttctgccccagcttagcccactcactgtcttctcttggttgaattctctgcaggacaggctcttttgttctcatcctcaggctcatagtcttcttaaagaattatatgttcctggtatagagtctcagaaatcagcattgagcttttctttgagcagtttagtaagcaaattcagcagcaaagtggcaaaagaaaaaagaaaaaaagaaagaaagaaagaaagaaaaagaaagccctgcactccagccggaggggcctcatgcaccctgactgcccagattctctgcttgtggtggcggagccgctatgtgctgctgctggtgtcccagcgccctgtgcacacagcattttatggcgtgtcacagtcttcattttaaaaagatgaaagcattttgcacagagaaagaaaagacccatgaatgtcatcttttatctttctcaaatcagttgataatggaatttttgtttttgataatgcacttgtaagccagtctccccacgatctgggtagtttttatctctcactacagttacctcttgtctctcctgtcttgactgctgacgttctccgtgattctgatgtctgtgctatggggagcagccttcccgtgggattcctagtacactctgcagggctatctttataaaaaaaaaaaacattaaaaaaaaaaaaagagtgaaaattgtcgctcacctcatgggggatttgcagaaaaccatttagcccaccttgaacaaagattagattccttgtttttttgttgctttgtttttaactcattgtaataatttaaaaaaaaacccaattaagaattattgtgctacctcaaaggtaaaatgattctaaggtcctgagttatattcatggtgtttgaaatgtctctcaattggaattatgttttaaatcattggggtaaatcttattttaacctgttttacacttgtattttaatctcaaaagaatatatgattggaaagcaaacaattcttgatctgtagccttgaacatataattaaaagtcactagaagttaatcatagtttgctgtaaacaaggttgggttgtttttttgtttgttttttaaaggaaactctagggcccggcttcactcttgactaataaaggctgacaaatcatgtctgactttcctggtgtgtctcctgttgtatatttttcttctcttgtaagggttccagacatcttagcacttacctggcaaatacattattgggattgataggacccttgaaaattagggagaagtcctggacatttgtggtaactaggttccacagagaagcaatcgatgtgggtggggtggatgacgagagaagggttctgagatgtgtggcaagggattgctccacgtgatgaagattgaggcaaggtgaatcagcaagccggagaccccgaggaacaggggtttcgttctgctctgaagttcagaggcctgagaaccaggacagtcagccgtcgctctcatctgaaggtcagcgggcttaagagttgtgaaaagcaaattcctcaacatgaggctgacagcaagagacagcatgggcaaggccaaaggtcagaaggaaaattctttcccacttgaaggaagcaaagccagggccctgcgcatgttagaaaaacactctaccattgagctgtgtccccagcctggccgagtcatttcaggctttcaaactgagctggtcgcataaggccttaccacattaggcaggtcaaagtgatttattccatttaccaagtaaaatactaatctcatccaagtcatatactcaggagaacacccataataatggttgaccaatattctataacccaatcaagtggacacacaaagtgaactgtaacagcatggcatattgctgtaggtaagatcaaggggacctagcgtaccccttcccaaaagataccagtgatagaaaccatctcctgtctgccgggatgtcactcctttgtgttactatagctgaacacgtaagcatggtagcccactgtcctttgtctttcctagagagcaaaggaagctcactggatggtaccctcactagatagagatgcctgactatagaaatgtgccaagtgatagggacatgaattacctacctaggtcccaagaatctgatagctggtcctctaaaagccaaattggccatgcctcaagtctttaaaaactgaatgttttcttttctgtggttgggggtggggtggtgtctgtgtctcagtatcatgtccaaggtcttagtcctgaagagggcatgttacatgaagattgctttttgtgtataatgaaccaagaggctaaacatttattctgtcaaatttgacttactcaggaatcttaatgacaataaaatcttataacaataaaattagtgcctttaatctcagcacttgttccaggacagccagggctacacagagaaaccctgtcttgaaaaactcaaataaatagatagatagatagatagatagatagatagatagatagatagatagatagatgatagatagatgcttgttataacacagaaggaaataggggctatttcgcaaggcatcatgacaagtgtaattttggtcctttggagttggtggggtttttgttgtttgttcccttgattttcgagaaggggccttaggctgtagcccctgctgggcctaaacttgtaacagtcctgcctcagcctcctgggatctaggcatgagctgctcgctccctgcgtccagaggtaaatggaaagttttgctgtatctgttatctgtaaagacaggtttgcctcgttacagattatggcagatggcacacagcttccttactggttttgaaagtgtggatccgagtgttaggaacataaaggatatctaatcctgaatttggatgacaattgccaagttctgaattgaaatgtcatatgttagatgtgatgttgttcgtggctttattggacagatcctgatggccaattgtgagtgtccttgacactttaagccaagggtttcaacagtaatagtactgtggtccaccagggggtcctagagccttttaccattgctgatggagttcattgcttgtatttttggactcctgtggacggcagccatggcttccactttaaggtgtctactgtcttaggctatgaagctagctagctccccccccccaccctttttaaggttttgagtttttttgagaaggtcttgtgtgtgtgtgtgtgtgtgtgtgtgtgtgtgtgtgtgtgtgtgtgtgtagccctagttgtcctaaaacttactctgtagagcaggctggccctgaactcaaagatctgcctgcctctgtgctgggattaaagccatggcactatcgcaggccttttgcctcttaagtggtttaaacacttaggcacacagcgcctcctccttctccctcctttcatgtgatgcctctcagaagaagcaaaagagaagactggattggtaagagacacagactcctcaggaattctcgtcctcgtttcacatcacttgaaactgaaagacccacaacgtgaggactcccccacgttctgactcaggagaggcgacaccccaaaatcacccacaagaaacgggtcttgctgcaaattgcaagaggatttttattcaagagcgctctcgggcccatggtcatacaccacgcaggggtagaggaccgtggcgccccgagtagctgggtaagggggtatttaaaggaagaaaccgaaactcaaggaagtggggagggcgttgttggaagataccaaagataccagttaagagtcacaaggaagtgtaaagttacaagagtcacaaggaatacctggtaattgttaactctcaagacagcttctaagagcccctaacaatagcacatttgcattgcaggttctgggtgactttctttgaatgagcactctttgaacccaggaagcgggtgggtcgctatctcttttatgattagcatacctttacaaaggccacattcccaagcctgggcctaaaggcctagaattctgtttttacgttgttgtactttcaaaacttgacaacggttggccagagatgcgcttttggccgaagttgctttctgttcagacaggtggccaagaatcaagttttcttgtgggtgtccattttgtgtgaccttgagctgcagctctgcagttttccacttcggtcagcagggggcaggctatccctgactccctttgggctcttggccttctatcctagaactgcagccaatcccaagtgagaaactcaatctcatccaagtctcaagtctccatcagcctccaaatctcagctcagatcccaaatgagagacagttccccaggcaaccacagcctcgagcagagcacagtgggaaaacgtgtccctcagaccttggcgtttaggtcaccatcccaagctcctggcggacgctgcccaaaggacaaaagggaattctgatctgggcctcagattgcccctctgggaaaccacatacttaccagagggtagctatccgttctgccctagcttgttttgttttgttttggtttggttttggttttggttttcgagacagggtttctctgtagccctggctgtcctggaactcactttgtagaccaggctggcctcgaactcagaaatccgcctgcctctgcctcccaagtgctgggattaaaggcgtgtgccaccacacccggcctgccctagctttgcctagacccttgccctatcagctggtgactttagtaaaggttagttagggtccaggggctggtttgtttgctccttgtgctctgctcaagactggaatgttctggatcatagcaaaaccagcccccactgcctgatacagagtggaccttctaatagttaaccaaacaagctagttttactaaatagaaggccaggctcagggtcagcaagagaactcaatgggtaaaggttgtcaaacctaacaagctgaatttagttctctgcaagaatttattcctgcaaattgtcctccgaccttcactccccatccctctgtgtgtgtgtgtgtgtgtgtgtgtgtgtgtgtcattaactcatatatctctcccatccattcctatacaaaatttaaaaccttaaaaatgtatttaaaaaaacaacaacgcaaaggcctggcacacagtgtgaaggcaggggcgcattgagagtgtgggtggaattggggctcacagactgggcatccatccagcacaatgggaatctttcagctggcccctcagggctgtgtgctgcctggaagcactggggacattggggacattggggacacagtgtgcatgtctaagatgtgctgggaaccgcctccaccctggccctgtggaacacttttcttggtaattttcctgttttgttctgggagaatatcctagcgatgatttacagcagccagctcccttcctgaatgacccatgatctgtagctgtggagagggatgggctcagaggagacacgaatatcacttccagccccagtgaggacactgtgtctctagccttgagttgtgtgtctgatgccaggtaccagagacccagggcagactttacaccatgaggactgggaggaaaggcacaaatttaggagcataaagggaaggggattctgataaatgacaggtcccaagtcaatattacctccttccaggctcagatactagcaaagaggggtgcttcttaagtccccagatacagccagaaaagggcagagagcagcagcctaacacaccagcccagagaccagatttgatctcaccagactctgaagatctccttcagtatctgctagccatccttctccagggtcctgaaggccacgcgtaacatcttgtacccctaccatgatgccgctaatgaccttatcatgtttgcaggggcagaaaccaagccatgtgctgccagtgtcagaatcctctgtatctgctaacgatcctatagctcctgctccaagactcggcctccttcttgacaccatcctggagacttgcttgtgagtgccacgccattacccctgtcacctctcactctttccacaccctatccatgcctccccaaagacttttagtgacaaccagtgtgtgtgccagctgagcgatgcgcatctctccggtttccttccccatcccgatcactctcctcttgagcagctgcaatagacagaagccgcaggggtctgggatctcccttctccttccccaagaacagggatggcttggagttttatcgccaccaggctgcagggccatcttagacataggtgctcctcggttctgtcccctactctctgtcaacagcagccgcagtccacagtggtcccattaaccccactgctctctcactcttggccttcattctggctcctagccccagttttagtcattcttcaggtcactgggtagggtgagtggtgcaggctatcagtgtctatacaactatcgtttgtatctacatatctttttgaatgggatgccatgtcaccctgggggtggccttgaaatcacaattgtccaaccatggccttctgagcctgctgctcccttctaactcatcctcctccatctgctcttcttttcttcttcctcccaccccccccccaccgcctcctgttgagatggagacttggctatgcaactctgcctggtttggaactcactatgtagaccaggctggctgtccccaaactcacagagatccacctccacctgcctctgtctcctgagtgctggagttaaaggttaaaggcatggcactacaatctctctctccccctcccccctccctctcctactcccactccccctccccctttccccctcttcccttcttccctccccctccccttatagcgattctccagtcctcagcaaaactctgagatgagaccatacttgacatttctctttggatatgggggagccttactgtttccttgattgaacttgagttcctctcaaaatcaaaacaggctgcagaggtagctgttggtaacatacctgctaagaaaacatgagagagaactgagttcaacttctagcactcacattttttaaaatttattttttatgcattgttgtggggctgtcagattcctggaactatggttacagacagttgtgagctgccatgtggttgctgggaactgaacccagatcctctggaagagcagccagtgttcttatccactgagccatctcttcagcctccacatttttttttaaagcaagccgtgatggtacacatctttagtattggtactactcaggaggtagaggcaggcaggtctctatgagtttgaggtcagtctgcatagtgagttctaggactgccacacttactgagtccctgactcaaaaacaaaaataacaatgaaaaataataaaaaccacagggcagggggcctaacggacgactcagcaggaaaaggtgcttgtctggcaaacctgaggacctcagtgcaattcctggaaacccacggaaagggaaaaggttggaagcaacttctcaaagttgtctcttcgtctccagatgtgcaccatggcacagatacaccgccacacacaaaacaaacacacaatagtaattttttcattttcttattctcctctcatatattacatcccgaccacagtttcctctccctctgcttcctcagtttctcccccaaaacatgcacaataatgattttttaaaaaggcaggcccatggctgtaatcccagccctggaaaggtggagacaggatccctgggacttactggacagaaaaatcggcacgatccaggttcagtgagaaaccttgtttcaaactaagtgtgatagagaaaaattgaggaagataccagatgtcaacctctagcgtctgcatgtgcacacacatacacactcacacacacacacacacacacacacacacacacacacactcacacacactcacacacacatacacactctcacacacaaacacacacacactcacacacacatacacactcacacacacactctcacacacacacacacactctcacacacacacacactcacacacacacactcacacacacactgtcaagaaaaggtgatatcagcttcctctgggcttgctgtcttttgagacaaccatcgttagaaccttggcactgtgttttgatgagacccagaacagaggaaaaaggcaatgtgggtgttcaggccccaagcaaagcctcccgcctgacgtcagtaatgggatctcttgcctctgaaacaatagaagtgagacccagccagatatgaagaacatgacaggcaaaagccgcactgggacttcagcccaaacgggcaagcagagggaagggtgacactgtttgtgaaggagaccagagtgatggctgagccaagggggtgggggtgggggaattttgttgaattgttggcagaggggctgctcatcttgtaactttccgttggctatgggtagagtttcaaaagctatttttcttcttgtgtacaaatgcgctagtggctccattttttttccttcagatttataaggtttaaaatgttacgtgtctgtgtgcatgaatgtgcatgctggagttcaggtggatgtgagccgtctgaccctggtgctgagagccaaactcaggtccactgcaagagcagccaggcctctctccagcacccactctgtcatggtgcataaacatccgtgtctttgggtttactctgggccttttggtgggatttcctgtgtctgagctgctgaaagaaagcacaaagatgccgggcgtggtggcgcacgcctttaatcccagcacttgggaggcagaggcaggtggatttctgagttcgaggccagcc

SEQ ID NO: 35367 - DNA, 1174 bp, Mus musculus
ttctctggatgcgtggctggaatgattcattcattctcttctccacagctttgagagccatttagtgttgagtaaaatagagcagtgtgagctgctttgttgtcccatagtctactggccagtagtggtcagtccccctctgggggcagttgcagtaccattccaggagttgctgaaccaggctgctcttcctacagctacgcatggagtacctctccctgatgcatgctgtggtccgctccacgccctacctgcagcaccgacatcggctgtcagacctgcaggctacactgcggcgcatcctgactgaggaagaggcctcaccccagtgccagatggaccgtatgattgtccaagagatgtacaaggaattcccggacctgggagaggttcccagctagcacttctctttactcccttctctgcagccctgggagggtgcagagaactcaggggcttggctctaaggatgttctgcaccgacactgcgaggtgataaaagattagaagggacctgagccgggccccttacctaaaggagagtcagggtaaggggccagatgtaggattggggaccacagtctgggaactgtattggggcagaggaaatgcgcaaggctgaataccctctgtttgctggtaggctgcctcttcagcatgccacccccatcccccactcccatgtgcatacccagagtcctgctgctgctccaggctgggctgctgccatccctacctgctgtctggtctgagtcttgaccctcagcaagccatgtccttagggtgagggaggcaccttctgccagctctgttctttgccttagctttgcagtgagtgttgctcatgtgcagcccttcccccatagggactgctgtcccctgaccccctgctttcagccccagaggccttggccagactgttgccttgaaagtgggatcctagagacaggccatccgtcctgcagccccatggaacaggatgatggtgctgagaaagccaatgatagaatctattttctctggaaaaaaaaaaaagaataggccaaaagccatgtgtattttcctatgtactacagctcaccttcagaaataaattacaggcaccaggagctgggcttccctgtatgatgatgcggggagacgacggggagggtggcgggggctcaggacctca

SEQ ID NO: 35368 - DNA, 1169 bp, Mus musculus
caatacagcatgaatagcaataccgctagtatgcatagccagatgtttcaaggatacccatctgccctctgaacttgagaattgtgaacaggctgtcacatccatccaatattcacgtgggtgctggagatctgaactctagtcctcacacttatatgagaagtgccttagctgctgagccatcaacccagtctttcccccttttaatggaagaatagcacaccatgataagtgcaatattcaaagacttgcaccttttcattagtttcctggctattcaattactttccattgtaatgcttatttaatcatttatccatatatctactgatttgtgtatttttatagatttatttctttatcttatgtatgtgagtacactgtagctgcacatagttgtgagccttcatgtggttgttgggaattgaatctaggacctctgctcgctcctgttgaccccgcttgctctggtcagcccaaagatttattattattatatataagtatgctgtagctgttttcagacatgccagaagaggacgtcagatctcactgtgggtggttgtgagccaccagatggtttctgggatttgaactcaggacctttgtaaatgcagtcagtgcttttacccgctgagccatctcaccagcccctgatttgtgtatttttattgacttatatatgtattcaacatgagtccttaaattttatacttatatatagtcagtcagtctgtctgtccgtccgtccatccatccatccatccatccatccatccatccatccatccatccaatctatcatctgtccatcaagatctatgttaccttaacatgaataactttcctatttcagtcttcaaagaggctgagtctgtaggatcacaggactgcagtgggttggttaatattcttttgttgttgttattgttgctattgttatttgaaacatggtctcactatctagccctagccaacaggtaactgatatcttactatctcagcccagtactgggactgcaagtatgtaacaacacacctggctggctcccttcttaatattgccactgaataagaataatttgttcactggaactgggtgtggtagcacacactttaaatcccagcactcgggaggcagaggcaggtggatctctgtgagtttgaag

SEQ ID NO: 35369 - DNA, 1169 bp, Mus musculus
tatatttgaccccgcctctactttatttgaccccgcccctcgtccagctccttcgaacccctccaagtaccacatctgataccctcctaccctttactttgatcccaccccaccagccctattggtctgataggcatccctgcttttgttgggtaggctacctagatttctggcttgatcttagggtacctcagtagctaggactttggctttgcctgactcctgaaagccccttctagtatcttccctaatctctgggtacaaaagggaggggcctgtctgagcatatatatacgtatgtgtatgtgtgtgtgtatgtatatatatttcccatgctgcagcaagttctccaaacctaggggcaactcattcccaaaccattcttctgatagaggggacaaagcatggtcacacagggctagaagcaagccgttctgactctgggctatgcctggggtttaccaggtgcttctccttcggtgttgactgtccccttcttctaggacaccatggccatggggggtgagctgcagggcctgaaagtaaaacagctccacgtgggaggcctgccccccagcagtaaggaggaggggcatcagggtctggttggctgtattcaggtgaggactgtcatgagaacatggtatggggtcactggggacctgagaaatagcattcaagtacatgttggcatgggagtggggccaggtgacacagagagaccagagacaaatcacaccttcctctgggggaagcaagagtctagtttagaaaaatcaagggtcatctggaatctatgttagaaacagcacagtagggatccttgtgtggggtcgatgggggatatttagagggtgggcttgtagaaggaatagagccttcatgtcagggaccatccgactgggtgtctggttccataggactgccttgacgtgtatctcaccctctgctgtctgtgcctatagggggtgtggattggcttcacaccctttgggtcctcagccctgctacctcccagccacagagtgaatgtggagcctggctgtactgtgaccaacccctgtgcatctgggccttgtcctccccacgctgattgcaaagacctctggcagaccttttcctgtacctgtcggccaggtgggtgttgagagagttggggaaggaacctg

SEQ ID NO: 35370 - DNA, 1149 bp, Mus musculus
ccccacccctgcacctgtcacacacatgctcacagacgcacacaggagggaccttccttctgcactgaactgaggggagggcttgaagaaggctgccttgcgatcagtcctgaaggctcttcagtcagcccaaatcctctgcaacccctggtggctcctcattcgctggtcagcccctcaggagtgaccctcgcttctgggaactctgtggagttgaatgtagaagtggaaagccatggttcagaggagggaccttgcctctcagccctcagcaccttcatgcctaccccaggactctgagccctccctccacacacccatcaggaccctagactcattagcaaggctacttggctgcctcagtctctcagtgctcagcaggacactgtctatgttcagatactaaattcagcatccagtaaggcagataatgtgacaaatctccacatctcaaggagttcatttctctaaactccctcaacagaggagatgagtgtacagcttgtactgtgccaaggtcatggcagaggagagacagaactcaaactcaaactcttgtgattctaaggcctgaatccttcctcagttgcctggcactcaaaccccaaggcttgacagactgtaggggactgtctcctaattacctttcagcagccctcaggacctccaggctcccaaggccctgcccctccctcctttatggcctctctcaacgctggggtctttgctcgatcctctgggtccccttgccccatccccagagacccattttccttacagctgtctctcatcctgaagagagcccagaacttgtcctggcagtttcagagagagagagagagagagagagagagagagagagaagaagaagaagaagaagaaggaggaggagaggaagaggaagaagaggaagaggaagaagaggaagaagaagaagaagaagaagaagaagaagaagaagaagaagaagaagaagaagaagaagaagaagaagaagaagaagaagaagaagaagaagaagaagaaaggaggagagagctcctattggctaataagacctggcaactccctagctgggtcctgcttactgagagtcccacaactcttccctcccctcccctactttccttctcagattcctgtgtctcc

SEQ ID NO: 35371 - DNA, 1099 bp, Mus musculus
gcagaggcaggcatatttctgagttcgaggccagcctggtctacagagtgagttcccagacagccagagctatacagagaaaccctgtctcaaaaaaccaaaacaaacaagcaaacaaaaacaaaaacaaaacactaatgtacataaaaataaattagttttaaaagaaaataaggcagggggatttctgtgagttcaaggccagatgcttcaaagattagcaccagaaatgctcctggatgtttctgataacccgtgagggaatagggcaggtaaaagaggtgtggcagtatgattagtcgtttggctccttccccatatctgtgaccctcttgtccctctgattgtaggagtcttaatggagcagctctcccccacattaccatcaatgagggcttacgtgaaacctgtgttgttactcagggtatgaccaggagctagactgatggctggttccttttgtgggtgctctcttgtccaggtgggagtgtggattgacgctggcagtcgctatgagactgagaagaacaatggagcaggctactttttggaacatctggctttcaaggtaagtctcataaagtccatgtttccctcagattagggcttcctgtctcaaaggccaacgatctaaaaattagtctcctgattggggacctttaggggcatggtctcaggctgcccttctggaaggagccaaaagttcttgtgagtgagtgcttatctgatgagccctgtgtaaggtcagtttatcacagcagggaaatacagaggctggaacttagaacagcagtcacatcacatccacagtgaaggacagagacactggctgcaaggatgcctgcctgcctgcctgcctgctgctttatgcccatctagctgtcttcagtcttagatcgtttagggcctgctctctagagaatggcgattcccatagagtaccctaatttaagtagtccctccttgagattctccacagtgactctaggttgtgtcaagttggtggttaaaactaaccttatcagactaggtttgtcatgtgcctgagcacgtggaggacttaatgaactcgcacatgtaagcatatgcattataacaa

SEQ ID NO: 35372 - DNA, 1267 bp, Mus musculus
cctcaggacattggcaaggggtccagcatctcccatcctttctgttttcccaggaggcctctcagccctgccatgtgttgtttcagattttccatctcgatgataccctgccctctcctctcagccctgacatgtgttgtgtcagaccaccatcgccatgatgccctgccttctcctctcagccctgacatgtgttgtttcagatccgccatcgcgatgacgccctgcctttggcccacgtggccattgcagtagagggacctggctgggctaacccagacaacgtgaccctccaagtggccaatgccatcataggccactatgactgcacttacggtggtggagtggtaagtaccaggaacagccagtgggacttgccctcagcagagggtgctgggttgcggtttatgagttatggagcttaggatatgtgccacagatgcttctgatccttgcctctggcagcacctgtcaagcccgctggcttccgttgctgtggctaacaagctttgccagagtttccagaccttcaacatctcctactctgatactgggctgctgggcgcacactttgtctgtgatgccatgagtatcgatgacatggtcttcttcctgcaaggccagtggtgagtctcagttcagtgctgcagcctgagacacaggtcattgccggggacactgagcgtcacttcaacctcacccccaccctcccacttgctttaggatgcgcctatgtaccagtgctacagagagtgaggtgactcggggcaaaaacatccttaggaatgctttggtgtctcatttggatggtaagtcctgcatcctctagagagggatacagcatatcccagcagtgactgttgtgactcaagctgtagtgtggccatgtttagaaaggagaaccatggcatgtgtggtgtttcacccttgtaattccagcatttggaagataagccaggaggatccggagttcacgattacccttagctacaaagtgagtgcaggaccagatgatagtataggggaccttatcttaagaagaagaagctgggcaattccagcactctggagtcagaggcaggaagatctttgtgcgttagagaggccagcttggtctacttatcaaattcctagccagttaaggttacatagcaagaccttgtctcaaaagaaaacaagaagaaaaagagggagggaaagaagaccacagatcccctgccaccccagatgtgggtgtttggagcttcaggtgcaagtggggctagcc

SEQ ID NO: 35373 - DNA, 1714 bp, Mus musculus
gagcgggaaagggttgataaccaggaacctgttttgactaagcgggaggggcaggcttggcctcttctggcctagggagctgtaagattttaactaatcaggattctcgttgcagctgtcgtgaccaacaccacaactactaccgtggttcatgccccttaccctcagcctcaacctcaacctgtggcccccagctatcctggaccaacataccagggctaccatcccatgcccccccagccaggaatgccagcagcaccctacccaacgcagtacccaccaccctacctggcccagcccacagggccgccaccctaccatgagtccttggctggtaagtatcactgtggattcagtaaacctgcatggtcccccaactcatgcctctgctcctcgggtcctttcctcctggcttgcctgcccacttgcgttgcagcccagtgtccccacagctaacccatgtcctttctccttccaggagccagccagcctccatacaacccgacctacatggattccctaaagacaattccctgaacctgcccccagcctctttggctgccatttatgtcgtgtgtgagtgagtgatacgcagagttctttactgctgtctgtggtgtgtgtgccttgtctagacatgtggcttcctctgctgttgaccaggtaggcgcaagtcttaccagtgtgggtcgggaccaacctgttttcttcctcacttgaaattgtactttctgaaatttcaagcaaattaaaaacaataaggtaggaggtatttcccacgtcaccccaaggtgaccagccatggcctgtcatacttaggagagcaagctttttgcgggtacagagcaggctttggggggtaaccagctagctgctgctaggcctttattcccagggtttggctgcattggcagtgaggcaggtggctgggggtgacaccaggtgacaaggggactcagtggcagggggtcacaccaggcagaacaccatacactctccatcagctgtctgtctggatgtcactgtccttcccggggctgtatagagggccacatgtgttcactattcaggctccactgggggaattttcctacctttgctggcttggctcctgctcccaggccagggacctcggtctgtctactacacactctggtttctccctgcactgtctttttactgttagccaaacattttgcctgttttctgtctccagatgtgtgataattggtgtgaggttgaaatccctggttcctggaggacagacaacctgacctccgactgtcagtttcccttgacaccatcttcatagaaatacctgactcctgtaccacagtccagtttgtcccagtagcagggacaccaaggccaatgggttatctggaccaaaggtggggtggagggcctaggtggtatctccggcccagatgtgaatacctccatattccctgttggttcctgtttcactggctgttttagctttgtgttgattggtgtttctgagcattcagactccgcaccctcatttctaataaatgcaacattggacccgcttcccctttcttcagcgcctaggcagctggccttggctctacaccaaaaactatttctgtctacttcttgaacttgtttcttccctctgttaattagcctaacaggtttgattgtcctgctaagagagcaggagagagggactgtacctcatccctagggc

SEQ ID NO: 35374 - DNA, 1137 bp, Mus musculus
atgcctttaacctcaagaggcagaggcaggtggatctctgtgagctctaggccagcgtagactacacagtgaattccaggccagtcaagtgagaaactttctctaaaaaataaacaaaatagaaacaataaacaatgttgcctggaaacattcacccattgtttaagtactcgctgcccttagtgaatagcatgtatctttcttccagggtctgcatttgttttggaaaaagactgagatgaaactctgctttgctgtggtcctgattcttggcaggaacaaatcactagcttagaacttctaggataggcttgaattcgagctccttggtaagtcagaaagtcagttgcttctgcttagccagaaggaaatatattagctgccacatcaaagtctaggaatttaggaacatagtagggcttcagatgatgtaaaccagaaatctcagattcactgttatgaaacctgttgctctatcagcagaggttctgactagatagactcatacatttatttttttcttttttttaaaaaaagatttatttatttattatacatgtaagtacactgtagctacctcagacaccctagaagagggcgtcagatctcattacagatggttgtgagccaccatgtggttgctgggatttgaactcaggaccttcagtagagcagtcagtgctcttgactgctgagccatctctccagcccaatactcatacattttaaaactccagagcacagttaagacttgggcttcctcagttgggcataaattgggaggctggtacatcaaggttaccataggtccaaggccagcctgggctatatagtaagatcctttttcaaaaagccaaatgaaagataagataacgtcatctcagacctaaaatttttaaagaagcagactatttccagaccagttctaaaaccagagatgataagtctcatttaagtcacagtcagaggtagggaagggagatcgtgttcaaagaaaactgctaggtaccagtctctgtcaccactgtccttggagcgtgttgatgcttgagtcaggggtctgtcctgcaccccctttccagtgtagggagccatgggcagaagcttcagtgtctgcctccatgacctcttccagca

SEQ ID NO: 35375 - DNA, 1151 bp, Mus musculus
gtaagtcctggacacaggccaggggtgactgctgggaggggcttctgggcagatactgggacccatatgtgggcgaggcactggttttctgactgccagcctcaggtcctctttgctgtcacagcttgtgaaggttcctgtggctccttgtgctcagcatctggactgtgactcttgccttgctcacagggacccttattgcggatggtgtgtgctcctgggcaggttagtgttctatctaccaaatccccgacctgggcttgtgcctctataacggcttcttgaccttgtccattgactctcagccgctaacatgtgggtacccagcccccagttctttatccactcactgcccagagctttagctccctgccatagcagacacaagagcctggtatcaacttcacgtgagggctgtgaccagggaagtcctcaggactagagagatgtctctgccgtgtgacttctcgatggctgccggagggtcacagttatatgctggttcttcttaggtgtagtcgccggtcggagtgctcaagggaccagggcccagagcagtggctgtggagcttccagccggaactgggctgtcttcgagtggtggccgtgagccctgccaatatcagtcgggaagagaggagggaggtgaatgaccagagtgggcggggccccagtggggagagctatggagatggatggagaccttggatttttgtgtcgttgcatcaaataccacatgtccttgctcagctatttctcttgggccttgggtttctctatctgttatcaatcaaggccagagagtatttgggagggatgccagcaccagcctgtacttgatgcccttaaatgagagtctgtagcctaccatgcagtggtgcctaaagtgtgccctttgctttctcggtaggttttcttgtcagtgccaggcctgccatctctctggccaggggagtcatatttctgctactttggagaccaacagagtcctgctctactgaccagttctggtgtgatgtgtccctccccagaccccagtgaggctccagtgctgcagagaggagccggtgggtgagagaaggggccagccctggacctgggagcccacccctgcttccatcttgctctaagaggtcttactgggatgagaa

SEQ ID NO: 35376 - DNA, 1202 bp, Mus musculus
caggcgactgttctgttttcaccctcaccagtgagacctacagtcagcctcaccactatgtctttagtcactgaattcccattgactaccctgcccaaatgctatctgtggtgaccagataagtctcctctgattctcttggtcctgcctttcagatcatcactgccctggaggaggatggcactgcccagaagatgcagctgggctaccggctccagcagatcgccgctgctgtggaaaacaaggtcacggatctataaggaccagggagtctttgcctgctgttgtctctgtacctcctgggcagccctggaatctcaagggagaggccaccaccttcgtagatgcctgtagtgactgacaagcagagtttaatgaaaggtggctcccagtctcttggtggcaccagctcatagcctcagccccattggacctgccttgtaggcctgggacctagtggttcagtgggtagtgctaggcctgccccaagcctggtgactctctgacctacttcctgggtgacgccagcctgcagggagctggggacttaaggtttccagagaatgtctggtaggccctccaggcccctggggagactgtactgttcttgagcactgacctatgtcccattgggaatcacagaggaaggaagagaacccgcccgcccacttcctgtcttcttcatccatcctccttgacctcaagtttcgcttcctttgtccttgttccctgttgccaattcccaggagagagagaggggggggggagagagagagagagagagagagagaaagagatgcatttctaggctgctgctgcctcagcagggttggtgcctcaggaccaccctgtcttccaggtggctggtggggagggacagctgcttcaggggagccttggggagagcagtgacccattgatgctatagctcttcattaaaggataacacatggtatggactcaccagcccctctgctaagatagaactggcagctgctgggagatgtgggcatcgtgctctgaagggtcccctgacacccacggaaggccaccatgaggttggcaagctctctccggctcctaggtagggtctgccagaggcaacactccccagaaaggagaacttaaagcacaataaggctcagggagagttggggcctgagatgtggggttctgtcccccatctttaaggggtccacctt

SEQ ID NO: 35377 - DNA, 1151 bp, Mus musculus
agacatgggctgatacaattccaagagtcccttcttgctgtcttttagaatctttgtcttcaagatcgcaggagccattttggttttcatgccaggggtaatcacagtgactatttctgtcagatcccatcttccccatgcctgccagatgtggggaaccacagtcacagacggccagcagtcaggccctcttttgggagcatgtgaactttagtactaatgatagttgtcttagttcagattttatcctcacgcagaatggttttgcctcccccagtggctactccgaccaactatgttgttgacagtctcagagaacagggctgacagggggaatgaggtcttggctagacttcagacagatacaggaagggaggcaccttttaagtcaacatggcagggatggtgacagagacacacctctgctccaggcttgagcttctgcagtctttgggagtcctctgaggcggtaagggttcctgcagaggaaggccgtgtacctgcgtgcttgggcgtgtgctcatgggatgggcgagtatggaacgtgctctgagtcactcctgtctcaccctcacagaacactgtgatagaagatgtcatgaaaataaaaatgttaccacttcagagaggaagctaagtcttcactcgattgccacggctgagggtggcaaggccagtgccaacaggacttggcggtggctcacctggggcccggccagtttcaatatagactgtttgtaatacagtttgctcagtctctcccccttttcactctcactttgcaaaggtatgccctcattgtttcccacaaagtgtgatagtgtgctaaggtcccacgtttctcatccccccgccactttaaacgctgggtgactgtccagatgattagatacgtatgaatcccagcgctcgggaggcagaggcagaggcaggcggatttctgagtttgaggccagcctggtctacagagtgagttccaggacagctggggctacacagagaaaaaacaaaaaaacaaaacaaaaaaaattctttatgagacagggattctatttctccctggctggcctgaagcttgctgtgtagaccagcctgacactgaactcacagcgctctgtctcctgagctttggaactaaaggtgtgcgtcac

SEQ ID NO: 35378 - DNA, 1099 bp, Mus musculus
ctcaaggcctgtctgggcaatgtagtaagatcctgtctcaaagtgcaaagagcacccgactgctcttccaaaggtcccgagttcaaatcccagcaaccacatggtggctcacaaccatccctaatgagatctgactccctcttctggtgtctgaagacagctgcagtgtacttacatataattaattaataaataaataaataaataaataaataaagtgcaaactcggtgatagagtgctcgtgtggtatgtgaggccccaggcagggtgaatccctagaacctcccaaaaggaagaaacttgttggttagcttttgatatggaatctcattttgaagccctggcttgcctgcctgcctcatgggtgctgggttaaaggtatgcgctgttgctcctggtcaaaacttaatttttgaataacgttcttcatacagtggactagagctctgtagttagctgtgcctgctgagttgctcggatgctagaaacactactgggaatgagtgctgcttcataccagcagtttgcaggacttccccccctttaggttagctgtaatttcccctgctctcctttttgacgttaggccttaaatgaacggatgtatgtattgtaggagacatcttggggtttgggttgggttggttttttcgatctggggcgctcctgagatcagagaacactattcttgtatatgctacaatgagaaccatgccatgcccctactctaggttgagcaatgtgaatctgctcatatgaatatctctttattcttatgtttacctttttgatctcattacagccttgaaatttccctgacgagaataaattccctacctgtaagttctgttgttttgagctaatacctgtaaattgctccatcaaacacctttccctacgatgagaaagtgggcattgcttttctacatccctgtaaacacataggcagtaaggtattacctagaggaacttcaacagtaacagcctcttgtggactttgtactcacctcagttttatcaaaccaggaaatgttctttttatgcaaatgttactagggggttggtatggcactatatcatacctgccaagaggtcaat

SEQ ID NO: 35379 - DNA, 1159 bp, Mus musculus
ttgttttttctttttctttttttttggttttggtttttcgagacagggtttctctgtatagccctggctgtcctggaactcactttgtagaccaggctggtctcaaactcagaaatccccctgcctctgcctcccaagtgctgggattaaagacgtgtgccaccaccacccggcttgacacttgtattttcaacaggtttagctgatcacagcctttagcacatggccttagttctcactgcaagatgagctcaggagccagggagtacagtcccctctctgactctgagggtgctaggttcacacggtgcacacacactcactctctctctctctctctctttctttttttctttcctttctttcagcagtccacctaagcaatcaaagtggtctagagttcttgctaattttgtctttcagctatcttcaaatgaaagtgaatcaggaaatttcagtcctctttttataccccagtcacctgtaaaagccactttgtccgatgaggatgatggcttcatagaccttctggatggcgagaatatgaaggtacagtctgtgggtgtgggcgtgtctgttcattctaaccagcctgcagaagcctcctaaaaaacagttcattttgtgagagttcattgagtcttctgtctgtttgactaaatccagcagggtgataggtcagataatactggtaagatctttctccttaccctgagggacactaacgatagggaaggagaaaggttttgagatacttctggaactaagatatagcatgtgcttaggggagtgtacaaggccttaggctcaatcaatcccttgtaccaagaagaaacaggcctgctctggtgttccatgccagaaattttaacattcaggatgctagccaaacacagtaagactctgtctccaaaacaaaacacaaaacttcttatctaggcttatctggcatttcttaggagagttacctgcaaaacatttggttgctgggtctttttcttcttcctagcccctctgctagatgtatttaaaagcagttttctcttgctctagaatgatgaggagaccccatcatgcatggcaagcctctggacagctccccttgtcatgaggagacctgcaaaccttgtaagttactcggcatgtggagttctgagga

SEQ ID NO: 35380 - DNA, 1752 bp, Mus musculus
ggaggagagggcctcgtggatgactcttaactttaatttattcagcttcatcaattattttattattgttttaattcaagacttttacttttctgcttcattaagtcaaaatactgccattctaggtagagttttatcatcctaggagctacctctacttttaatttaaaaaaaaaaaaaaatggggcagggataagaaaaaggcaaacttgttaagttgtgaacagcgcaaggagctcagtcacccctaggaggcgctgcagaccagtattgctgctactcaaagtcaaggactgagatgctggtaagagcctgcaccagatccaggcttggctacaggacataagctaaccttcccagacctacttctgcattttgcagtgttcctcggggaaagtcttgtctccactcctcaccccacgtccccatgacagtggctggtgtaggagtcacaggaaggcactttaggcagcttccatcaggccagtactggaatgctgtagtgtgccccaaggtggaagagggggggcatgaaagagtggagtccacagagtgagggaggagcatgcccactgaatgtccttttaaaaaaaaaaaagtcattttatgagtcggaatatccaatcagtgttgggtgggcacccaagggtgagcaggggggcgggaagcccaggctgttatgtatcctggcctacagacaactgtggaatttctcaggagggcgtagtaaattttgaagtcaaaggttcagagtttatcatgttttaatttgagggtcagagagtggtgaatcacatcagttaccccctaatctaatcccatggaagtgaggctctcggaaacacctctcgtctgaggggccaggctgctttgattctgcacagcctgttttggtgcctgcctgttgatatccttggacaccagcctctctgctatctttgctccattggggtctagccaggtttttcttaggaagagtctcccctcttccctctgctttctattctgggggcggggagggaatcagtgatattgaagatggctagttgctttgttatgggtttgagttgcatttggctattaaacaaatcttgtttgaaaatatgtggagagcaagggaatgagcagccccttccctggcgtgttgaagtatgtcccagttggtccctggtctggtttgtagagattctgttagctgaatgctttccaggagaatggcttgcagattgtaccagcatagctagcattgttaaccaacagttgcaggctctgcaaataaaagtgatcttgaacccttgttctctgcctagttcctaatatactcaactgggagtctcatttgcctttagggtcccagggtcacatagctaaattaagccagccatatttcttcaagaggatattaataaaaaaaattcagtttgcctttaggaatagccgaaacaatcccccaaaaacaggcggttgacaggatgaaatggccttctaggtcagtcagagtcgcatgatgggacctattaaaatagttttctcagtactccatgtggtcttacagcctagtccttgggttgctaaaggcctgaggattggcattcaaggccatcccccacatgatagagaaacaactcatgaattatcctctggctcccacatatagtctgtggtgtgtgtgttcataccaagtaagttttttaaatgtaaatttcttagtacttgggccaaggtgggaggatatcagattcaggaccgccc

SEQ ID NO: 35381 - DNA, 1120 bp, Mus musculus
tggcggaccgttggcgcggcgcgcgtcgggggtctagactgcggcctcccgcccgcggatgcctcagcgaatggcgaggctcaggccgcctccgccgttctgagagggccgccgcttccttttccagcagaaaggatgctagtgtcaggcgcacgcgcctgcgtacgggtgggcctgagtgggccccgccggccctgactggtgggctctatgatgtaatctgggaggggcgggggcggggccttgggttcactgctaaccgcgaggaactgactgggagctgagggcgcagctcatagtagctgcctgaaacgtggctggaccaagttgagaaggaacattgttgaatgcaaaactgattatatggggccgggcgtggtggcgcacgcctttaatcccagcactcgggaggcagaggcaggcggatttctgagttcgaggccagcctggtctacaaagtaaggtccaggacagccagggctctacagagaaaccctgtctcgaaaaacaaacaaacaaacaagaaaaaactgattatataattgggagtgtatttagtaacttaaataatttcatgtttcttttagtttttttcttttttcaacgtagttacttgaaaacttaaagatcacctttgttctgttttgggttttttgcacagtgcctcccaccatagcgcaggctggcctgaaattcactttgcatcacccacctccctcagagtgatggcaatccctcagcctcagcctcctgagtgttgagattacaaatttgagccgccatacacagctaaaattacctcctcctactctcctctccccgcccccctcctctagagtgtcactacggtcacattatattgcctgtgcatagtactggtccagaagaaatagtgatacccaactcctttatgcttattccatgatccacatatcttaatcatcacaagagccctacatggttaatatatcctcagtgccctttgtagttttagttatgagccttatctttaatagtttaattttctctccagcactcctcattctcattatgttaacaggcaagtttagtaacaccacagtgtcaacaagacaatgtttggctagtggggctttaactt

SEQ ID NO: 35382 - DNA, 1157 bp, Mus musculus
tacagggttagtttgttcatttttaatcaatattttattggataaggatttatttttgtatgtttagatatataaaatttattcatagttttaaaaataattattatttttattttatgtgcattgcctgaatgtatgtttgtgtgagagtgttggatccctgggaaatgttcctctcgcaaaatagagatcattgccttctgaaaccttataagttaaataggttggaccctctctaagcctgaaaaaggattctgccatgtctgtgataccctccttggctttaagcaggactgtttgggagaaaggggatcacatttttaggacagtgattctggtgactagaaaatggattatgaaattagagggctgattgagagattcagttctgttaagagacttgtacacccaattcagtggtgttcagctgtaattttaggttatgggaggtgaaggcagggggatcagcaattcaaggtcatcctcacagtgagcttgaggctaggctggactgcatgatgagaccctgtctcaaaaaagaattgagggtgctggtgcagagttcaggtgaaggaagggcatgcgaaccaagacagataggggtggataaagaagctaaacacagtagggggactggtggcccctgcctttaatcccagcacttgcaggcagatggatctcttgatctctctcagcctggtctacagagtgagtctaggacagctagagctacacagagaaaccctgtctggaaaaaccaaactaaaccaaaagaaacaaacaaaaaaacccctaagcactttacagatagtggtgatgttatttactgagcactgtatcctggagatatctcacctgtcagagtcaagttgtgcatctgttgctcaagtcagcagcagcagcagcagcaaagaatacagatatgggtttaacactggaagggaggaaataacattacaaaaatgggtaatttgaaagaaggaattacaaagataaaagtacagcaaagagccataacaactttggaagtaagattcaaataagtggagtaacaggcacacacacatacataacacaaacaaaagaaaacaattgatttaaaaactagagagccaaaagaatttagtgagggtaagcttatctctgtaggtgaagaa

SEQ ID NO: 35383 - DNA, 1146 bp, Mus musculus
tagttcatccagtagtgagctgtagccaattaataactcaaattaatttttgaaaatcattgggtttgaaactgatctgtctcttttgtggttgaaatttatttttattttattggatttattatataacccaaaataacccagatctctactctgcttttttcagaagcaatctgcaatccccagtaaggtgaaattctttttgtttcactaaacattttctctaaagtatctgcatcagaatcagccaacaaaatatctatgtaatgataaataatggattgaggaaattgcctatgaattatttctactggttgttgcataaaatagaattgtaccatttaacattccgggtggaaaaactttccactgacaccttttttgtacaggttgaacattattatacataggcactgtgaagccagtttttttctttatcttgctcttgcagggggatagtaaaaaagcagtcttttaaatcaattactataccttaggtaaaggaactccaggctgtgatggactactctactcagggctctcaaatctgttaacattctctatttcccccatttcttttttataacaaacggggaaattccatgggctggtagactcttctggatgttgagcctccaggtacattaattaagcattaattaagtttaaggctgttctgctcacacaggcttctttcacttagtcaatcgttttaagggtaggggccattggtctaatttcagcagttccccatcctaccccactttatacatttggaaacccagtcactgttgtgatctggttttggacaatctgcagtctgtgattttgtagctggctagaatgtacaccagaacatttctttcagaatcctgtagatttcctattggcaatatcttaccaataagagttgaccgtgggctggagagatggctcagtggttaagaacggttaagccactgcttttccagaggtcctgagttgaattcccagcaatcatatggtggcttacaaccatcttaaaggggtctgatgtccttttctggtgtgtctgaagacagctacagtgtactcatataaataaaataaatgtacccactgttacctccagtggagttgaacagtatggaccaaacctgacatcca

SEQ ID NO: 35384 - DNA, 1177 bp, Mus musculus
aagcagccaagccgaggctgctgcacaccagccccagacacagccccagccccagaccctcacccagagcccacatctttactgtgtcactcaggctggccaagactacaggcaggtgtcactatgcctcgttgtggagaaattgtctgactactcacaaagtgtgtgtaggattaaaggctgtttgagctccaaagtacttttttcagcaacattccaatagaattggtggatcacatatgaagtcctgtgtgtaaaatcctataccatgaaatgggaatttatattctgtttcattggtactttttgttcttcatttttttccaaagaaataagtaaaattacaacataaaagctagaaccattaggataagtactggggaacctttggtttttaggagtagatcacaaatcccaggccatatttgagatcatagaggaattctgatataagaactgaagtatgaagagtgctttttatttctgtcctcttggttacagaaggtatttcagcctccaaggtactgatcaaaagaaatagcttatactatatttgaggaacattacagagcattattttttttgatcttctgacctaaaacttttgaaacctgagggtagtgacttatacttgagatttcaagacttttgtaagaagagtcaagaattttgagaggtaggaagccagtctgagctaagtagtgaggttaaggctaccctgagctatgtgaaaccttgtctcaaaaacaaacactcccctcaccccccagtacttttacaaggtaaaatcagagtgacaaatcaaagggttaggaaagttcctgcagtgcctgcattcggagaagccctgacttccacctgaatgacatcacaaggctggtgtctttgctaagtgctccctctgaaggtctagacatcttccaagatgttcttttaattcccccccctttttttattgggggcagtggagttggtcagggaagtttaaaaaaaaaataatgtcaccatttgcttttttaaatcatgtttggtgtgtttctgttggtttttgttttttggtttgtttgtttgtttgtttttaaaatgagactccgtagtttttctgagagataggtagagatgctaggcaataaacgctcaaagttcatgatcaacattgatttattccacatttatt

SEQ ID NO: 35385 - DNA, 1134 bp, Mus musculus
actttgattccctagtctagcctagttctggttcttgtagttttctactatttttggaaaggtagtgtgaagagatgcttcagaggatctccctgggttccagagagtcttcctggctttcattatgtaatgactttctttataattaatcagacccagttgtttcagcccatagtttctgcctactggttcaatggcataaacagtcccagttgaccaaattggaaatcacgtgcatcttctaatttaattgcatcattgattgtgtaggctagtagatgttacttcctttttggagactaaaacatccaaattagtagaactcagttggcaaggtggaatattaggttctagattgatgagtggcaagggcttaggatatggctcagcggtagagtgtgtgcttagcacgtgtgaggccctgggttttcaagcctttgcataaacaaataagagaatgaacccacctccctttctccttgattctaaatctgtgtattctggcagtagtcgagacaagcaccatgcgtggtttctgattcaatgcatcgatacttctttcagagtgttgtctaactgaacagtaagcagttctgtttctaaattaggggtgcatctcacagacatgagctccactctgcaattctttgttgttaaaatgcccaaccccgacttgtttagaaacaggtgtgtgagatgtcaagattttgattcaggggctggtgagatggctcagcggctaagagtactgactgctcttctgaaggtccgacattcaaatcccagcagccacttggtggctcacaaccatccataatgagatctgatgccctcttctggtgtgtctaaagaaagctacagtgtacttatatataataataaataagtctttgggctggagcgagtagaggtcctgagttcaattcccagcaaccacatgatggcccacaactatctgtgtacagtcatatacataaataaataaataaatctttaaaaaaagattttgattcaggcattctcctgtaaagactatctcctactttggaaaacatccagtttgagactagtttcctactttgggaatgttgttataatgttttttccttccttaatcagttggccatgtggaac

SEQ ID NO: 35386 - DNA, 1099 bp, Mus musculus
cccaagaatatacaaaccatcacatatactaaataagtaaatctccaaaaagccaacaattaaccctaagcagaaaatgataccccagaagagggcatctaacctaattacagatggttgtgagccaccatgtggttgctgggatttgaagtcaggatcttcggaatagcagtcagcgctcttaaccactgagccatctctccaggctgtttattttgtttgttttaagacatggtttcactctgtgtatgacagctctggctctcatacaactagctctgtagctctgtaactctgtgctggcctccagctcacagagatgtgccttcctttcctcccaagtactgggattaaagatggagctaccaccacttagcaaatgtctgtttttattggtctttgggtttgtgtcttcttggcaacacatttctgatttaaactgtcaaatgtcttttcccctgactattgatgaccacatttaaaaactgtgtttcaatattaggtatgcttccctgtgactcatttgcttccacggctgttgtatctcaggagtggtctgtgggagccccaaactctccatgttcagagtcctgtgtctccccagaggttactatagaaaccctacagccagcaacaggtaagttattgaaaactatttcattagttattgcttatggcatcagtaatcagtgttctaagcagcttatagcagatatagataaacagtctttttatctttcttagagaaacagaatcttacctggaatggaacttactgtgtggattaggctggcttcaaacttgtttgcttctgtctcttgagtgctgtgatgaaagacatgcttgatgcagatttttaaacactggagtgttttgtctcataaagtaaccgatgctggcctatggtgctcttcctgcctaatcctactgaatgccagacttctgtattagtcagggattattagagtcacagaacttacgatagtctctatatagtaaaagaatttattgatgacttacagtcggcagcccaattcccaacaatggttcagtctcagctatgaatggaagtccaaggatctagcagttactcagtctc

SEQ ID NO: 35387 - DNA, 1100 bp, Mus musculus
atggtttcactctcagaaatagaagaggctctggcaaagaatgatgagtcctctgcagaaatacctgtggctcaggagacagtggtctcagaaacagaggtggtcctggcaacagaagtggtactgccctcagatcccataacaacattgacaaaggatgtgacactccccttagaagcagagagaccgttggtgacggacatgactccatctctggaaacagaaatgaccctaggcaaagagacagctccacccacagaaacaaatttgggcatggccaaagacatgtctccactcccagaatcagaagtgactctgggcaaggacgtggttatacttccagaaacaaaggtggctgagtttaacaatgtgactccactttcagaagaagaggtaacctcagtcaaggacatgtctccgtctgcagaaacagaggctcccctggctaagaatgctgatctgcactcaggaacagagctgattgtggacaacagcatggctccagcctccgatcttgcactgcccttggaaacaaaagtagcaacagttccaattaaagacaaaggaactgtacagactgaagaaaaaccacgtgaagactcccagttagcatctatgcagcacaagggacagtcaacagtacctccttgcacggcttcaccaggtacaggcttctgctttcttttagtattctctctactggggtgtagactaaaggacagctgtcattcctgataaaatacagcctcgctgcttttcaagtccaattatgtttctcctagtcagcgtgctgaccctctccttcctctctggtggctcgtcccattttttgttcattcttgcttcttttgcagagagtgaaccagtaagacccacagcccatcattacccatctacatactgactgtgtctgtatgcactgccttattcctttttttatggttaacatggcttctcagtaaagccaacctcgcctcactttgcagcaagtcccttccctgtactcaagtgtactgcttcccagccggccttctccctttactcactagtgaagtcttctttccatttaatcgttcccacctgctttcagaaacgtttgg

SEQ ID NO: 35388 - DNA, 1123 bp, Mus musculus
gtcctagcaacaagcatgatcagtgggtcatcatggacattttgtaatggtcagatgagtgttgaatctctgcagatctcttgttaaatatactcatttgtttgtgcaggcatcaagactgaggggaaacctgctgatgtcaaaaggatgactgctaagtctgcctcaggtaatgcctaagtcacctgttgggaagtctaatgaccatgctgtccttccccagttctaaggctcccctgctctccctatgaactcctgtacttctcatttctttgcagctgacttgagtcgctcaaagaccacctctgccagttctgtgaagagaaacaccactcccactggggcagcacccccagcagggatgacttccactcgagtcaagcccatgtctgcacctagccgctcttctggggctctttctgtggacaagaagcccacttccactaagcctagctcctctgctcccagggtgagccgcctggccacaactgtttctgcccctgacctgaagagtgttcgctccaaggtcggctctacagaaaacatcaaacaccagcctggaggaggccgggtgagtcagtgagcttggggatctttgcattctggcttctgttgcttttctgccacatgcagtcatctagatcatttcattcagcatcagagaatttcagtcttggttcttggcactacaatatcagggaaggcctggccttatcttcccataaggacctcctgttcactgtgttgggatttatatttatatttttctttgggaggtagaaagagtcttctattttataaaaactcttagccgggcagtggtggctcatgtctttaatcccagcacttgggaggcaggaggatttctgagttcgaggccagcctggactacagagtgagtttcaggacagacaggactgcacagagaaaccctgtctcgaaaaacaaaacaaaaaaactctagaaagttggatgtgtggttcctcagagcacttggaagacagagcagcagaatcatgatgagtttggcgccatggcttcagggtttagggagtttggagagaaagcttcagaaactgtgaaggtaagagacactgcacatgagccccatttatttttggtt

SEQ ID NO: 35389 - DNA, 2547 bp, Mus musculus
atctcccctgtgttccctctcttgtctcccccccttgttaccctctcccatccctcctcacgtgtcactgcagattgagacctacaggctgacgttccgggcaaatgccagggcccgcaccgaccatggggctgacattgtctcccggcctccccacttccctggtggcccaagcttggggtctcgagccctgggctccttttcccgggctgtctactagacttgtaagctcttgggtgctgggcagcccctttaggcctccctccctcctgcctcgcttgctcaaggcagcagcagccccactcgctgccattacacctccttccacccctttctgggccaactccaacttcactatctcaccacttcaccactgcaccacggagaaagttgggcggggacgggagtccagtgggatctctgtgggatctaggggtgaggagctggattccagccttggctgtttggtttttttggaccaaacccaaaagaaactgacaaacctctcttccctggctcaacctggagggactggtaaaggtgaactccacgtggagaccagcaccgactgaatccctggaacctaaaccactccttgaccccacggggtggaagccaccatttggtggtaccaggcccttttgctgcctcacctcaagttagtcaaggatcagtcctccttgtccccacgacttatcgtacctgagtagctgctgtctcacttttttattctttcctctcccaataacctatgaactggtggtgtagtttgcaggctgaagccatgtctaaatgagagttcttggtaggtggtgagggaagtggggaaggagatcccgagtctccactgaggaggctgtcagatattggcgggggttgccctactctgggcagcttgggccctgcaggaagaagtgaagtcagacagctagggtgggtcagtgtggctgattgtgttggtattgtgtgtatgctgcttttctaaccaagaggctggttttggcatctatctcattccctgggaatgcggtggttaaatgtgtgatacaaaatcagggctggagaaacagaaatgaaggtcaaaatcgctggcctgtacctacaggccatagcacccaaatcctcatatctaggggagcctgaaatgtccagaacgcttgtgaacagtggggaatcaggtgtgaaaatttaaaactaaaatgcatgagactgaggccatccagtcttctggtgtggcgggagaggtggagccatggtggtgcagccatcccagcgtggtctgctcatggatgggatggttgcaatgttgagaaaatcccgggaattttatcaacacaagattcttattgcacttgtattttttgtattaaagtttgcatggtttctaataaaggattcaaacctaagtttgtattgaaatggcctgggagtgtctaagggctcctctgatagggcattttctgctgggcagatttgcctctcaggaggctggcccagacttggtccccttggccctcctccgaacagactctgcctttgcttgggtacagtttgaggaggtagaggtctttactctctctctgccaagggaaggtatccctgggcttgaaggtcttctccatttatgaggtagcagttactttgtgataatcttgacactgaatccctagctctctaagcacacacaaagaattgctgggacctgtggaaaaaagactgcctgagctggggagtggctttcttcccaagctgtcagaactaagcttggagcctgcattgtctgtattttgcagcaataggggcccacggagctgggaaggacacagtggggaccagggtagtgatgactgagcgtatacaggtacttgctaccctccttgatgttgatcttagggccttgaagatgctaaggaaattgacaagaaacaagtccattggccaaggattagagaaaggaaggtaacccaagctctgtaggtagctccctggaaggatcccacgagccagagaacctgagaaggctggtctagcagcttgggaccacaggccatgtgatgtgcatacttcaaaatgtttgggaataaggtccttctgtattttatagtttgctcatggcttagccattacccatgtctgtaattgttgtactgatttaaacaataaagctgcctgacatcccaccatgttatgttgcttctgtcctcttagtccttattagttcttatccccttcagctcctctcccacctgccttatggctgtggccagggcaaaatcaatgcctggagttcctggcaggatgtacacaaatcaaggctgcctagaacagtgctctttgcctcttgctattcatacccattaggacacggtctgtgctgtgggtatcattagaagcatctgtgacaatgctgggcttgaccagatagttagctggaatgtgttggctgctctggtggatcactcttgaggatagaggttttaagccccatctgcctgtaggacttgggccactgcccagagtcctgagaggagcccttgggaggacagc

SEQ ID NO: 35390 - DNA, 1113 bp, Mus musculus
cattgtggatgaggtccatgagcgggatgtgaacacagacttcctgctgattctgctcaagggcctgcagcggctcaacccagctcttcggctggtgctcatgagtgctacaggagataatgagcgcttttcccgatactttgggggctgccctgttatcaaggtacctggcttcatgtatcccgtcaaggaacactacctggaggacatcttggccaagctgggtaaacatcagtacccacaccggcatcggcaccatgaggtgagggacaccactccagggtctggagctttcctttggattccctcctccctatcctcatgataggccattattttcttcccaagcctgtctccttggtaaaaagtagggaataacatgcctttgtgtgtgacaagtgtgggctagggtttacatacttagcttaccctcactgtgttcctgtgtgtgactcctaccccatgactgtgagtggcctttcttcccctactccagtcggaagatgaatgtgcacttgatttggaccttgtgactgacctggttctgcatatcgatgcccgtggggaaccaggtgggtgcttcctcccacttctcagctactcccttaccccactagctggacaaccagctcatggctgcagggtccctttacaggtgggatcctgtgctttctacctggctggcaagaaatcaaaggagtgcaacaacggctccaggaggccctgggcatgcatgaaagcaagtacctcatcttaccaggtgagcgtctgggtatgcacgctgcagtgttgagtgttgctccctgtggtagggagtgacccggcctatactccagtgggcctggtttctttgaccatttgggcttcagttggatcagggtcagggttgggtgagtgagtgatccagatccttgccctgccttcagtgtgggactcttctggctaaacagtgcgtgaagcccttttgcatcttgctatccaccagtgcactccaatatccccatgatggaccagaaggccatattccaacagcctccacttggggtacgcaagattgtattggccaccaacattgctgaaacctccatcacagttaacgacattgtacatgtc

SEQ ID NO: 35391 - DNA, 1194 bp, Mus musculus
atggttgtgagccttcatgtggttgttggggattgaatttttaggacccctgcttgctctggtcaaccccactctcactcaggcccgcttgcttagtccctgcttgctccggcccaaagctttatttattattatgcataagtgcactgtatctgacttcagactcaccagaagagggcgtcagatctcattaagagtggttgtgagccaccatgtggttgctgggatttgaaccttgggaagaacagtcagtgctcttaccccttgagccagcccccttcctactctttctatctgttacggtttgtgagatggtttcactgtgtaggcaaagctggcctggatcacaagattcttctctttcagcttccattgctgagataacaggggtacgccatcatgcctggattcaagtggatttttattcccatttctggccaagactgaagaacgtatagcagggcccagcacaagctgactgaggtgtagtgatgctatgatcctaacagttttctctacccaacagggctggggtctgctgggaccacggaatgagctgtttgatgcagctaaataccgagtgctagctgatcgttttgggtctccagctgacagctggtggcgcccagaacccaccatgcctccaacttcctggcggcagctgaatcctgagaacattcggccagggggtcctgcaggactatcccgatccttaggccgagaggaagaggaagatgaggaggaagagctagaagaggggaccattgatgtgacagagtttctgtctatgacccagcaagactcccacaacccactcagggactcaaggtactgctgttacaggggaccctggacacatcttgacataggattgaccttctctgagcctcttttagtcgtcatatcttgttgctcactgtgtctccccacgtgagggatgggatgagatagtacactactgtcttgggctgtggctgggctcctgcagactgggcatgaaccttctttccagttcacacagtgatcgctttgcttactctctccctctgcctgcttccctctggggaagctgggggagtgtgggctctgctgtgtgactgaaggggcagtagagcctggccccatcatttcatgcctcctacctacctgttacatcagcactatgtcccaaccttgaaggcccagagaacttgc

SEQ ID NO: 35392 - DNA, 1128 bp, Mus musculus
cgagtgctgggattaaaggcgtgcgctaccaccaccgggcacttgttgctattgttgaggtcctggattcagtcctctgcagccacacagttgctcacaaccatctgcagctctagttctagttcatttgaagtttttatcttacttctgtaggcatcaggaccatgtagggaaagacaaatacaggcagaacattcacatacataaagtaaatcttttttaaagaatcgtggtgctagaaagattactcaaagacaaagattactcaaagtttgattgctagccctcagaacaattcactaccttctgtttctttagttcttggggatccaacgccctcttctgtctctttgggcaccaggccatcaggtcgtatacaaccatacacactggcaaaaccctgctaaacataaaatttattactccacttcacagatgatatgcaccgaatgacttgctatgtcatctgagtagtagaccgtagagctgagagtcgaatgccatagtgacaggctcccctgtccacttctgcacattggctcacacttactggctgtggatattcctttcccacactctgacagccattcagaaatgagaacccagtgagtctgaaattcttacttaggcggcacataactgcttcaggtagttctaaagtgctttttaaaagatttatttatttatttatatgtgagtacgctgtagctattctcagaaaccccagaagagggcatcagatctcataacagatggttgtgagccaccatgtggttgctggggtttgaactcaggacctctggaagagcagtcagtgttcttaaccactgagccatctctccagcccctctaaagtttttatattttagttttctacagataaagtgacagtacttttatttgtttggagtaatgagtaaatactcattttttaaggagaaatgtagagggtgccttgagtttctacttgaatacttgactttttcttgtttgtgtggcatcaagaatgagcatttgttagtctaaatggttttgaggggtttctagttttgttttaaagatgtatttagtagtctttaacctagccatatgatacctttaattttcatagcggtgctccagcattga

SEQ ID NO: 35393 - DNA, 1110 bp, Mus musculus
tctgttatctttaaaacttgtgtctcgtttacagagggctgggtttgaaaggcatgtgccaccacaactagatcactacccaacatttttttagaaatactattggcagaatcttggcaagtctggctttgccttttatagagcagtagagcctgtaagccaggattagtagaagtttaagaccagtctgtatcacgtagtgagaccctgccacacagaagcaaaataaagagcactggcttcgtttttcttcttttctgtattacttccttgttatttgatattaccgatctatttctgtcttcacttaggctctggagatgtacaaggacgattggaataaagtgtcagaacatgttggaagccgtactcaggacgaatgcatcctccactttctgaggcttcccattgaggacccttaccttgaaaattcagatgcttctcttgggccactggcttaccagcctgtccctttcagccagtcgggaaacccggtgatgagcactgttgcctttttagcatctgtcgttgacccccgtgtagcatctgctgcagcaaaagcagcgttgggtatgtacttcttgtggaagctccctctccagcactgaagtctggcctcacattcaactattaccaggtctgcctcaggtgtatcaactctgctacggaagcagggggatctgagtttggatgggatgggtgtttggatagcatttctcctgggaggtagaactagacggcctcacctgtcaccctgtcagagacggtaactcggacatgaagggagaactggtagaatcgtttgatgtcagccactagtctgtagatgcctactggattgagcccgcagacttacagccagacacaagctcactcccacacatacatacaaatgtttttaagaatacagctgtgttaattcacatttctcttttataaatcataaaaacaagccacaaggataatgtgcttcataaaaattaatgtgtgaaaatacagttgtaagaacatttgtttttctttcaccttttaaagtctatttctgtgtgcatgctcaccatgatatgtctcgaaaggccagaggattagcagtgggacggtgagctctct

SEQ ID NO: 35394 - DNA, 2899 bp, Mus musculus
agcataatggctgaggcaggcagatctctgaattcaaggctagtctggtctgcatagcaaattctagaccagactaggctacatggcaaaatcttgtcccaaaaaagggaaaaaaaatcctttctgttacttcccattaagtggactttcccaaccgtccccgtgtttccagcaatgacgagttaccttgaatgtgtttgcagatcctcctccaccacagcagcagcagccgcctcctcctgcagatggggtccctccacctcctgctccaggcccacccgcctcggccactccctagcctggaagatacaagagcctccacagccaccacaagcaggaatggggatggcaggacttgtgtctcggcttccttggttttcttgcaggatttttttttcacaaccccaagcacaagccccatgtctctccactccttgatacttcttgtgtcaggtccttagttgacactcattgggaagcctgtggtgactgatgtgctctggtcatttaaaaagtaccatgtgtctcccctgtccccgtgtgacagatgttggcaggtggtctgcaggtcctgttgtgttgacattagtattctttgtgtgtatctctctctgtctctctctctctgctttgtctaaggcttcaatgtataatcctctataattattgtcctttcttcctttgtaatggttgtttttttaaggaaagtatcctaagttaatagaaaccaaaaaaaatggtaatgggcagaaagagatagccacagagggacacaccttaaggcattataagtgaccttatttctgcttatctgagctagagtggtgctactgatagagtccctgagacttgtcacacataagtgcaccaagatgagaagagctggggaaagggggtatcctttcgatttgatttcctggtgaggaccatgaaggacttccctgtgcctggaagaacatgccactgtacctagtacacgatagatagcaaagagcacagctttacaacaagcccttcctaccttctcccgccattctggttgtctgtgcagaagatttgcaggattggaacatggtggttgttttcccaagggcagcgtgagctttcagagttggggttttcccagtctaacaaagataaagggtctggggccctacctacaaacctttaggaacccttccaaacctcccaaccttccccaaacacatagggcctaccctcgccaccccaataaacattacatgttttttaaaccttcctataagaaaggaaaaaaatgtaaaatgggttatagattatgttgaacattttatctcatgcggcttggtgggggtgggggtacagatccctaaactacctcttgctgtagccagggtgagcggggttcttaagcggtactgaggtgcagaacgggagtgggaatgctcacatgtgatgagcagcctcctgtacctcacattctgagacctcacattccatctgttgtcacagggttatggagactgtgctaatggcacaaggacctcacttggctccagagtgcgaggctgtaaggtttaagtgccatcccagaggaattgccaccaaaaaaaaaaaaaaaagccttaatctgagcctgtatctacccctgctgatgaacaactagatgggttttggttttgccagcttctttcctccctccctccctccctccctccctccctccctcctttctgtctttccattagtagcaaaagggtgtttttagcagaactttaagtggcagtttcattcttgagagtgcaaggtagagcaccttacgggtgtatttttatgtgtattttaaagctttatgtatgagagctataggtaggcatttcttaataacacaaaaacctacagttgagatttgcctttaagactcttggttttcctctaaccaggagcccacgtcaccgccagagtcctggagctagagctaatgactccagagccttggggtggaaatggagattcgcttattccctgggtgcttgtttttcctccaggaaaaccccggtgtcttctgaccgcagccagggttgccctccttccctccattctctcccaaagtaaattgactccagcacttgccttctccccggagtcctaggggaggtataggactctgcttgtctgtaacctgaggtctgtaatgtgattgctttccagttttgagagatgcaagtgggaatagtttttacattgttgataatctatagaacctaagttcaacacttcaacacagctctttccatgactgtcagttaggtatcattcctgtaataacacccatccagttttgtgaggggcgggcttggatactgtgtggtttttgtacaaatgtgtttctcagtgtgggtttttgttttttgttgggttttttttttttttttggtgtttttttgtttgtttatttgttttttttctttaggttttgttctaatgaggtaaaggagctttgagagtttgggagaaaatgaatgaaagtggcttaatgtccctcgtttgcattgaataaatgaaataccatttatgaattctagtcccattctctgcattcatccattcatttctagtgtgtcctgtaaagaaagagtactcagtctcacctgggcctggttagatcttaaaatgccgttgctcggggcctttacacgtgctttagtgtgaatggatgccttccccttcatcaaaggaagatgaggaggacatcctgcctcctcccaggggaacagccctagtgagccagagttagtcaggtaccgcttagatggaacccggtctcatcagccgataagaggtgcttgcaaccaagcctgatgacataagttcagtcccgtggctacacacatagtgggagagaactgactcccaagaa

SEQ ID NO: 35395 - DNA, 1109 bp, Mus musculus
cacagggccacttcagtcagggcagctggtggtggtggtgggggcctgagaaggagcgttactgctctgaggacgccacatgcactcggtcctgcagatagtgcggcgtttattgattctaagatacacattccttctcacatattagcatctctgaaattggattgtgtcttacaattgctggcatcgtgaaatcactgttggccagatggttgtcttgatgcagttgtaattgcctggcatgcacaaacacggtcatagttgttcatatcgttggcagttctttaaagtcccactgtgccgcttccagttaagagtcccaggggatgagagagcgttggccgggtttaagtggctgaagtttactcccaagggcaagtccaggcctggtgcatcttactctcctcatggtgtgatttagtatctgatcccgacattgaagcatcactgctggggtttggcaatgataacttgacttacattttcccttccctcttccgtccttctagtaaattccggaccccatctgagctccacaacgacaacttctccctctccaccattgccgagggctctcatccaaatgtaaggaaattttgcgacactccccgtgtctcctccccccatgcccgtgccttggctcactatgataacattgtctgtcaggtaacttatcttcctcacatctccccttttgcatgcctctgcccctgcctcccactcccaccctgtccccttgccctgtctcagagtaggcagtcaccaaacagctttgaagatcagctcagggcaacccagtggtgcagggaacggtgcattgattccctgacagtctgacttacaggtcctagagtctgctagaatggctcatgatttgaagcttcacctgtgctggagaatttcctggtggtttctgccccttgggataggcagagaatcctgccccttggtactttctggggctcctaacagctagcagacttacaagtgcccccttggagccaagacgagcacagaaactgttagaaccgttagtctaggaacaattctgatctgagtggggggtgggggatcttggtttgtttgttttttctaagacagatgctcac

SEQ ID NO: 35396 - DNA, 1170 bp, Mus musculus
tgccaacccaaagacagatggcctgtctgctgtggcttcggtgaccttgcgcttaacaggatcagctctgggggagacagttggactgaaggaaccctgccttgggttagacgctccctcccatttcctttccagggggtctatagcttgtttgcggtctctgataggattcctctgctccacactttcaggacctgcttctctaactcccggcctacacggcaggtttctctgtagcttagactggctctgaatttactatcttcttgccctagccctccaggtagctgggatcacaggcctgagtcaccagtactggctggcagtccctgagccctggaggtggcttgcccacctttgtgttgttagagctctaaaagtcactctctcctctatgtaccctgaagagcatgtattgaagacgagaggctctctcaaggaacctgaaacctggttcctgtaagaggggaggtgactacaggcctactgtgctttcctggccctactatgtgttcctcggcttttcagaccatctttccttttttggaggggtgggaatcaggggaagggtctcttgcattctgggaaagcctgagctgtatctcttgtccccatcttgaacgtagaaagtgtaaattaagaatgagccattatgtgatagcacatccctgtaatgccagtacttgaaagggccgaggcagaagatcatgaggtctgcctgagctacatagcaagttcaaagctagcctggccagcacagcaagacctgtctcaaaaactaaaaaataagcaggcaaaaaaaaaaaaaaaaaaaaaaaaaaaaggtaagggttgtttttaggaagtatagcatggtgcaattctgaaatttgaaacaaatttgtaaaaacaagaatattaggatctcatgttcactcctggccacctaagctcaagaccagtttagcctacatgtttccctgcctcaaacacaaacacacctgcagccatgctcacctgcagccatgctcacctgcagccatgctcacctgcatccacacctgcaattgtagctccaaggaaggcagagacaggaggatggctgggactcgccgccttctaccttagctaagaaaacaggagccctgggtctggcccctgcccccccccaaaaaaaaataggtggagagt

SEQ ID NO: 35397 - DNA, 1185 bp, Mus musculus
aatccgtctgcctctgcctcctgagtgctgggattaaaggtgtgcgccaccacgcctggcgtatgtaggtcattaataaacagctgttcaagtgtcgaaatgtccataactgactagctttctctgatggggctcagccctaacttaccttgtactcttctctactttcaggggacgctgactctcctctgtgacgctaagacagatggcagcttccttgtgcaccacttcctttccttctacctgaaaggtatgtgactccctggtgctgtagagaaggatccccaggtctgcagagatggctctgtggtttggagcaccaggtactctctcagaggactcaggtttaattcccagcacccacgtggtggctcacaaccatctgtaacttcaaaataaaacaaaaatcagtaattatctagccaggcatttggtggcgcacgcctttagtcccagcacttgggaggcagaggcaggtggatctctgagtttgaggtcatcctggtctacagagtgagttccaggacagccagggctacacaaactaaaacaaacaaacaaacaaaaaacaacaataaaaaaaaagtggaaactcagaacagctaagaaagtagagaagaaaaaccctaaggaagcaacggggaaaacattgattgtcttggctttggtgtttgggtaatcaatgagctttcctgttaggtaccgagtgatgggggcatcattacaccctgcccaagaatgccgtgtgcccatctgatctacagcctgacttcccttcttctccgcctccccctctccatccactgtggaggagccaccacctctctgaggtcctcgtgggggtggcttcctgacccagttgtttcttagctgttatgtgtttagtcccagtttctccaacccgtgtgatattttgccattgcaatagctgcttcctagagaacactgcggtttaccttaggaaagagattagaaagtctctccctccattttttggtggtgctattactgtgagactgagtctcctggagcccatgctcgtctcgagttttctgtgtagctgaggatgaccctgaattgcaggtgtgtgccaccgtgcctggccttattcagtgctggggatccaactcagtgctttatgagtactcggtaagtactttatcagcttagctattttcccagcac

SEQ ID NO: 35398 - DNA, 1141 bp, Mus musculus
agaccgaacttccagcaagttctggcccttaactaggcctaggatgcaagccaccccttccctacgttagggcagaattccccttctttctgtggtaactggcagacaagcacacgagcaagtcaggacttgtggagaaaggctctgtcctgctgtcctgaccacactagtcagctcccagcctccagacagtagcagaagggtgttttcctttgccattgctgtgctctgccaagtctggggcctgtgcctcccaggctgagagccactcgcgcagacaccatgcctcttgtgtgttcactgcaggagttctgcctctttgctgttgtgggcctggtgtctgacttcttcctccagatgctgttcttcaccactgtcctgtcgatcgacattcgccggatggaggtaagagaggctgagtctgtctgcttggtgctgactttgtttagaaggtctctgagtgagtgagcatggcctcaagcagaggcagcctccgagcaacttggggcctgatctctgtgcactcaacagctagcagacctaaacaagcggctgccccctgaatcctgcctgccctcagccaagcccgtggggaggccagcacgatatgagagacagcaggctgtacggccatccacgccacacaccatcacattgcaaccatcttccttccgaaacctgcggcttcccaaaaggctgcgtgtcatctacttcctggcccgcactcgcctggcccagcgcctcatcatggtacctgtcagccctgctctgccttgcaaggggcagcactcaaaccccaggggtggcactgcagggccttcctgagctctctgaccaggagctcctggcctgcctgttggggaagcagtgccaggatcagcagggaatgagctgcctctagagggaccaggacagggattctccaggataaagtcactttgcgtggtcagggttttcctgggccctggctaatcggcctccgtgtagcagcagagagcagtgggatgtgctggctgttgaggtggcagctaacggagagggtgggggtgaactgaggcccttgggaaggtttgcagtagcttaggtacctgggccctctggccaagctgaccagggaatagtaccagctttctgggcccag

SEQ ID NO: 35399 - DNA, 1159 bp, Mus musculus
ttggttcctggaacagtaatgggatggggacacttttgttgataaaggcacattacactgtgaccaagttcctttgggcctcttttcccagaccatggtactggccagtggaggacaagatggagccatctgcctgtgggatgtactaacaggcagccgggtcagccaaacatttgctcaccgtggagatgttacctccctcacctgtaccgcttcctgtgtcattagtagtggcctggatgacttcatcagtatctgggaccgcagcacaggcatcaagctgtactccattcagcaggtgaggaggcgggttataggtgttggtgtttgggggattgaacacccccaacattgaagacctcttctgcctttgcctgcaggacctgggctgtggtgcaagcttgggtgtcatctcagataaccttctggtgaccggcggccagggctgtgtctccttttgggacctaaactatggggacctgttacagacagtctacttgggcaagaacagtgaagcccagcctgcccggcagattttggtgttggacaatgctgccattgtctgcaactttggcagtgagctcagcctagtgtatgtgccctctgtgctggagaaactggactgaaggcaggtcaagtacgctattccctttcccccatcccaaggtggggcacaggggatagcaactctttggacctagactagaggcaatagctgactctgaactgttgtctcctgactgtaataataaacttttttaaaaaaccacatttaccaggggctgaagttcttgtcattccacactcctcctagacccttctcagagctgtccaagaaatgtgggctaggaacagcaaagggggaggggtctttggcacctctgaggcagcagtaggtgaactcaagacaatggccacagaataagtttattatttcagcagcccagggctggaaaaatgtcaggttcctcaagggagcagagcctgatctgaggcctgcagtgcatctccatctggcagagctgaaggcagcagggatgggaggtgtagtgtaaggatcagataggcaaagccttttcaggtcttgttgagtgtccagagtggatccaggaggctgagggggtcatccgtaggctgggcagcccttagaccctgcccg

SEQ ID NO: 35400 - DNA, 1148 bp, Mus musculus
tgtttctgtggatcacttcctgtgtttgtggggtttagcaggtgctaggaaacaagctctaatctaagtgggcgtttcagtgtcttgggggcagaaggcagagtggtgcctgatctgcctacctcaatgttacccttacctcagtgctgtcaggggtgttcacggatgtggaggcctccctgaaggacatcagggatctactggaggaagatgagctgcaagagcagaaattgcaggagaccctgggccaggccggggctggccctggcccctctgttgccaaggctgagcttgcagaggtgaggcgagaatgggccaagtacatggaagtgcatgaaaaggcttccttcaccaacagtgagctgcatcgtgctatgaacctgcatgttggtaacttgcgcctgctcagtggaccactggaccaggtgcgggctgccctacccacaccagccctcaccccaggtaagccccgcccgttgctatggggaaaggcttggaactagggtctctttgatctcactgactgctgccgccctcagaggacaaagccgtgctgcaaaacctaaagcgcatcctcgccaaggtgcaggagatgcgggaccagcgtgtgtccttggaacagcagctccgagagctgatccagaaggatgacatcactgcctctctggtcaccactgaccactcagagatgaaggtgggttgggtgagcagcgagacagggctctgtttctgggcttctccttaggtggtggtgtccccatcttccctcagaaactgtttgaggagcagctgaagaagtatgaccagctgaaggtctacctggagcagaacctggccgcccaggacaatgtcctccgtgccctgactgaggccaacgtgcagtatgcagccgtgcggcgggtgcttagtgagctggaccaaaagtcagtacctgcctttgttcttaccgcagctccatccagagctctgtccctatagcttgcctcaatctggctttttgttttgcctaccaaggtggaactccacactacagaccctggtagcatcctatgaggcctatgaggacctgatgaagaagtcccaagaaggcaaggacttttatgcagacttggaaagcaaggtagctacccttctggaacgggcacaat

SEQ ID NO: 35401 - DNA, 1142 bp, Mus musculus
cgctattttccatccatttgccaaccctgggtgtccgtccaccttctctccagcaagatgggcctttacattcaagctacgaacgctggcgtcatggtataaaggcttacaaagaaatgtcttttgctgctgcaaggaagagattttctatttcttcccctgatcttggcaaatgacctcgtgaagagactcaatgctcctcctccctctggatgggaccttaccatagcacagaaggacccagagggagactgtctcttaccagtgcactgggcagtggggcagaccttcaactgccgctgccaaaatctgctttcctaaaatccttccagtagcgacgagaaggatataattgtttctagccccaaactgggtcttagggtccggtctgttccactgtccacctgattggtttcttgccctctgctgcctgcctggatcggcctagaagacggttcaggcggctctgggtgaagcctgcgggggcaggggggtggtccctttccccagaccatcaggtttcccagtgtgtgcaattgccatagattcagaaggaaggactcttgttccctgcaatgtaaagagccgggcctctgctctaagcacttgaaaataatgtttttatcttaaaagactgaacaatctggtaactgatacatcttaactaggctcccagtggagcgccagcatttcttcctgcccctcagtttgcctgctgaggtagactctaggggactatgggtcttggtttcctcttagtcctattaggaggggtgtatccacgctcctcttattaagtccttctgtgaatgtactgcccagcctcgactgtgaaggtgctgagaaccagtccgtgggctcccaggtgggcctcctgggtcctcacgatgcaagcagactgcatccctagagatgatacgccatctccccaccccccccgccaccccaccccggcctgctgctgccaggttaaccttcctgcctccactcccacctcctagtgtagacagtgtttccaagaaccatcaagtcagtgttttgatctaggctctgagcacacaagcgaacagaaacatttttatactcccctgtctgagggcgatggctgatctgtctcagtgtcagaactgtaggatcatgtg

SEQ ID NO: 35402 - DNA, 1223 bp, Mus musculus
attggcccagaactatgtagcccttgcagtatttgaacttgaatctttttgcctcagtgggctgtatagcttagataactggcgtcattcatcataatatgtcattacttcattctaacttccataaatacctgttagtggatcaactgaattgctatttagatctacatttggggataggatttttgtatgtttctcttaaggagcgcataaaagatgtagctgtgcttgagttgccacagagcaacatacttaaaatatacatccttgtcacgctcttcctagcttttcccttctatgtagatagtcttcagtatgccttggtacacgcatgtacaccagacttggtgttttagtcttcctagaaataaatgcatctatacttgtgtaaaaatgtgattcttcaacatgcccactgccccttatcccatttaattgctgccttctttctatctcatactttatacttaggcagtagtgaatgaattttcttgtagaacttgttctgttttcaatttctgccttttatttgggatcactccaaaagtatattcattaaaattaatcctctggattctttacatccctggtcttttaaacaaaattgtctcctactttgctgctacattgtatatttctcagtctttatatttacttcttatgttggaattacttttgtaacaatcattttttgttacttattagaaaaagtaaggcctcaagctcagaactactgctttactcatttggtttctgttacttctcctagtggtttgcaccagcttcaggaaacagttattacaaaaaatagagcatgaaagagtggatgggttttataaggatctgttttaattcaaagttacattttgtttgaagtatttatgattctgttttattcttttgcatgttttcttggctgaatgggagtagagaagaagaaaatgaggtaagtataattgaattagtcatttaagaaatggccttttaagttcatttattacagctgaaactatttaaagttaactatcattttggttgtgaaatgaagttaatagtttaatcaatttggttattgtgagctataataactcatctcaagaaagtcttttttttttattttatgtacattggtgttttacctgcatgtatgtatgtatgagggtgttggaagccctggaactggagttacagacagttgtgagctgccatgtgggtgctaaggt

SEQ ID NO: 35403 - DNA, 1116 bp, Mus musculus
aatacatgtgatgaatataagcagagcattggtagcactagttcagcttctcataaccattttgatggtttgtatgagcctatagggagttcaggtatttcatctctccagagtcctccgtcaggaataagatgtgaagaaaacacatctccaactctagatgcagtggagagtaaaaaaggcatagattttttaaagtatgcacggaaagaaacagatgttggtagtgcccttcctgattcaggaaaaggattttcttgggaaaacaggcataataatgtgttatctgggcagtctttgcaagaggctcaagaagaagggaattccatattgcatgagagaagaggaagaccagaaatccccttagatgaggaacaaagaggccatacacatatttctgatgattcagaagtggtatttccttatgatttgaacttgaccatggaagacagtgatggtataacctacaccttaaaatgtgatagtagtggaaatgctccagagattgtatctactgtccatgaagactattctggatcttctgcaagttcaagcgatgaaagtgattctgaagatacagagtctgatgatagcagtattccaagaaaccgactccagtctgttgtggttgtgccaaagaattctactttgcccatggaagagacaagtccctgttcttctcggagcagtcagagctacaaacattattctgaccgctgggaagatggattagagaccaggagacatgcatatgaggaagagtatgagagtaaaggctgttctcaaactgaaaaatacttccttcataaaggaacagagagaagtgcagaaagttgttattcacagtttggcaggaaagcagataatcacctgcctgacattgctcatgctcagagtgacggggttgatagtacaagtcagacagactcgagatctgaccatctaggtcacctgaatccagaggacacattaagagccaaaacatctaggccacaagagctaccagtttattctgacgattttgaagatctcccaaataagtctcggcagcagatgattttctctaatcggccagatagtagtagactaggaaaaacagagctgagtttttcttcc

SEQ ID NO: 35404 - DNA, 1080 bp, Mus musculus
gatggagaagcagtgatgtaggtggaggatgagaattcaaggccgctcttgcttgtgtatcaagttgagaacagcctggcctacatgagaccctttctcaaaaaacacaaagcaaaatgaagaagaaaaagaattcattatagaaataccaacttcgggctggtgagatggctcagtgggtaagagcacccgactgctcttctgaaggtccagagttcaaatcccagcaaccacatggtggctcacaaccatctgtaacaaagatctgactccctcttctggtgtgtctgaagacagctacagtgtacttacatataataataaaataaatcttaaaaataaaaaaaatacataccaacttcagtatatatgtatgaagagaataatatccttgtttatccatcctttatcaacttttggataatattctttgacttataccaaccatattgtactccttttggagcttggagagatggcatagtggttaagagcactgactgctcttccagaggacttgggttcaattcccagcacctgcatgggagctcacaactgtctggaactccagtctcatgggatctgacatcctcacagagacatacatgcaggtaaaacacaggcatacaaataaaccataaatcaatggcttttgaaggctgagtggcggcatactcctttgatcccatcagttaggaaatagaggcacgtggatctctgtgagtttcaaggctaccctgggtctgcattgtaaatccaagccagccagggctctgaagttagcaaggtagagtggtatatgcttgtcttcccacattgaaaccgtggaaggaacaatattaaatagaaccaataaagtgaaggggtagaaatttcaagtagggtgtagaattctgaaagcttccctcctccccagattatacctttattacctttgatgcttatattaaaaggcacagagattaagtttctaggatattttaatccttgctattatagaagaagatttaattttcttactttgtctagtgtggggttttttttttgttgttgttattttttgtttttgttttttttacc

SEQ ID NO: 35405 - DNA, 1155 bp, Mus musculus
aactgtgttagcaattttatttctagcacaaataatttatatagcttcttattttcatgtttcaataagtagttttattggcctgttttacctgacaggtgatacaagattaggaaaacgatgaagccagtcctgctggtgcatgtctgtaatcaagctacgtgggaggctgaggcaagaaagccataggttcaaagccagactgaccaacctgttgaaactgtctcaaaaatagaaagtagtgagggggctgaaaatgaagcatattagtagaactcttgttcaacttgtacaacccatggattgaatttgtcttccccactgcccccacacattcagaaattaagagaaggaatggtggtgaaaaaggaatatttttttttttacaagcagttcgtaggcatttctattagaagcaggtttgtaagtctattaatattaaaacgtttatatttcctgtaggttggtataattcttaacatgttgtcactcttacatgctttagttttgcaaacctcattctcctgttccctgacagcaaagaagctcagaagtgtttctgtgggtcagccaactgccggggctacttgggaggagaaaacagagtcagtatcagagctgcaggagggaagatgaaaaaggaacgctctcgaaagaaggattcagtaagttttcggctctctgttcaagttttaaggaaatagcttttctgattaatttaacaggaaaatccaggtttggagtagataccagaaaagaagtatggatggctgtttttattttactttaatagattataatagaaaactgcttaaagtttttggtttataattcctctgagcttgtctttgtttgggatggacacggctctgccaaatgtgcaggttaaggcacagtgtgcaggagtctgtttgttacctgttcccagggatcaaacccagatcatcaggaatggcaacaagcactgagccatctaacctgccctatatgtatatgtattttattgaataaacacaccagtttgtttaactgtgtcacacatatttgtattgtttatttgtgttttgccattatgaatgtgacagtagttagcatcataggcatttcctggtacatgttgtgcagacgtttttctgtatgttgttcttataagtg

SEQ ID NO: 35406 - DNA, 1109 bp, Mus musculus
tcaatcacacttagtggcatgggtaggcattatgtcattaccctgtactttttaattataggttctcttccatcttaaaaggaaacaatgttataaccttctacatctatatttatgaagacatagttgttaatttagtaagacagtacccaaaatgtactgttttctgtatctgagtcctcacctgattttgaaaggtccgctatacggagtgattgattaattttttattatgtttaatcagattataaagactttggagcatttgcccattcctactaaaaatatgttggaagaaagcaaagtacttccaattattcagcgctggtctcaaactaagactgctgttcctcagttaagtgaaggagacgggtattctagtgagaatacatcacgtgctcacacaccgcttaatacaccggacccttctgccaagccgagcacggaaatggatacagatactcccaagaaactcatattccgcagactgaagattataagtgaaaatagcatggacagtgcagtctcggacgtcactagtgagctagaatgcaaggatggcaaagaggaccttgatcagttagagactgtcactgtggaagaggatgaagagctgcagtcccagcagctcctcccacagcagctgtgcgagtccaaagttgagagtgaagccactattgaagtcagtaagttacccacatctgaaccggaggcagacacggagacagagcccaaagacagcaatggcacaaaactagaagaaactattgctgaggaaacaccatcccaagatgaagaagagggagtgtctgatgttgaaagtgagagaagccaggagccaccagataaaacagtggatataagtgatttggctaccaagttactagacagttggaaagatctaaaggtaagattaaccttttttgtgttgtcataacagaattatttagattccgtgtgctgtaacctaaataaaaactgacatttttagcaatgaatatttttgaaaaatggaatatgatctctcagtttgtgatagatgtgtctccagtgttaagtttttgtaagagccataactatcaaaccataatacagataatgtccatctt

SEQ ID NO: 35407 - DNA, 1696 bp, Mus musculus
gctgtgctttttgctgccttttctaatgatcccatctgcacagttgagcagcatgtctcctaccttctgtctgcagatgtctcagttcattgtccagtgcctgaatccttaccggaaacctgactgcaaggtgggcaggatcaccaccactgaagatttcaagcacctcgcccgaaaggtacttcccacacttctcatctgtctgtgcacctcaaagatgctctctcaggaagtatggcttatgtgccagatgctaaggcttggggcccaggagcaggaggcaaggttcagaggtaggaaaggagagatctaagagactttgaaagctcggtttctcctgtgtcctgtaccagcttgccccaatccaccctttgagttaattccaagcctgtcctccctgtcaagacattgtcccttcttctgatggtatctgtggtctctccttctgtgccccgaacagctgactcatggagttatgaataaggagctgaagtactgtaagaaccccgaggacctggagtgcaatgagaatgtgaaacacaaaaccaaggagtacatcaagaagtacatgcagaagtttggggctgtttacaaacctaaagaggacactgaactagagtgacctcaggccagagtggagtatgagcggaaaggatgaatcctgtggcttctgccctaccccacggccaaggctgtgctactgatgtgatgacccaccatcctgagcagttcaaacctgcaggtgtcagctgtaagctgcaaaagtgagctctgtctccaaatgacccctagttgtgagctgttggtgtaacagttacaggccatcagaggcagtagcctagggaagaccttggccacacgaccccattctcaaatctgggtctcccccttggcggtgctgtcagcgcacagacccatgcgcacctcccccagatcctttaccctgacaatatgtattatattttaatgtatatgtgaagatattgaaaataatttgtttttcctggtttttgttctgtttttgtttgctgttagcatctatgtgctggaatcaaggaaagactttgtgaggatagtataaattctcctgcaaggttggatttgttatcatgtaaatatcccaacgcaggctgccttgtggtttggccgccttgtgctatgttgataagattgatttactgcttcagatcactttactttatccaatttttactgaactttttatgtaaaaaataaaatcaattaaagaacttggaatgtgtgctccctcaaaattaatcaggtttgtttgtgttgatgtgaaaggatgtagtggtcctggtgtgtggaggctgagattaacctttctactgcagttcattataagcttggttcttgagcctgagcttacttgagcttacagtttagtcattccagaccagaggatgtctgtcctgagacctcattgccactggcttgttttaatttggctagtgggtcaatcaagagaaaatgtcttcactcttggctggagaatgtcactggaccattttgccttcagacttcacttctcccaccccacaggagtgttccttcagtgtgtggggcctagcttctcactttactttacactgggcctagacaagagagaaagcagcaaaggacaggacagctgtggcaggggtgcaggcaccggcatatggtaagagtgtctgtg

SEQ ID NO: 35408 - DNA, 1208 bp, Mus musculus
agaagatgcaatagcaagacgtttggatgcttccggaagatgacaaggcacatctgggagtgactgtccacaatggcaagcaaagggccatttacgtgtacctatgtgcacgtctgtgtgtgagagtgcccacagagggtgtaagagggcatcaacccccccaggagattgagttaaaggtggctgtgatccatccaatgtggtgttgggaacagaactcctgtcctgaggcggtacaagccccagtaaccacttagcaggcacgtgtggttcagggatcctgggggatcaaactcaggttgtcatacttggtggcatgtgtctgtctgctgagccattcttgccgctccagggccagccatgtagtcctttaacacatggtaaactctaatgtatttggaaagttctgccaagatggtctacctaggtgaggctgccgtggctccctatcttgaccactgtctgtcttcacagatacagccctgcaggggcaggacggggacagggaaggaatgtgggtaggagctgggggagccctagcccccaatacctcctccctatttccccctgagcctccaggggcctcgagcaacatcattcctgtctactgtgctctcctagctacagtgatccttggtctgctggcctatgtggccttcaaatggtaggtggtctgggtcctgtcctgtggcatcccctccatgcctggactctgaggcagttccttgtcttagtgccctctgccccctacagctggcgctcacataagcaaaggcaacagttggctaaagctcggactgtagagctaggggaccctgacagggaccagaggcgtggtgacagcaacgtcttcgtggactctcctcctagtctggagccctgtattcccagccagggtgagcacgtttcctagtctgtctgtagtcctttgtatttaactagtgcctcccctacccactaacacttctctcttcacccccacccccacccccacccaggaccacacccggaccttggctgccagctttacctgcatattccacagcagcagcaggaggaagtccagcggctcctgatgatgggtgagccagccaagggctggcaggagctggcaggccacctcggctaccaagctgaggctgtggaaaccatggcctgtgaccaaatgccagcctataccctgctaaggaactgggctgcccaagaag

SEQ ID NO: 35409 - DNA, 1197 bp, Mus musculus
aggaattcagcttagccagacttcaaatgaagacaaagtagatgcacgaaaaggtgtctgttagctggcttccttgcagttgtgactcagtgtacacctacttccctgctccagattgcggcccgccgtgcctcccctgcccatgaaagtgccggtccacagtgtgtctgtgaccaaggagcgcagtcatgtgctggtgggcctggaagatggcaaattgatcgttgtgggcgctgggcagccttctgaggtgaggaagagggcagcttggccggccgggcaggagggtggcgggttgtggggtgcggctgccagggctcaccgcatctcatcccatccctactcccgctaggtacgcagcagccagttcgcgcggaggctgtggcgctcctcgcggcgaatctcccaggtgtcctctggggagactgaatacaatcctggcgaggctcgctgaacctagagtctaggcgctcagacatcagacccggcccgagcctgattctctgcccaggagactactgcaccagggggtgggcggggcccaccctccagctcagggattggtagatggcatcaccaggaagtcccgcccctcgccggctgaggggagacctagcgtcggcctctgaggccgctgctgcatattttgcacaatctggggtgggagggaatccctactttcaaatcccacgtcccagtgaaagcacaaagaccacctgtggccttaatcctcaaaggtgactatcgctgcccattctcagcaataaacgtggcctagttttgtaatctttcggtttcttgagtacacatgtgccgccgtccttggcctcctgtggcccccagtcttagcctctgttaccctgtctggcctggcatgcttcttcctggccaggctggcctcggtgtagccagcggaggcgcctctggctttgccagacgtttcctgactcctggttctcagctctcgcggtccattgcatggcatttgcatgccagtggcctgctctgccaggcacgctggtgtcggcttctgtgaactccgagtgcttctgcgtgctccggcgtggggcgggggcgggaccgcgccctcgagctcggccccgcctcttcattgtcctgctcccctcttcaacaccacccccccactggcccgccccttgccttggctcactcttgggcagaccggaacctgccctc

SEQ ID NO: 35410 - DNA, 1197 bp, Mus musculus; identical to SEQ ID NO: 35409

SEQ ID NO: 35411 - DNA, 1120 bp, Mus musculus
tagacgctgaagaggggaagtggccttggcaggtgagcgttcgggtcaggcacatgcatgtctgtggaggttccctcatcaattcccagtgggtgctgactgccgcccattgtatttacaggtgaggagtcttggggagggatctggagggaaaccctgctgtctaatctacctgcctgacagaaacattccagaacaaaagaagggggtggccgtgctatgaccatcttgttactagaaatatttagggtgtggcacaggcaaaacagttgagagattaataaagagttttagtgacagacacaggatgatagagatttgggacatgttgagaagcagggacggagtggaaggggtataagagagcttggtggggtcatggctaacgaggcaacacattttttccatagccgaatccagtacaacgtcaaggtgggcgatcggagtgtctaccgacagaatacaagtctggtgattcccatcaagaccatctttgtccaccctaagttctcaacaactatcgtcgttaaaaatgatattgctcttctcaagctccaacaccctgtgaatttcaccactaacatataccctgtctgcatcccttcagagagttttcctgtaaaagctgggaccaaatgttgggtgacaggatggggaaaactagtgccaggcggtaagactggtgctcagaagaccttcttcctggggtagaaacaaaagatcccaaggggcacagaagagaagcagactccttggcaggcatgtgtgtgtgtttgtgtgtgtgtgtatgtgtgtgtgtgtgtgtgtgtgtgtgttgttgggtaggcagtttggcagaaatcaaggtcatggtcagcttaagtgatccttggtcttgtgttgaaatcttttgtcacaacgcaaacatctgatgacagcccacagaaggtatccctctctcctgggaactggaaatgtgtcaaatctccttttgcagatttgtggggcagtatgctgaatggttataggaattgctactttcccagtggacaaaggccaaatgtgatggaattctcctgtgtggatatccagatctgatttattttatttggtgtgttataagtgttttgcctccatgcat

SEQ ID NO: 35412 - DNA, 2041 bp, Mus musculus
tccccactctatgtggctagggcttttaaaattgactgtggaagttcattaagcaaatgtctttaccattgcatcctgggtattgtatatagattagcaaggaacggtagagtgattagatgaatggaggccatattttcttcctggaattttggttctgttgtccccttaccagagcctaaccaaggtctgcaccatctgtggttttgatgtaagatcttcggggagcgtaagagtgttatgtagctactgctgatcctgtaggtgaatacactgtcctctttgagttaggccccagcagagttctggatcgtgaaggcagcagggagctggaaggatttcctttagtgactgagtatctcaacctttcagatggtcacgtgatggaccaggacctcaaagcatccgggactccgtgtcaaacgccgtctgtgacgaccacttttatgctagctggcgcctgcctttttctagatatgaaagtataggtgtcatgtgaattccatgccagtgccatagcaaagatgtcattcatcttgatgctcacagtgaatccctaatgttacccctcaaaacactaactaggccttacctctgcacagcccctcctctttctggaaaactatggcgtgtgtgccaagcactgtaacagcgagttacattcctagcctaaaagctactctaagaatgtgctgtctgccatagcctgagtttcttgatagaagtaactctcttacttttcttcctaagacttttaaacagttctgaaggttattattaaatcccaatgtgcaactggaagtaaattcagagtagctgaaaacagctaaattatctttaagcagggaggtggtggtgtctaccttaaatcaggcaaaggcaggtatatttcttgagttccaggacagacaggcctacacagaaaccctgtctcggggagaaaaaagagagagagagaagaaaaactattatcttaaaagaaaattaatggaccaggcattgtggcagatggctttaatcccagccctcaggaggtagggataggaggatctcaagagttcaaggccagcctggtctatgtagcgaacccctgtctcaaaaaggaaaaagcatcctacgagggagttgaggaagtaatgagggtctgtgcagagggagcagcagatggggaagtgactaagactggggaaacagagtggattgtttgattgatgtttacggaggtactgggaatttaaaagctaagttcttcagccaagcacagtggtgcacactattaatgtcagctctcaggaggctacaacaggactactaaaagctcatgtccaacctgggctatgtacagagtaccaggccaacaaagactgaatggcaagaccctcacagaaaacccaaacacccgagtctcttttctgcaaaagtacgaaggctttctccaagctatatacaattattcaactgttgtggaggaaagaaagtgtttattattgtagtagtaaaccagattataaaaaccacgtattgtcaagtcagtttttataataattgttcatgaatatgcacagtaaaaatgggaactctgaacaaaatgtgagtagtgccttatttctaagtggtaagttaaatagtttgttgtttactatgtatacagcattctgtctgggccagaaaggcaccagatctcattcgattatgagccaccatgtggttgctgggacttgaactcaggacctctggaagagcagccagtgctcttaaccactgagccatctctttagcccccctttttcttattttttgaaatgtggtcttactttgaacgtagcataggctagccttgaccttgatctttcagcttcttgagcaggactagaggtgtgcaccgccacccagtctgttctttgcaatgctgaagaccaatgcaggccttcctgtgttctatgcaaacattctgcctgctgagctacattgtcagaaccaccccagccccaagaagcatcaaaagccaggtattatatctcacatctgtaatctcagcact

SEQ ID NO: 35413 - DNA, 2059 bp, Mus musculus
cggaggatgaccttgaactcctcatcctcctgcttccaccacctgagtatgggaagtacaggcatgctcagtttatgtgatgctagggatcagaaccagggctctgtgcatgctagggaggcgctctgccaactgagccatgtgggggatgattaaagaaaaagacggatgaattgcgtgtggctcagtggagaaaagaaagaatgaataaatggatgtgttagagaaaccactgctccagaaggaaaataccttcatactctgtaaatgctgctaagaaaataatcaaggagtaaatatagatataaatatatatccctgctatcctgaaaccaaagttccagacggtggttgtgaccagtgtgtgggtgctgggaatcaaacccaggccctctggcagagcagctagtgatcttgactgcagagacatctctccaacacacagaagaggaattttgctgttgaacagtcccagtaaacacgtgcgctttctgtgctttccctacagatttgtaagccttgtggacaatcccattgataagaccggatgtcaagacactgaagacacagtagagagcgagcgggaccgccagcattttgataaggaatttatgaaagcatatattgaagaccttaaagaaagaggtgagttgggacaatgtaaaaaccgtctaagggctggtgagatggctcagtggttaagagcactgactgctcttctgaaggtcctgtgttcaaatcccagcaaccacatggtggcttacaaccatccataatgagatctgacaccctcttctggtgtgtctgaagacagctacagtgtaattacatataataaataaataaatcttaaaaaaaaaacaaaaacaaaaaccgccgggcaccacgcctttaatcccagcacttgggaggcagaggcaggtggatttctgagtttgaggccagcctggtctacaaagtgagttccaggacagccagggctacacagagaaaccctgtctcgaaaaaccaaaaaccaaaccaaaacaaaaaacaacaacaacgacaacaaaaaaaacccaaaacaaaaaacatctaaaatgatataaattgacaaaaaaaattatttgtggctatttgtgaaccacaatgatagcatgcattcctttgatcccagcattcaggaggcataggcaggtggatctcagtgagttcaaggccagcctggtccagctccacccagagaaactctgttttgaaaacaaacaaacaaaaaaggtaaataagtaaataaaaatctaagtatatatttctattttttctttattacagaagctgttcccagttatacgaccaaagtgtcatttagtcttcagctttgattcggttcaccagaagatgacaaaaatcttactgccccgtgctctaaatctttgaatatgtgttacctcttattggaattgcggcttgtgcttaaggacaaagtctagaaactactaccatcatcactgttaagaaagataacattcaaattattgataaacttgcttatatattaatgttagcagacgaatgcacatacttgtcctaaatactgcatatttaataatttaggaaacacatcacttaaaaattacaacatttaaaaaaattacaacacctagaacaagttttgaaattggatgcattatgttcaggaatcaagggctagagggttgtgggtgaaatggagaatttaccaccttgaaaatgtttcagggggctggctcagtggttaagagagcctgttcttccgaaggtccagagttcaaatcccagcaaccacatggtggctcacaaccatccgtaacaaaatctgatgccctcttctggagtgtctgaagacaactacagagtacttacatatagtaaataaataaatctaaaaaaaaaaaaaaaaagaaaaagaaaatatttcagtatactgtttatttttattgagaacaacgctccttgagtctaaacaacttcctacttccatatttcaaatttattttggcaagtacattttaagttgtactttgactctcaggagagcctg

SEQ ID NO: 35414 - DNA, 1200 bp, Mus musculus
aactcaggacctctggaagaaagccagtgttcttaactgtggagccatcttaccagcccctattttttggtgtcattcttgttgccacagccctgcctcagcctcccgagtgttgggagaatagctgtgtgccagcacaccacgcatatgctgtgttggaaaatgtacagcttctcacctagccccccgtggctctagtacagatgggcttcagagcgtttccttggcaccttctccttgattctgacttcacaactttttttttgttattggtgataacataattttttgtcacatgtaacaatttatagaaatgttcttatctgtttgagcttctaaatgctacttgtgacatagaaatgcatttaataaagaaatgcaaaacctgcacactgaaaacatgatgtctcatggcaaaataaggaggacgaaataactgcaagaatcctatgactttgagactggggcttaatgttgctaaggcagtccccaaagtgagtcatagagtccttgtaattgccattttaattcagggtgcatttttctttgtcatttatttattaaaaaaaaaaaaagacaaacttcctaaaatttacatggaagtgcacaggattctcagaccaaaaatcttaaaggaacaagataaaagttggatgactcacttttccaactttaacaattatacaaagccatgtatggcttcaaagtaatgaagatggtgtacaatataaagaaaagtatatagattgatggaataaaaccaagttaaccctcgcgtcaccatgtgcctgtactttgatagccaggagactagaaattctgtttacttctataattagtgtggatgggcagtgtgtgggcatgctaggcgaaggtgtgaggtaagagagcaatgcttgggactgggcttttccccttgcgcctttacatgagttgggacttgaacacgtgttgtccagcttgcttggcaagcacttaaacccatgaactcatcctggtttaccacctgatgtctcataagggcggcaggataagttcctagagaaagagtagtattttcagcaaatagtgccaggacaagtagatgttcacatgtaaaagaataaaattggatccctgcctcatccgtattcaaagttaacttcatgaatcatagaagcaggagttaatattctggccttgggataggcaatagttttt

SEQ ID NO: 35415 - DNA, 1140 bp, Mus musculus
gctttaaaaaaaacaaagagacaaagacaggtttctctgtgtagccctggctgccctggaactccttttgtagaccagattggcctcaaactcagaaatctgcctgtctctgctttccattgctgggagcttttttgagggaacacctttaaatttaacagaattagcagcaacaattaaggcagcaaatgcagttcgtgccgatgcacttgtcattgcattttatataaaagtctaggacactgatgctagtcacttaatccttgccggtctcagatgctcactggagatgtcgatggtgatagctgcgcatgctcagcctcactctatcttaagtcccagacatattcaaaggatccccttgcccagctcagctgcctacttcataagcttaaacatttgttttctacattttattttatatgtctgagtgctttgcttgcatatgtctgatacaccatgtgtgtgtctggtgcccacggaagtcagaagagggcattagatggcctggaactagagttacagatggttgttagccgtcgtgtggatgctaggaactgaatcccaggtcctctgcaagaacagcaaagtgctcctaatcactgagctctctctagggccatagttcacagaattttaagtgttttttttttttttcctactacatttgcagaccagctggcagtagggctggactggcctgcatctgcatgtccattaatactgatactggttgggtctcctttcttgttttcgtttagggcactttcatgatgttttttttctggtaccaaatccacttgtgtgtgtgtgtgtgtgtgtgtgtgtgtgtgtgtgtgtgtatgtgtgtgtgtgtgtgtgtgtgtgtgtgtgtgtatgtgtgtgtgtgtgtgtatgtgtgtgtgtgtgtgtgtgtatgtgtgtgtgtgtgtatgtgtgtatgtgtgtgtgtgtgtatgcatgaatgtatgtatgtatgtatgtatgtatgatcgctctatgttgcctagtatgctgtaggacctgaactgctgtggtccttctccctcagcctgctaagtaactgaaactaactgagattacaagttcatcctacaacacttagtgtgggttgttattgttcgagacagtctctactta

SEQ ID NO: 35416 - DNA, 1227 bp, Mus musculus
gatgaagcacagaaagggtcgagcttatttgatgggaaccagagggttgggaaacaacattttgtttgtgaggcatccaaggcttacactgagcaatggtgaggcaagtttaccctccatggggtcagacaccccagatatggtgggagctatgatccaggagccagtctcagaaatgttaggaagaggagataaagatctctcccataggccatgctcccttaaataattgcttcctttgcttccttacaagccttgtttcctctgctcagccctgtgggatctcaagcctcctgcagaggctgctttgtaagccttgcacagctcacccacactcaccactgagacctttccaggcgcagtgcctgtcttgtcattatgtggggagataagtggtgtgtcatatattttccagagtgacatgcctggctccacgtcaaagccctggaagtggactgtggagcacattatctataaagccttccgctcacacctcctacctccgaagcatttcacagaagatggcaatgtcctgcagcttgccaacctgccagatctatacaaagtctttgagcggtgttaaatacaatcatagccaccgtagagactgcatgaccatccaaggcgaagtgtatggtactaatctggaagccacagaataggacacttggtttccaagctccagggtttccagtgctcactattcttgttctgtatcccagtattggtgctgcaacttaatgtacttcacctgtggattggctgcaaataaactcacgtgtattggtgtgattttttttttttatataaccgcacattggaaaactttctaaaatgattttcaactagtaaatactgggtagagttgatgatgtcaaaaagaagtttgaaagcctctgggcactgaggaggcatttctacacacactcttaaaaaagctcttcaagtttccccaaatcatgttctgatggtggtggtctggaaagctgctgtctgacaccaagcttcgtcagttcagattcctttaaaagaatccctggaatagcatttttgagaagcccgtgtccatgtcttaggtttcctgcatctcatccctcaaggttcaggcttaattaaatccatcttaaaactttcttaactctagttttgcaaaacaaatcccaaggttgggcactgtgcatgtcttgactccagcacttgggaggcagagacaggtagatctatgtg

SEQ ID NO: 35417 - DNA, 1200 bp, Mus musculus
tgcggagggtgacggggccctgtgcctggtgtgtcgccgcctggtcgcctctactcgggaacgcgacgtgaggcgccactacgaggccgagcacgaattctacgagcggtttgtaggggacgaggaacgcgcggccctggtcgagcgtctgcggcagggtgacatgtctttggccgccgtgctcactccggaggagagagcgacccgggcaggcctcggcctctgccgcttcttggccttgaagggtcgcggctggggtgagggtgacttcgtacaccagtgcatggaggtgttgctgagagaggtgctgccggatcacgtcggcgtcctggaaggcattgacttgtctccagagatcacacggcagaggattctgagcattgacagcaacctccgcagccagctgtttaaccgagccagggactttaaggcctattcccttgctttggatgaccaggcttttgtggcctatgagaactacctgctggtcttcatccgtggcgtcggccgcgacctggaggtgcaagaagatcttctgacgattatcaacctgactcatcacttcagtgttggggctctcatgtcggcaattctggaagccctgcagacagcagggctcagcttacagcgaatggttggactgaccacgacccacactttaaggatgatcggcgagaactccggactggtctcctacatgagagagaaggccgtgagtcccaactgttggaacgtaatccactattcgggatttcttcacttggaactgttgagttcttatgatgttgatattaatcagatcataaataccatatctgaatgggtagttatgattaagaccagaggtgttaggcgaccggagtttcagcctctactaactgagtctgagtcagagcatggtgaaagagttaacggacggtgtttgaacaactggctgagaagaggcaaaacgttaaaactaatattttcactaagaaaagaaatcgaggcgttcttggtctcagtgggggcaacaacagttcatttctcagacaagcagtggctttgtgattttggtttcttggtagatattatggactatcttcgagagatcagtgaagaactgcagatcagtaaagtctttgctgctgctgcctttgaacgcatctgcacctttgagggtaagctgagttcacttcagagacatatggaggaagtaaa

SEQ ID NO: 35418 - DNA, 1135 bp, Mus musculus
gacttagaacttttctcaaatccatttagctttaaaccggaatatgcgcctatttctgtaagagtggagctaacaaaacttcaggccaacactgacctgtggaatgagtacagagtcaaagacttgggacagttttatgcaggactgtctggtgaagcttacccaattatcaaaggggttgcctataaggtggcatccttatttgatagtaaccagatctgtgataaggcttttgcatatttaactcgaaaccagcacacattgagccagccactgacggatgagcatctccaagcactgtttcgagttgccacaactgaaatggatcctcgttgggatgatcttgtgagagaaagaaatgattcgtaagccgttgtggtccaagaagttgatttgaaaagggaaaattaatttgatttttctttcacatttcctcatttggatggttggaaagcattgaacttactacagatgttcaaattgataagcattgaaatctttctgacaagttgcctttctccatctcatttggcaacatgggactgactgaagcataagaataccacctttaaaaaacttagtttaatggaaaagtcattgttctttccttttattattactgattttcaacaaatttagtattgatattgtcagttgaactagaagtctggttttaaaatggtttaaagatatatgccaaaagtttcagctcttattttgacacagtggaaagtgtgacacgtggtttgaaatgaccaactccttaaaagtgtatttgagccagtttacagaaactcacatatcaaattaagtttctgaaaaggaatagcataaacacagtggaggtattttatctagataacagaatttaagattattttttaaagcatatttctaagtaaatacaatccccccatccccacctacccagttgatggtgacattacggatggaggaagtaatcaatttggtgttggagcagcaagaattattttaaattcctgatttaggagtttcttactatcaggagttaagaataaccaattattggtggtttgctccttattttttcacagctggagcaattttttcagctcatctatcaaaggaccatggtaagtatggaatcttgatc

SEQ ID NO: 35419 - DNA, 1140 bp, Mus musculus
agtcatccagagatttgatcctgttgcaaaactaggtttttgtcaaccttcaggttaagggtttctcatttttatctcgtatttaaaaagttgtttcatcctacagtgtaagaacgttataaatactctatcatttctgccttgaaactgaccaaatactgaattcatgtatactttgtctaaagcagccaatggccaccacaaagtatttttttttcttctttaataaagggtagatgtcccatctcccagctcatctcaaggggcacctctctagaacataacttgtccctgtgtcgttattttgttctatcttccagtagcgtctccctgatgcctcccaaataatcactaagcaaactgtttagtgttttagttctgcatcaggattgctgaagttgccggaagcagacaaaagtttagttgtttgtgacaggttgtctgagctgtcagactccaacccctacaggccaagtctgtcctggcccatccttctctgaggaaattattacaggagttagagccgtgtctgtctaggaactgtcatggctgctcccctctacagttgcagacttgagtagttgtgacactgtgtgcaacacaagctaaaatactttttggaaaagttcactgtttcctgctttaaattgtccctacctaccctggggactaagcagatatactcaataggagtcgacagcccactctgggcaaagagaaaagaaagtttggctctgtaagcccatagccacaccagatctcaagtgcaaattcctccatacaggtgggaggaaggtgaactatttggaagataacactactggtcctagttacatcactctaaatatgtctttgctttttcattgagataaaagtttacaaatattcagtgtccacttctttttatattcacctgtgaatgcacctctcagatcaaggtaggaaatatttctgttactccagtaggtgccctttgcctctcacagatagagaactgctggtctgacttgtattgcctgtcagttagttttgcctgttttaaatgtatatcaagaggaattaaatacactgttgtatcctctgttctctgtgtctgctatagtagtccatgttgtggagtgtaacacctcatttttcact

SEQ ID NO: 35420 - DNA, 1228 bp, Mus musculus
ataaagaagaaaataatccttgccatccagcagttgggaaatggtgagtggacccagggcctgcagaagaggctgaaacactcaaaagggaatatccagctctttgaagcaaagctggacaaaggtgccaggatgctgtgggagcttgccatcgacttctctgctcggtgcagtgagaactctgagaaaattataggtacggagcggaacacctactccctggaaaaatcagggcgggtctatacagaaatcatccgcatctgggacattgtcttagatcactgcaagctgtcagattccatcatggctatctgtagtgcctacacccggggcctgtcctgtgtccttcgaaagaagctgaagggtatcaacaaaggacaggtatcagctaacatgaaaatccaaaagcggataccccgctgctatgtggaagacacagaggccgagaagagcttagagcaggtagatcctgagtactttcctccagccagtgctgtggagacagagtacagcatcatgaagttccacagcttcagtaccaacatggccttaaacattctcaatgatatgacagcaacggtggagtatccattccgagtgggcgagcttgagtacgccgtgattgacctcaaccctaagcccctagagcccatcatcctcattggacggagcggcactggaaaaacaacctgttgcttgtacaggctttggaagaaattccatgtttactgggagaaggctgagcaggcaggaagcccattgctgtccaaacagatcttgccaaagagaaggttggaagtagaaccaggaaaagagggtccaggtcgagaggaagaagaacatgaggaagaggagggttccatcaaagtggaaacggtggatggtatagatgaggagcaagagagtgaagcctgtgcaggaggagccacagtggagccagcaggggacagccaaggagcagagggatgtgtgccggaccacccacaccagctggagcatctacatcagatctttgtgacgaagaaccatgtcctgtgccaggaggtgcaaagaaattttattgagctctccaagtccaccaaggccaccagtcactataaaccactggatcccaatgtccacaaactccaggacctgagggatgaaaacttccctctgtttgtgacttctaaacagcttctcctcctgctcgatgcctctctgccaaaacctttttttctgagaaacg

SEQ ID NO: 35421 - DNA, 1234 bp, Mus musculus
cagggcaggctgtgtttgtgatgaccgaggcaggagccctggcttcgatgctccacgagagccactttccctttgctcccagcatcaggacaaagagcatttgctgagcattgcctggtgagccagctgctgagccagatagtgggttcagcactgccccagactcatagagacttctcagctgtagataagaccagcaatcccaagagatgaccaataacgcaagttcagaacagaactgctgttctgagaaagaagctggtaccaagtcggggcatctcagaggaagcagaacttgtaatttagtggtgaagcaagggtaaggttgaagaatacaaaatgtagggagggctggctacctggagcaagctgggcatgcataagatgtatctgcctaggaggtggaggtttcaggatacttttggaagatagcagcaaggaaggttctagaagatggtaaaaaaaatgactttaggtgtgagtgtcaagctaacagtaacatcaaagagccattttctgattaatgcgtaatttcattcatatgcactattgcattttgggaaccaatttcctatatctccatctgtccatactgtttgccccgtctttgaacttccccgagtgtggaatatattccttgctccgtggctttgaggccagctgtaaactcgctttgaccaccaagggcgaggctggagatacaggtttgcattggggccttacttctgtcgctaaatactgcagtgaccgaggtgtcccagcagagactgctggcccgtggaggatgcagatcctacccaagagagccttggtctcagtgagagtttcctcagtcactgcagccaaggctggaccacccagccatgccccactttgatcagctaatcgctggccataacacattcagagattaatccatgtatctacatgtcctgtcaatgcatgagctcaataaatctgtctgtatgtacatgctcctgcacacgtgagggcagatgtgcacatctgtgtgtggaggtcagaggtcaatgtcagggaaggtcttccttaatcaggtcccatgagaaaaggacaaaactggctcacaaaaagttgttccctggcttttatatgtgttgtggcatacacgtgtctatacatgtacattacacatacacaataaagcaatacaattttaaatgtgaaaaaaattctttagaaagtaaatatttcaagctctcaaactatgacacct

SEQ ID NO: 35422 - DNA, 1116 bp, Mus musculus
gcaatggtacccggagggttacaaaccaggagacaaaacaaaacaaaactctctgattagtcattggctgagtgtgttccctggggtgctaattacctgccaccatggtctttctgtatagaaggccaagcctgtgtcagtggtcagagggctccttcaggcaggagcagcagacacgcattggaaactttctgcgagcagtgggcaggaaggggtgagctgtggtagcatctcccacagcctgccctcccatctccatgcgattcacaggctctcaaccctacagctccatcccttcactgcctgtatccgtgcagatgcttcagcagctccttccagcctgtgtgctccggttcacagcaatctgctgtccatcaccacatggttaccctcagtgcaccttcagacggggtgctttggtccacacccacacaccagtcacagcactgcctccacgacagcggggtcggatggccttcatcctgcatctctcagagctcttccttctcgccagacacaggctgtgtggcactcctgggtttaggattgaccctatccagttttctccgaggccctagagatgagcacatggtttggcatcctaaacaaatgctccagactgaaccgggcatctatggctcatcgtttagcatgcagttgggactcattatctgtgtcccgagttgaacccacccttgtcttgcttggctgcctctttttagaataagcaataccaaaaaggagacaaaaccagaatcttacctctccctagggataagcttgttattttttgtcaaccctgtgagattagagctggaggtggtgaccaagggggatccggaagccagagaagacaggaggtcatcgggatacacacgtgtgcacacaccgtacatgtgaataggcagagctgtagcaaaaatgaaaagagaggaaacttaacagactgggagaggctgagcccagaagatggactgtcagggatgaatagaggtaagaagaaaagacaggaagagggaagattggaaagatagggccaagaggaggagaaaatatggccaaaccatatcctacttgggaaaatatagcacaaaagccctggagagagactctctg

SEQ ID NO: 35423 - DNA, 1429 bp, Mus musculus
acgttggcttaaagtccgatagctaaaccttggcaaaacataacaaacatttcattgctcagcctcagtgctctggagtattcagtgtatgagacaggtttatttgagtcctctgtaaatggcatttgaattttatattctcccctcccgagtatcttataagacatcccctgagttagggagttcccagactgctactctattccttatgaatgcaaaacaaccaccaatagaacaaagaaaaagaaaaaaatggcctgaatattctcttgggaaagggggttggaggtctataaagggaagggtaagtgtatcagaaatccaaagggaggaggggtcaggccagcagccatttcctcatgctctgtgttatgcctgcagggtcacagaggacaggcagcgtggtggtggggggcagctccttccagtccccctgccccagctcagctcctgagggacacctcttgccaactctctcatcctttaagttgctcaggatgttcttcgggtctcaggctaggtgccattaagctgcagtgcttgctttgccttcttaagcctgtcctgtttgactggtggaaagccgactcacgtgcctacctactgtgcttcctaggaaactagatggcggccctcacctgggcgggcttgtcagcacaccctaacctctgctcggtttgctgtgctcttgagaacgcactgcagaagttactgtgctcgatggcaggtcgagggttccactctggctcgagtatgttatcccgtttataattagactttctgctaccttcttaaatgaaggcacctcccccgacccccacacacaccccggccatttatgttggctctctaagcctcttatgaaatggattgattacctgccagctactgaagctttgccgagacaccagtcagaagaggggaaagccatccaacttggatttcctgtccccagagatggatggcttgactactcagcatggtgtcagtctctgagctggagaactatttctctgttccttggtccctttcttgattgagaaaagtgctcgtgtcacactgcacagcagccagtctctgagacgccgggtctacactctggcacccttgcatttatgtccccagtatcagtgaggatgtggcagttgtatccccacctctgtcccagccagctacctttttagtcaagacagattagtggtttttgttttttttgttttccagttgtgatttacagtttgtaagcattcctttgtatacatttcctaatttcatgaacaggataaaatagtaagcaggccttggttggctagtgggagtttttaaaccaatgacgagtatgtcttgaagccttgctacagccctgtggcctatgatttctaagacttgtgcagctagttgactcacagtgtagaaccgggcacaagct

SEQ ID NO: 35424 - DNA, 1563 bp, Mus musculus
gacattgtatttggtttgttgatggctttggtcttgatattcgggtcctaattccctaccttttgcttttttcctgtgattcatacttcatagttgaaaattataaagaaatttgagactaaattgagtagtttttagtgttgaagtagcacttatctttctgttaagcatttagtgtagagctagatagtcagcctagtcaagggttgagttcggtctgtgtattgtgtttgctgttgattcctgtttgcttctggttcccctgagttagcttgatgaagggttttcttccgtatttcagtttcaggactctgcttgaatcctttcctgtttcctggaatgcttcttccctgtgcgctcactttgtcttgccagcctgattgtgaggtgtgggaccaatttcttaatttttctggtacagttgaggggcagtggactgtgctaggaaacttggtaaggttgaacaggatcctgccagtagcgtatgcttgtctcaaagattaagccatacatggctaagtccgcacggctggtacagtgaaactgaatggctcattaaatcagttatggttcttttggtcactcgccccctcctgctcggatggataactgtggacattctagagctaatgcatgctgagggtgttgccccatcccgggcaggggagatgcctgtgcatttatcagtaaaaaccaacccggctgtgggtgctgggggctttggtaactccagataaccttgggcagatctcttgcctcctgtggtggtgacgacccatttgaacgtctgccctattaatttaagatggtcgtagagcctaccatgttgaccacgggtgatggtgaatcagggttccattctggagagggagcctgagaaccggctaccacgtccaaggaaggcagcaggtgtgcaaattacccactcccgacatggggaggttgtgacaaaaaataacaatacaggactctcttgaggccctgtaattggaatgagtctactttaaatcctttaatgaggatccactggagtgcaagtcttgtgcctactggacataccccagctggcaacctacacagacccacatcggaactccagattaaacaaagactgtgagtaacccctggtgctagttccaaagactcaagccttccaattctaaagacagacactctgtcttcttcccacttttattttggacagagctactacaccaaccctgtccaaatccagatagtccaactgaccattaacaaaaactctgatccacactcctctctccctactccctacttcctccagtcctgccgataaggtgccaccaaatccatatgctgcttctcttcctgctctacttttagggtgtacaaaaaacattccacccctgccatcttctagcattaccaaccaaggcaaaacacgggggtgggggtgggctacctgctagagcagccatgacgtggcagagcaggcccttccccgtcccccaggtgaaaagagcctggcaagcaagaacaatagatgagattttgctgctgagaattcaaacaaaacaaaacaaa

SEQ ID NO: 35425 - DNA, 1158 bp, Mus musculus
ctttaacttacccttaagagcgcagctttataataactacaaactctcagcaaacgaaatgtctgagggcagtgggatgaatgggcaccagtaagctgtgatacattcctaccagaaagccgtaaggagcagagtgaaccttccagtaatatcttcttatctagtgaagagagattagacgccacagtggatactgtacttctctcctgtgtgaggattcaggactgactggtttagttagaggttctgagagtgcttgtaagagccaaggcgaaggcagtctttacagctgggtactgatcatactaatacattggctttgtgaaaatttattatttgtttcttggaatttgtatgcttagctttgttataattttttttaaatcctagtagcttgagaatgttaagagttaattttttaaatggtaaggacacttagacttttcagcttgtatgtataggatgagaacacggtttccatgggaacttctgcctcctctttcagtgcctgactttctgtaagatttttgtgtctgttctgtcatgtgtgtgtgtgtgtgtgtgtgtctttaagagttaacaaaaaaaaagtttattttgaattgttctgatttcttaacagagtgattatatataaagcacaagttttaagctcattaatttctccatactggcttcctaatggtgttatgataaagggatgttttatttaagctagaagaatttgagggtgggaggttgagggtagaagagatgttaacaaaacatttgctgaaacagaatgtaattttagattatttatttatttttcccattaacaatcttaaattttttggggtcttgcctttgtccctatctaatagttatattggtggtgagtcttcatgtattcagaatgagtgggcatttgtagagtgagaacagaagggacaggaagaaaattgtcacatattgatctgaagtctgtggtaaagctgcttctctgcctcacccatcttgtttgccatggttggtttgcgcagggtcctagagaaaacggtttgtcagcagagtgcatggcatctgtcttgtgagtggaggagggagaagttgactggaggctgtgggcttgtatgtgaggagaggatagcagtgtcaccgtgcatactccggaaggag

SEQ ID NO: 35426 - DNA, 1172 bp, Mus musculus
tgcagaaaatgatttttgactaatgtaaaatttgtctgtgtacttgtagaaacagatcttgaaagaattaattcagttacagagttatagcagttaatagtgtccttccaccacacatgttgacctgtgctccaggtttccatctgtcttagtctgtccaggctgctataacatgcaatagctcagtactcctaagtaactaggacttactcctcagtactgtgaaggcccagtgtctgctgaggacccttctggctcctgcatgctgtcctccgtagaagaagtccttagctctctggagtgcctttaatgctctcataactagattgcctctcagaggcaccacctacctttaacacttagagtcagtatttcaacatatgaatagaaaggcacaaaaatctagacttacagaattgaattgaaatagctctcagtgggtgttgagagtaaaggagataagattattattagttaccatagtggttttttttttactgcaagtgtttgtttttgttttgttttcatgcttgtacttttgacatttccctccatttgaacttgcctttcctgtctcctatggcctatttccgtccacttaggtgtgatttgtatttgtgtcagagttgatctctcaatgctacttgatgttccattgccatgtgtggcgatgctctgctcattaactatgagagtgacaccactgttaactacctctccttgcctgacagtagtgctgccactattccttgtctctgtggtgatagatgaggtttgtatggtcctgttattccagcctccagacaccattccagatccactggtgccctctacgcccccgatgtgtgtggggcctcaggtgaaggatgagtacatttcactatcgtctctgcattcatctcagtctgcccttttctgttttcatcacataagattcattttaaagctcatttgtgttatgtaaatttaattgattagagaataaatcacttatgtttttcccccaagtaactctccttcctccctttagcaaccccttagcattttctaactggcagatgggcattgggttttttgtttgtttgtttggttttggggggtacaactcgtatcatttttgaatatagaattgttttatgttctcagttatgtatatatatatatatatatat

SEQ ID NO: 35427 - DNA, 1149 bp, Mus musculus
tctccagccctttgttttgtttttttgagacaaggcttcactttatggttctggctagcctggaactcactgtgtaatcctgactaactttgaactcacagagtttaaaggttgtaccaccattgcaggtattaactacactgtaataaatcagaattgtagttgtaggattctactttcatctttcatagcacagacataactatcaagttcatggaaaatttctaatactaaaccaaagttgcacctgagaaaataaagtttaatttacaaatggcaaacggtctataactaataagaatagtttgagtttctttgggaaactagtggtttttgtttatttgtttacttttttggttctgtagcataggtgtgtctctctaaatggaaggacactgacaggactagagataaccctggcagtaagcagttctttggtatctgtgttatataactgggtatttctaattgtaggcattgctaatgccaattcactgtgctgtttagcaaaatgttcttcattgtttttaatttctctctttaaaaattgactgctctcagctcttaggagacatacggactaaggtatagacactgctattttctgacatcttatgatatcatagcttgttttctttgcttcatcaacttaacagttaatagtcgtctacaaaaaataagatctttagctgtctatctattactctgtcattgtcattgtcattgtctgtgggggatactgactgaacatagtgtcttagggaggtgccactttttcacacctgagatgagtcatttacactggagtctttaattgacctggtccaggagcccatctaagtaaacattgttattctaaattgagttagtgtctgtaggtcagtaaagagttactggtggcagcagctttgtaaaagcatttggttatttgtgttcagatagtacgtctttaaaacttttggactggagagctactatctgtagatgcttggaattgctgtacttggtgtgtttcctggtagtagccccaccactccctagccaaatctaggtatcagagtatgtacatttgtttccagtttctgcatgggattctcaaagcagctgtttacctcatgacacttttaatatcaaggcataatcggcagt

SEQ ID NO: 35428 - DNA, 1251 bp, Mus musculus
caggcgcggaccccactgctgatgtttctggacagagttagtgctgccgacggcgcctcccagtctctgagaggacaactggctgccctcctcaaggaaaggacactcaagtacagctttgggactcagctgcggtttcccaggtctagcttttcgttttgttctgttttgtattttctgtaacagaggggtgtcctcagtctgcatgtaactttatgatagttattccaagttcaggagaagcagtattaacatcagttgatcagtacaaagtaattttttaatctaattcaccatttcacatgtttgtacttctttgtcttcccattaacctttgccagtgttatgattgtatacatttttaaaaatgctggttaaacaggaatgcttaaagctttaaaagttttaacagtctaaactttgttttgccttcattcaactgcagaagaatatttttattgttacttttgttctgtatcatgtcctatgctagaaatactgacaataatgtgagacaaagcagggctacgtggcactccagccagactctgtggatgtgcgctgatgctcgtcatcagcagcaactcctttgggatgacctcaatgagaaatgtcatggaaccagccagttctgtaagactgacgatagtgtctgtcggttcttgatcttgccacctttatttaaagccgtgtcccttcttttaccccgtaagaaagctgcaccagatcacctgcctaggtttccatgagaattattacaatgggaggttttgttgcagagccttttggtttatctttgttgtgaatgatgctttttgttgtatttattaatatcaaattcacttatgaatagacttgataatggaaacagatgagaaaaatcaagtgcatgtgtgtctttgactattctgtttctcatttgataaactaattattgacatgggagtcaaccagcacctttttgttgaatggtggaacctggtttcctttgaccatgaaattgtcttctggaaacatgggtcctgatgagagagaagatgctgcaagaggcttctgtccattgggctctcactctacctctcagggctgacattttaactgacccgcttcctggagtgtcttgtcttggaaaactacttcaaaggagatgttttgttaccttttaacatttttttaaatcacctctgctaaagttattttcgtgtgcagccaactttcaaatattaccagtttgggtgaaaggccaaattt

SEQ ID NO: 35429 - DNA, 1156 bp, Mus musculus
aaggcatggacagaaatgtcagacagtagatgttgaactgaggctgggacttcttaagaaccagactcccattttctgtatccttatttttcgtagggcgctgtctccattttttttttttttttttaatttttgggggtattggaggtgacagataatttttagtcttatatcctcatttggagaattactggtttagactccttttagagttttttatgcataattagaaacacactttttctttttttaaagcttgctcctcctattgtacccacaacaggatattgtaacccatgtacattttttttttcatcctttgccccagtccgttaccctgatgactctgatccctgatgcttttcttttacccctcaatatatgaagctgttatagaaaaatgaaagtcatatagttttatacagagtatttattatacatgagcataaataacgtgttcttatacgtcaattaggtgggtagagaatttaaaggggcaaagaaatgttactttgttcctgtttctaaatttgaattttattattttggcactttgaaaagatggactgggggctggagagactgctcagcagttaagagcactgactgctctttcagaggtccagagttcaaaccccagcaaccacatggtggctcacaaccatctgttatgagattggatgccctcttttggtgtagctgaagacagctacagtgtacttacatataataaataaatatttttttttaaaaaaaagaaaagttagactgtatatagatcaagtgtaaaacgtcatagtattgttaaagtgctatctttctctttttcagtttatcatgcaatctacttggaagaaatggttgcctcagaagttgctcgaaaacttgcctccgtgtttaatattcctttccaccaaattaaccaggtttacagacagggccccactggtatccacattcttgttagtgaccaggtaaatcaaacaggtagtagtcccctcctcctgccaacgggcactcatatcgtgtcgggttgtgagaaatgctgctggcctcttttacaatagtcatttttaaatacagccatgatcaaaatagtatcctagtagcagaaggaatacagttagggagagggcctgagctttccctggccttt

SEQ ID NO: 35430 - DNA, 1957 bp, Mus musculus
gggctccctgagcagagttacagggaatgtgtctgagggaagaggagctagaacagtgcagtcagttttaatactgtatctcttctaagcttagaagttttaacacccccctctttttttttttgcagctgaaaataatgatggtattcacataattttgaagtgataccttaaacggactgaactctatccagtaccaaataaagtcatgcttaaaagtgtgtgaagactgaatccaagaagtcttgggattggattttactgtgaaatgtttcatattgaaaacacaagatgaccttcctaaggagctgcaggagaggcaaatctcctcagtgtcactgccacagccccagcatcctcgtgagagagagagagagagagagagagcctgtgcgagcgagcgagcatgtcaggtgacattcgacccagcttctaccgtggtgggcacaagtacttgcttccctggcaagggccagtggacagaaccccccagagcagttgctgctgcttttcacactgtatgcagtttgaattgaatgtaaaactcaaccgtgggcatttacctttctgtgccagtttggcttttgttgcctgaaccttatgctggcctggggaggagatagagttgcctctgggggagctgctctgtactgggtgacacggccgtatgggtcaggtaagaggcttagctccttcctgaaggtggacatcagaggggtcctgctagacccgagccgagccgagccgagccgagcagatgagcagactgcactccctgtcagccattccgtgtgcgaggtcagtgtaagtcctaataggtaccgaggcttgggcgtttggcttgggcttccagttttagcattttagtttctggatttcacctttgaaacctccttgccttttaaactcatgtggtttccttttctcgtctccccaccccctacttgagcctccaggtgtgtatactcccttgtcttgtgcctactctgttcttaaacatgtctaaagcccttcccagacctcagaactagatgatggggaaacagtatcatgtctctgatattaaagggattttttttttaatgagacaaaattaccctggaaacactagatgtcataacaagacactaaaatgtatcataaaccttccccccgcccaaataccgagtttcagtacaatcatggctagatggtggctggtgggggctctgtactctgcatcgttcatgctttgtctgtagcaggtgtgcctgtgagtcacgcgtgcacacggccatcacctctcctctctctcacgacctctcgtgaggcctgtggcatatccgagtttttaaaaacttctttccattttaattctgtagcatctttgcccatttgcttagctgctggctgtgaatgcgcttgtctgacccttgttgttcaggtgggtaggaataattacattttaaatgaaatctcttccagaagacagactacttcaatgggtaaaggctttaacagcttgttttattcatactggggattaattacttgccacaaaacaaactgtctcgataattttcctcttgggtttggcagtgctgtagccttgcaggccctttaggagggagcgctcccatccgtccttccctttgctttgtgtgaccacatgctttctgtaccattcacttacttgggaaagaagtggacttatctcctaattgttttagaattttgcttgtctatttagctttcctttttggatctcatgatttatggaacaataaatgtcatttaatgctgtgtattattttgaattcattatcaggttttagaagtggggtgaaagtacttacaggctcctcagacttgaacttgtgctgagcagcacaaagtgctaggccgtctcagtgaaactatacctggcccatggcaccagcagtctgctactttggttataggatgtacagttcagtgt

SEQ ID NO: 35431 - DNA, 1191 bp, Mus musculus
tctagcaatgtcgatgcagaggcgaggggattattattaggttcggggctagcctgggctacaaagcaataccctgtcccaataaagcagaaacaaatatatattttttctattcaggatttttgtatgctgtcctaggttttcataaataagtcttccatatctcaattccttgctaaagcacacatgcacacatttcctcagttgctgtgttggtttttttgtttgtttgtttatgctgtgttggggatgggtctgagggtttcgggcacgccaagcaagcatggtaccaactgagctttagcccagaaaactcccttccccttaccccctcaagggccatgctagcatttatatatcatagaatactccttcctatctgcatacttcagtggctgttgggtatgtacacactcacacagtctttcttagtgtgtgctcattaaccctttcatgccttgaatgaaatccagtaccctgtgctgcttgctgttggcactcacatgagaagtctggtcacccgacagttctctctgtgtctggacaggaagcagttcagttctttaatgtgacgacgctccagaaggaactgtacgacttcgctcaggaacacctaatggatgacgatgaggtaagctctcgcgctctgcacagtgtgcccgagagaaaacatgactcgggtctctgctagagtcacttcaaggctgggtaccccctccaatgggaaacagaaggggccctcgaggacacagctgctgttggggttttaatggacgccagtgttctggtgtggaaaagcacagagctggaagcccaggctagaccgatgcttctcctgtgggggaaatgtgtttggagtatgcatcagattgtgtgtgtgtgtgtgtgtgtgtgtgtgtgtgagagagagacagagagagagagagagagagaacgggatggactgggggcgcttgtcccaggacagccctgtggagtcagtctctgcttcccccctttttgtgggtttcagggattgaattcaggccaccagacttacagggcaaccactttacccactgacccctccaccatgtttttacagtggagtctcttacagaacctggagtttatttatttggctagactgactgcagtgagctctcaggagcctcctttctctgtcctcttcctcagggttgaggtgacagg

SEQ ID NO: 35432 - DNA, 1282 bp, Mus musculus
tgttgccaattatccgttttgcttactctcctgtggttttcttctgctccccattccatccatctctgttctgtttgttctcttgttttgtgttgtttggagacagggtctcagggtgtagccctggaattcactgcatagaccaggctggcctacgaggccaggagagctgtctgactctccatgcccagttctttctctaatttcttgaggaagtgccactttatagttctatgtttgaggcaaagtctgaaaaggttcagtatactgtgcgggctacttctctttaagtctgtagtgttcctctcactcatgagtgcgtgtgtgtgtgtgtgtgtgtgtgtgtgtgtgtgtgtgtgtgtgtgtttagtactaatatggaggtcagaggacaggtcctcttcttcctgtgggtctctgggatcaaactcacattctgccaagcgcctttacttagctattattattattattattattattattattattagtcacgtgttggtctgtgtgtctgcatgtgggcctgtgcccatgaatgcagatgccgagggagctggaggatgggggcagcgatggcaggaggttgtgagtgcctgacgctgagccaccaaactcactgttgctccatctcctgcttcctatttttgtttttaaaacgatacctctgtctttttcccccacagaaggacaggattaagctaatcactggtgaggagagcgcaggagggttagggtccagacacaagtgcccgtcgctcttggtgtcctccattctgctgtcccctccctccccgtggcagtgtcctctctttagccaggtgtttcagatgtgaaggaaaaaaagtttttgacgcaagacacataaaacaagcaagatgagtaagtataggtgtgtggtagagcaggtatccacagatctgtcctggggccattttcgccgagaacttcagttgcttcactccaccagcctgttggaaggacatcctgaccacagcagcctctggactcccggccatctgaagtcactcttggcttgggccttaagtgtgcagagcccttcctccccctctttccatagccctgggtctctggtgaaacagctgagtttttccaccctggggctgaggtgcccctttcaggaactccgcgggcccctggggtgagttggcagggctcgtggggtgtgactagatacccactggattggaacttcccagcttcctcccagaaaacctggagacaaggccttgcttgaccatttaatttataatgaccctta

SEQ ID NO: 35433 - DNA, 1133 bp, Mus musculus
tactaggagctagtttcttgtctttccttttcttcttttgcattcttccttcctccctcccctccctccctccctccctccctttctatactcttctctcttctccactcctctcccttttcccttccttcccttctgcttcctcttctcttaaagaaattatttacacatatgtgtgtacctgtgtgtttatgtgtgccgtgtgtgtgcagtgtccatagaggccagcagagggcatcaggtcctctagagctggcgttctaggtggctgtgagctgcctaacatgggtgataggaactgacgggggggggggggagcctctggatgagcggtgaacgttctttttacccctaagcacctttctgaccctcatcccttcctcccacctcccctcctcctgcctcccattttctaataacctcatatgtatcaatggtgctgtggctggacatttaggttggatctgcttgggcccttcagtgttgagagtggattctccccgttcagcttggcagtgaaggtgagaaatgaccatctgtccgttagtccccacctctgctgctgtccttactgagaacccccccctcccggagcaaatagcacaatgctgttcatgcattgggtgagcaggaaggtctactgatgtccagtgacgtcatgtattatggctaccacaaaacagctgacaaagggaacttaaggagtgaagggtttatctagtctgacttactcaaaagtattacatttgttagtatgtgtatgtgtgtctgtgcatgtgcacatgcatgcatgtgtgtgcatgctacagagtacatgtggcgctcacagggcaactttccccaagtcagtcctttccaccatgcaagtcttggggaatgaagctcaggttgccaggcttggtggtcagtgtctttaccctgtgtgccgtctcaccaccggccctcttggctcacagttgaagggggtacagtccatcctggctggggagggagtgtggtgaggtacggtcatgctgcctgagtaatcagaaagccgagagggaacaggaagtagaaatggtctataaaacctcaaacctgccctcagtgagggtccctccagcaagagtcggtctgccttccaaatgttcctc

SEQ ID NO: 35434 - DNA, 1099 bp, Mus musculus
ccattctgccacaggagcatggagataatagatgtgcgctagccaccacatccatctttttatatgtgttccggcgtcgagcttggggtgtcggtcttgtgcagcttgctccttttcccgacaagtcatctccccctgttttgattggtagatttgagatatgcaaacgtttctctgatgtatatgtcttttcccacattgctgttaaccctgtgtacatccaattatgcgtaggcataagatttcagataagggattctctcaagagggcacagttggctttattgtgcatgcacgccagaccagttcagactggatctggggtatgtttccagagattggtaaggttgtgttggcatctgctgatctctggtcctcctttctaaacacacaggttgagaatgagtacgggtcctactttgcctgcgattacgactacctacgcttcctggtgcaccgcttccgctaccatctgggtaatgacgtcattctcttcaccaccgacggagcaagtgaaaaaatgctgaagtgtgggaccctgcaggacctgtacgccacagtggattttggaacaggtcggtgtgtgtaggtagcatctagaaaacagctattgcagatagagtgaggtgtctcagagtttcctctatcaggtgggctagcgagctttgcgtgactgtaacaaaatacctgagggagtcaactcctaaagagggaaggctctgctttagcccacagttgcggcttcaatccgccatctgtttgtcctgtaatagagagaacctttctgggagcatataatgaaatgagacccttttacctcatggcctgagaccctcaaagagggagagatgagactgccaccctctctttcagggacatgtgcccagtgacctaaagtctactgagctctgtccaccccaccccgctctgtttgagacaggattttttttgtagtttaggctggctgcttattcatggtctagccaaggatggcctgaagctctgggtccccttacttccatctcccaagggccggagttctagatgtgtgctacccccatcctcggcttctttgtactattcttccacttaacaagag

SEQ ID NO: 35435 - DNA, 1145 bp, Mus musculus
aaaacaaaacaaaacaacaatgatatatatatagagagatatagatatactaataatgttatatatatacatatatgtgtgtgtgtatacacacacacacacacacacacacacacatacgtatatatcaagcagtaaaatgcctgagccaagcatgttggtccatactagtaatcttagcatttataaggtggaatcaggaaggtttcaagttcaaggcaatcctgggctgtatcacaggcccttgttcctagaaaggagtctcagtcatcacaacacattcccagcagaggagtggcccctgagctgtgtccagccatcctcctcatttgggaagacagggattgtgggaacttgtcctgagcacatccagcctatccctgtacacctggtgacacttcggggcaggaaaggggacagatgagctgtgcacacagctccttttctctgatctcaccctccatcccctcggctttaactcacaggtcccccaaggaatccttgatcgaaacctcatgacagctctgaacatacgggggaaggctggagccacgctggacatcctggtggagaacatggggcgtgtgaactatggcagattcatcaatgacttcaaggtaggacacttggaggagggacgggcctgggcctgaaacactcacgcatctgactctgcttccatttatacagaaaaaaaatctttactttctatgtctaccaaggaatgcagtttattttccttatgtagaccaggcaggctggcctcgaactcagagatccacctgcctcttgtgttccaggtgctgggattaaaagcatgcaccaccatattagatctacacattaactaactttttaaatctgtttattctccttgttgttgttgaaggcagtctcaagtagcctaggctagccttgaactcaccatgactttgaattttcgatccttgagcctccaccccccaggtgctaggatcaccaatgtctgccaccatcctgtttacgcagtgctggacgttgagtccagagcctcttgtatcctgacagccgagtcacattctccagtccttaagtactgacagttgtatatgctataaatattatataacatattatatatatcaataactatattgatacttaag

SEQ ID NO: 35436 - DNA, 1378 bp, Mus musculus
acgtcaggcgacatggctgagctctgcctctgtggggcagagagcaaggaagactctcctgctgaagggtgtgggcagccatagcagagagggttggggtacagacaggcagttcctgggagccagggtggatctcagaatgtgctgaggtgtggcccaagactggtctgtagcttctgaatctgaggctccaaaattcgtttcttctgcagcaggaattggtatttggaagaagctctaccacctaacatgggatactgggatgctggactctatggggcatctgttgcctctctgatactagtgttcctcagctgacaacctctctctctctctccctctctctctctctcttcctctctctccctctctctctctctctctctctctctctctagggtcaagtatggatcaatggctttaacctcggccgatactggcccacaatgggcccacaaaagaccttgttcgtgccaaggaacatcctgaccacttcagccccaaacaacatcacagtgttggagctagagtttgcaccctgcagcgaggggaccccagagctgtgtacagtagagtttgttgacactccggtcatttcctgacctgacttgaccatcggtggccattttccaagccagtctggtcaagactcatggctgaacctctgagactgagccttggggagcacagctctactctggttacacggatcacctttgttgtgctagaatggaagctacatttctggaatgtgtgtaccctgctggtgactttgcagccccgccttgcctgacctcccaccctagtggccaccgggaaggctgaagggagtggacaccacaggaagacacaggttggagcaaaacttgaataatgtcctttatcctgatttgaaataatcacgtcatctttctgctgaataaaattggtttgcaagttgtgggggtcctgtcattaatatatcaggcaggtattaaactccagggtctgacttaaatctcaactagacctgagtgggctgcctgaagctacttcaccagcttgaggtacaaagtgggtagaagagagagctggtttgggtgagaagagggctttgtttttgatcctgctttgactatttctgaatctctgtgatatctgcttggtgagagatctccagttataaaccatctaaaagattaatagttgctcaaagtaggtagtatggtctctctatacaattgaatagaattctctctctctctctctctctctctctctctctctctctctctctcctctctctctctgtgtgtgtgtgtgtgttcatgttcatgtatgtatgaagttgcatgtatatgcatgtatgtatgcaggtcagaggcccatcttgggtgtc

SEQ ID NO: 35437 - DNA, 1145 bp, Mus musculus
gcctggcggtggatgggcaggctttttgttgagttttgcttttccgtctgctcctttctcagaaatcaagtttaagatgactatggaagtgtcaagaggaggactgtaggcccaattatgactcccgggcttgtgatatttcatcttccctctctgacttcctgtgtcttcacatatgatagtcactgtaaaaatcattactacttgtatacgtgtttattattaaattttatctttgtcaattccatacattacacaatgcattctggttacctgctcagtccttttttttttttttttttttgatttgtagtttactattgctttaaaaaaaaaaaaaagattatttgccgggcatggtggcacatgcctttaatcccagcactcgggaggcagaggcggatttctgagttcgaggccagcctggtctacaaagttccagggcagccagagctacacagagaaaccctgtctcaaaaaaagaaaaaaaaagatttatttatttttagtcaggtgtaatggcacacatctttaatcctacacttcagaagcagaggcaggcagatctctgaatttcagggcagctgaggctacaaacttcatgtctcctgccccagaaaaacaatgtttatttattctcacttgtatgtgtatgaggctttggcctacatatatgtaagtgcgccacatgtgtgcagtagccacagagacgaagagagtgtcaggtcccctagaaatggagctacagacacttgggtacagagagctggtggcaggtcctctgtaagagcagccagtgctcttgtctcttctgaccctgatgtttcatttgaaatcctccctgcaggaaggtctcctggttcttaaggagtggggatgcactgtgccaggctgcctgctggttacctctgggtagtagcagcttgcccatcccacaaggctgaaagctgccctgggtctcaagatcaactcatgctccccctggcagctcagtcatttccggttttgtttatatggatggaggttttgcctccatgtgtgttgctgcgtcgagcttgtgccatgtctaggagagggcagcagatcctctgaaaatggagttacctgacgaagtcaccttgtaagtcagactcacatcattaaat

SEQ ID NO: 35438 - DNA, 5401 bp, Mus musculus
gaacaaaagtacaacattgcctaagtcctacctcagcttaaattttttttttttttttttttttacagatgaatgtaattctcctctgtgcagggcttgagcctgtgaagtgataatttctatctacctcaactctttgcatttccctctctggcaagcctcttggctcacatcctcttccctcctgaaggcctaggaggcacaggacagcggtcctgcaaccttgagggcactggaagcatatggtggggtgcatgcattttgtagattgagccaaggaaacccaaaaactactaagtaaaaaagagaagtataagatgttggaaagataggatttaaaattcataattgtagtgtatttgtgttcttgagaatactgtgtttatgtggggttaggttgtgtgtggtttgctcttttcttttttatcgatgcaacagggcttttctctgtttacctcagtgtgtctgacatctcatccctaggagatatggctgtggcttgctagcctagaaaagcagaccattcatattttcgggtgtctcatctttgtatctggtaaagaagggtgggtgtgtgggagtgtgtgtgtgcacacgcgtgcatgtttgtgtttcaaagccatctttgcttgaggagaaaagctggacttgacacaagacatcccaagcaaatttcttcccagtttgctaagaaactcgatttagctcaggactctaggttgaaagtgttcgcaaaggttacgtgtctgtgtttttgttgtttgttataaagacttaggtataagaaaataagttaaccttgttctcagagagagaggggcttttcagatgtggaccagggtgccacagaagtggggggtgctggagaagtgaggcacccccacatcagggactgttcaggagggcgggggacctcgtctctatgtgtgagggtgtggtaggcaaagggatagctttgatttgagaagcacaatgttttttcctgctttggaagttcagggaatgtagaagattgtctgactggtgggagcacctcactccctaacccttggctcaggtctgtttctcaggaaccttccctaagtctgagtggaggcagacctcaaggttaacacaaagccccgttcctcccccaaaggcctttgaatgtaaaggatttacaaaccaaaccacccaacaggaagtgtaggacacagtatatgtctttttttttttttaattttattttatttaaaaaaagaaaaaaaaaaaagaaaaaaacctgtaccaaagaatagaaacttgggggcctgtggctcccatcccattgaagtctgatgtattgtaagccacagagtgggccttcttgacattcacctctgagaatgagggcccatcccggttctctggttctctgtattctcactactgagctcagaccagatttgaaagaggacagaagactgcccaacatagatctaaaacccagtttctgacccccattgcacggcaggaactccacagaggaagaggcggtggggacaggataagggctcagtcgaattgctttgggatgctcagtttgcctgtgtgagctacgacgttccttcacattcacatgacttgaatttcaggatttcggggtgatctgagtgtggcggcgggtgctggggggcggggggccgtctcagcagggagaatagtacacaatcaaggaatcccgaaggtagcttcaactgctgatctccatgtttctcgggatgtgaaagagggttacaagctccttttaaaatttaatagtgggtccttccccagtttatatatccctttagcctttattatgtcacttaagcgttaaactgatttttaaaaattttgtagaacaggacaacccaggaggcctcaccccgccccccccccgctcccccccccccccaatcttaaactgcctttaaacactcaatagaactagctttacattcttaatgacactaattgaacaaatgaatcttgacaaccttctcagaaacctgattttaattgtggctggggaaagccgattttcaatgctaaattgaagtcatgttcagtgttcctcctcacagctctcctgtggcaggaatattgactgactgactgttcagtgagaactttttttctggtgactaacaaaatacttgacattttacttaggatctgataactcggcccaggttcccatcttgtggttgggtcttgatcagtacatggatagaccagtgtgggcttagagcacagcagatgtgttcttagaggtctgtggctttctatatccagatcagtgtaagggctggcttctaaggaattgtgatcatagttggagaacttttgtttttaaaacaagtggcttattgtggccgcctgagattggactcctagccggtgggggaattggtgctaagcactttggagagtgtaccttgatatggactgatccatatcatgacaccagccatgtttggtgagcacctgcagccagttctgaggtacgacaggaaagagattcaggaaggagacaccgtgggtgctggctggccggaaaccttctgtcactgcggtgagcgactgacgggtagcggtccctggtcaggtggcaggggctggcaggaactggcaggagctggcaggagctggtgagggtgggtaccaggagattcccattggaagtgaagtttcttaagtttgagtattaaccacctggttgccacctgcctaacattccaaaactataatcatctgaaggtcatcaccaatctatcacttttgttcatgagaagtctccaaacctgtactccgttatggctggcaggtaactccttatcttggtttgagcctagtagtctaggctgttcccctagtgcactaaacttcctccaatcaatacccttgttaagtctaacttacctggggaagcacacaagggtaccctaaacagaactggacagtgttgggccatagaggctgccgggatgaagacactttggatggtccagagtgtctcggtgtagttaagccaaagcttaatcatttgagttgggaagtcttttaagcttgaagcagcacaattactgtcttgtctgtgtgtcttcttgggtttggaagattctaaggttgctgtgttctggtaggtattaaaaggaatgccaaagttctaggcttgttttccctgttgtttaagacgtgtgtgtgcgcgtgtgtgtgtgtctgtgtgtgtgtctgtgtgtgtaatatacacacacacgcagtggtgccaaaatgtatttatttagaacatctctcctagtgaggttctgacagtctggggctgtatgaaaatgatgctatcatgtgtgtacagttacataggactggggctttctctggcttcgtgtgagccagggtcacagggcaggacaccgcccctaaccacactgattttgtttagtatggattttctacctcaattttggcaaaaagttgtctacctcacgtcggcaccggatgggtcttaaaagggctagtattaatccagtggggagggtgtggatgtgggagaccctctctagatgcagggatgttcagggatgcaggattgatttcttagacaaacgtttgaccttgaataagagctgtctggtcagtgtcgtcgttcacccaagtagttctcagccagtctggctttccctgccacaaatcctgttccgcagacagcggtaggagctgcttctctgaccggatggagaaccttccaccattaaaggcctttaggtctctcttctcttcaagagaaagccgttttatctgttaggagcgtctgtaggcgtgcccttttagtgggaactctacaggtctagtgggaagcatgaggtatttgaagggaatgagagtctctgacttcatgattgtatttgaagctgtctgtgcccagcagaatctcccgtcacggcggtgtagcccgtctacagtgaccggtgacgtgtgtattgctttttgttttgatttgttcttcctaccaaaggcaacactttgacacttgttgttccccctctcctccctttgttcttgtttgttaaatacttgataaattgagaagcacattatcaggactgttaactttctccctgtttgtccctccccagtaaccttctggtctacctggatgagagagcgcatcctgcagaccacgggactaatcgggttttgggtttataaataaatgtcaccatgaagaaatacctcaataatgtctatttttaaaactggtgttacgggtcagcaatccagcctggacggctgtttttccatcatcatttaaccagtaatggttctaaatgtttgttttgtatctgcattggtcttagaccccttttaatgattgtattaactcaggagctcaggtcgtaccttacctatctcagagcacactggctgaatgttggcgcccctggcagcaacgcgtttacttgtgctgtaaccagctttggttcttggtgctcctagcagtctgtagctctcctttagagggagactgctcacatgtatgggtggggctctcttgtttttttagggtgataaatgtctttcccccttttcccttaacgtctgccggtgagggtgggtggtttagcgatgtttaactagcatgttacgtgtagtagttgtgggtgggagggttggttgttcggttttgttttaatggatcttgtttgatacagtccattagcgctctcatgcctggtcagccaaaaaagagaagcagcagctttaacttttatgtaactgtagaatacacggcccacttcggtctttttgtttaagagaagtgaatgcacaccgcagaggcattgcctgatgccaggatgactaagttaagtgtcttccgctggacaagctgattgaaggaacacaccgcctcccctggcagcagagccctcggtgtctctgccccttttgggattgtggtggcatttctcggagcttgtcacggcactgggtggctaaggggatttccccctaaacctcaaggcaaaagtgtattttttttttttttttattttatttttgcaagccccttcctccccttgttgggcttttacctttaaaaccttaaatgttactattgccagccgcaggcatgacgggcaacgagagcgggtgaagagccagtggaagagcgttccaaacctcctgtgagctaagcggcttctgaatgtatctctgtggtccacagagaaggctgggggagtagcaaggagatgctgtatcagctactgcagccttaaaacaaagccggtgtctctttggactttaaaagtgtccctatgcagcttattttatttttgtttaatcaaataaacagagggttgtcccatgaaaacttggtgtccgtgtgatttttttccat

SEQ ID NO: 35439 - DNA, 1144 bp, Mus musculus
ctttgaaaatgcctcagcagctcaggggactgccccttgacctggaactctggaattccaggcaagccttggccacatgaggtccggtctcaagacaaaaaacaaaaggcctgtgtagtgccctgtcttaagttattgtgtctccatagttctgcttcgtgacaacacgatttcgcttccacagatctcgtgcccagtgtcttctcttgtactgttaaaaagttaggattctctaaaaactgttttgccctgtcttctggttaactgtgtccctggccactgcctctgacctgaggcaaggagagctgcagtcacctgtcccacttcctagatctttgtatcttaaattccctcttcctccccctggtgttttgtttttaattgagacgggatcttcttcttttttctttttttgttcttttagagatttatttatttataccagaaaagggcatctgatcccattacgaggagttgtgagccgccatgtggttgctgggaattgaactcaggatctctggaagagcctaccctacagtgctcttaaccgctgagccatctctccaaccccaagacaggacctttctattgactcttgactattctggaacttgatttatagacctggctgacctcatcttcacagggatcctcctgtctctgctgtttaaggaggtgcttcaagtgggtggttaaataaggagatctcacgtgctttcggctaaggaagaggagagggataggagatttttgctcaggctaagcagaaaccccaggtgtagaccatggaggccaaatattagttggtgatcagtatccagtgttggtctggagatcgtgaggcatgctgggtagaggagcagggtaccaggtgggtgcctgcactgggatggaggcatattatgctaatggatacacctgcacaggaacaccccccccccccccccccaatgtgagcatgccccctaactgggctctgagtgcttcttccctgaggagccaacgtggggttggggcagctaaaagatgaggtcagctggctttcctgaagccatgactgctaaatctattgtttatttcccgcatgaaccacagaaaatgattgtcccccaggagcgaaggttggtgtggcccagtttttaca

SEQ ID NO: 35440 - DNA, 1205 bp, Mus musculus
agactggccgcctgatggagggagggctgggaagtactgtactgcgcgcccccccccccccccccccccccgtttttcgagacagggtttctctgtgtagtcctggctgtcctggaactcactttgtagaccaggttggcctcgaactcagaaatctgcctgcctctgcctcccgagtgctgggattaaagacgtgagccgccacgcccggctcaccgtactgcttcttgaccttgcttcacatacagcgtgaccacagaccgccaatcccagagcagagaaccatagaactttctagatctgttgagacacaggaactcctccctgcttaagccccctagactgtctctatgatctctgactctgtgtgtctgggttgtgatctgactcaggctggaatgggatatgtacggcacctgggtttgaggcatcggacatgcaggggaggacagtgggtaacgattgtgacagttctgcctgtcttgaggggggaggggtacacactgtttggaggaggactgggctgtctccactctgttcacacccgtctctctggtccacaggtcctgcatctctactgtgacacctgctctgtccccatctgcagagagtgcacgctgggccgccacggtggccacagcttcgcctacctccaggatgccctgcaggactctcgggcactcaccatccagctgctggctgatgcccagcagggccgccaggctctccaggtcagtcacctatctcattgactcagacctctcttgtggaaggtgggtaggcagacgaactgcctggactcatggactggagactaaagacaagaagggcttgacaccccggctactgaggtctctagggctcctagcagtgtccagaggatgctgcgagttactgggttactttgctggttgtttcagcttttccctgaagctagcaagcattggtttttgttgagacagtagagagcatggacacttcatcttctttagccgtttgggtatttggtgcacagattgactaattgaaggctgagtcctgaacacagggcatttgatgttccgtgtcttgcaactgtccctgggtcataagtccttgtaatttgaatgtttgttcttttatggttgggtagggacatgcatgaccgtttgagaactgaagcagctctcccacattgctatgcagcggtgtatattatgtatagt

SEQ ID NO: 35441 - DNA, 1207 bp, Mus musculus
gctgggtccttttctacctcaccctccgtgattaccagaaatggctgatgggtgtaccttccgtatgtgtggcctatgctcgtttgggcttcctccagttctctgctcatgtaatttggccaatttcttactctttttgagaattctattgtatttatctttacattgcgtggaggtcagaggacaatttgagggggctgtttttctccttccaccatgtgttgtcttgagggttgaactctggtcatccaggcttagcaacagacagactcgactccttcacctgttgagccatctccaagatctccaagacccaattaaaacagattttgggggaggtgggtttgtgtgtgtgtgtgtgtgtgtgtgtgtgtgtgttttgagacggggatttttctttgtagtcttgactggaactcactctgtagatagaccaggctggccttgaacttggagatccccctgcttctggctcccagagtactggaattaaaggcatcccttgatcaataaaataattttgatcaggagaacatgaacactactcccacccaatgagtgcgtcttaatggtggaagttgccatgccctggctgctgtgcaggaaggatgtctttacctggaagcctcctagtctcctggagaccagtgcctctccccccaccccctctattataaactcttgctgtttctgggccacaatgcaaatggccagggcacattgtttgctacagagcagatgcctgctgggaggctgatgcctcggggattgcctggaaaacctggaggtgaagtccatcccatcaaaagcattctcacgcaacaaccgccttgccggaggtgtttaggggacacaagcagagttatattctgggaacccttgcatccccagaatagagaaagacaattacccagcagcccttgggtattttgttggtaaaagtgctttatgcttatggtaaatacttttaaaaagttaatcaagtagccacactgggtagggggtagagaagcagaaaccagcttttgtgtgctgttacagaggtggccaggtaggacggggaaccaggagctccctttagtattgacatatttttctgcaggggcagtcagtgtgaggtcagttacctaggccgacagcagttttgttttgttttgttttttttactagaaaatgttgatctttgagcctcttgacaggaacgtaa

SEQ ID NO: 35442 - DNA, 1701 bp, Mus musculus
cgcggagcgtgtggggcgcgcgtgcgtacttggcacgcgtgcttccgcgggccgggggcccccgcacgaggcgcagctgcgcgcccgagccgaccgcgccgcgggggaggctgcgcctcggccgccacgcaggagctcctgccgccgcgtcatgcggcggggcggccggcggcgcgcgcggggacttggactgctgcgactcccggacgttttcccctccctccaggaggctcaattcatttagccggagggcaaggaaaaaaaaaaaacaacacaagcaagactcgttgggaccaaattggtttgcgccgcggggaccggattccacggcggactttgagacttgtgcgggcgctcgtttgctgaggagtagcagtgcaaacccgccctgccgaggtggcccaggggtcgcctccaccgcgtcctcgatgcgctctgctgagtgagccgcgcgccctcatcctcctcgccgcgcgccctctgccctccagcccgcctgcaaatggcttcgttcccggagaccgacttccagatctgcctgctgtgcaaggagatgtgcggctcgcccgcgccgctctcctccaactcgtccgcctcgtcgtcgtcctcgcagacttccacgtcgtcggcgggcggcggcggccccggggcggcggcgcggcgtcttcacgtcttgccctgcctgcacgccttctgccggccgtgcctcgaggcgcaccggctgcccgctcccggaggcgcgggccccgccgaggcgctgaagctgcgctgccccgtatgtgaccagaaggtggtcctggccgaggcggcgggcatggacgcgctgccatcctccgccttcctgctcagcaacctgctggacgccgtggtggccaccgccgaagagccgccgcccaagaacgggcgcgcgggcggcggccccgggggcgcgggcggccacagcaaccaccggcaccatgcgcaccacccggcccagcgcgccgccgctccagcgccgcagccgccgcccggcccggccgcctcccccgggtcgctgctgatgcgccggccgcacggctgcagctcctgcgacgagggcaacgccgcctcgtcgcgctgcctcgactgccaggaacacctgtgcgacaactgtgtccgcgcgcaccagcgcgtccgcctcaccaaggaccattacatcgagcgcggccctccggggcctgcggccgcctccgcggcacagcagctggggctcgggccgcccttcgcgggcgcgcccttctccattctctcggtgttcccggagcgcctcggcttctgccagcaccacgacgatgaggtgagtgcgcgtggggcgcgggcgagggcaaagggacttttattttattttacttttttgtgtgtgtgtggacttgtattatcgcctctcccaaacccccaagtttctcggagaaccaggatttgaggacggtttccttctctgcatgtccgaggagtcccaaaacacgagattccctccttttttgttttcatttgtttaattttagtggtgaggttcgaacccagagcttatgctacccaagtctgcccttgaatttcccttctttttttttttgcttttttttcccatttatttgtactcgtgtgtaggtcaggatcattttcaggagtcgcctttcctcactaagtgggacccggggacccaagtcaggtctttcaggtttt

SEQ ID NO: 35443 - DNA, 1200 bp, Mus musculus
agaaactctgtctcaagaaacaaaacaagacaaaacaaaaagacatcataagagaacctgcattctcacattattagggagactgtcactgagactgatccaactcccaggagacatggcagcttccatacactgctcatacaggtaaccttggtgtgtgtacaagtgacgggctttatcatgggaagtaaccatctgagagcttagtggtatttagtcagcatttcaaatacaaaatcaaaacatggatactgatccatggagacttggaggggctgagcaggtgagctgtaaactgcaaagaggtgaagtgtcttgtcagtgatggagcttggtatgtaccagccctctgatgctctctgaccccaggccctgtggccagcagggctttgatctgcagttagtgtgttagtcccattcaggttctcgtacggcaggtggtcgtggctgctgccttgcaggaagagacagatgaggtcagctctgttggggtctctctcaggtttgtttttggtctctgttctttgggttaatccagtggcagggccattgttaattgggaggcccaccgtgtctagaacaacagaacagtgacttggagagtcagaaagggctctgagctgatgtttccaaaatccccccacccgtgattctgaacagtcagcagccacgtgccattaagtctcaggaagttgttaccttgaagtctcttattcaaggctagagagagagagactggtcgatgcaaggaataacagcaaatgacctgtggttactagccctaagagaaaattgaattaaaaaaaaaaaatgtgcacacgtgtatgtgtgtaagttagaaaacaactcaaggttattaacttagttatttcctttacccctgatcatctcaacacctccttcccccaccccaaacaaaaataaagatgtaagtatccacaaagtgtattggtgctgcccacataaagccccacgtgcaggcattaccttccagaactgttagccgcctgtgtgggagaggcatcttaagagcgagtccagtctctggggaaggcatagtggtgcactaggaggcagaggtggcacaactctgggtgagatgcgcagcagtcctacgcatctgtgtccaccctcagccttccttccatgcatttcacattctgtcaatgaggtaggtgtctgcctcacagagcagccata

SEQ ID NO: 35444 - DNA, 1138 bp, Mus musculus
actgattccactgtgcaagagggaatggagacatggttttcaaacaattttcagtaatttttaagtatctgaaaatcacccatgtgaatcagacatgggtgattccatgtggtcccctcttgatgactaactcactcaggtggggtggcagtgaggttgcatcctgatacctttagcagagcctccacaactccaaaagcaaacacttgctcttgttaagttcctacttggtaagagacttaggtgttagaagatgtgctgttgtcctgcctcagatctattttcatgtatttgtaggatcagacaagggtgaaaatgaagcaatggaatcctgtaagtaagaagttttgtaaatccttaagtagcctggcctgcatcccaaagacttagaccctgcatctctgtgtcctgcgtgtatctgtcagcctgaggagtagtgctttgtcccaagtgctcagcgtggagcggtgctctctgtcctctgcacagccccttcatccgtatctacgctctctcctcagctggcaagcgcgcccctcagtgctaccccagttctgtgaactctgcccggactgtgatgctcttcaacctgggcagtgcctactgcctgaggagcgagtacgacaaggcccgaaagtgtctgcatcaggtgagagggcacggggagagggcagccctcatgcacaccagccatgagaggacctgggagtttatggagtttgtgacttttgattgaggtttatggtcagtttattaaacacctgaaatatttttccaggtttaaaatattcttgggagcatggtggggcacatttttaatcccagcatttgggaaacagagacaggtacatttctgagttcaaggctgagctgacctacaaagagttccaggctatccagagcctcctagtgagagcccgtgtgctgcctggtttgtattagctttatagaagctagactcatttagaaagaggggccctttaattggaaaaatgcctcatgagatctgactgtaggacattttcttatttactggttggtggtaggtgatgccatccctgggctggtggtcctgggttctataagacagcagactgagcaacccatgaggagcaagccagtaagcagcactcctcca

SEQ ID NO: 35445 - DNA, 1148 bp, Mus musculus
tctctctctctctctttctttctttctttctttttctttctttctttccttatcatatatacagtattctgcctgcatttatgcctacatgccagaagaggtcatcagatcacagtatagatggttataaaccaccacgtggttgctgggaattgaactcaggacctctggaagagcagttggtgctcctaacccctgagccacctctccagccgagaatcagtttttcatgtgcatataaaagaaaacaagtctaaagctccgctctacgcaggcgaaagccaggtaacagatagttgaggtagctaagagactctgtgctaaatcagactctcagaagcatcctgcaggctggggatgtagttcagttggtgaatgctttcttggcatttacaaagtcctggatttttatccccaaagctagccctggtcacacaggcctgtaaccacagcacagtgaaggtggagaccggagggtataaagaatagatagccgggtagtggtggcacacgccagtacttgggaggcagaggcaggctgatttctgagttcaagaccatcctggtctatagagtgagttccaggacagccaggactgtgcagagaaaccctgtctcaaaaacaaaaaaaaaagtcaggcttggtggttcccacctctgatcccagcagttcagaggtagagaaatacctggtttacacatagtaggttccaggacacccaggagtataaaatagagaaatactatctcaaaaaacaaagagaaatagaatcagggcctggctccttgttgaagggcacttgctatttttccagaggagacccaggttcaggtttagcactcacagtcagttggctcatggcattgttagctccaattccacaagttaatgggaggccatcttctggcttctatggacacagcacacacatggagcacatttatccacaaaaccattcatacatcttttaagatgtcaagatacatctttttagaaatactgatttcccccacttgggaagtgtttcacgattaactgatggggctggaggtgtggttttggtgcttcaaagcccacgctggggttggagagttttgtgaggacctgggtgggattcccagcactcatagttacccacaaccgcctg

SEQ ID NO: 35446 - DNA, 1237 bp, Mus musculus
atttttattcaaaagatcgtaaatggcaacattcttctcttggttcccaccctccaccccccaactccatgctaagaacaatgatgtcagcctttctatagaggaagcaagtctgggcagatgccagcttggaaactcccctgaaaacggagctgggggcatctgcaagtcaaaagctctgactccagtgtcacaacaggcaatgagggggcaatgctgattccctctggccatgccaactaaacccagtgagtgggaggggacggtgcaggccctggtgcccacagagaactctagcagacaaaagacccaggtggacactgttttcatgtttcctctgaagagacaaaaacatttttcctacttttttttttaacatgtatttattactgtatgtatgtacactgtagctgtcttcagacataccagaagagcgtcagatctcattacggatggtagtgagccaccatgtgggtgctgggaattgaactcaggacctgcggaagagcagtcagtgctcttaaccactgagccatctctccagcccttttcctacctttttgactatataaaaaaaccggccggtagtggtggcgcacgccggtaggatttgctgaaggaggcagaggcaggaggatcatgagttcgaggccagcctgggctacacatttttacgggctggagagatggctcagtggttaagagcactgactgctcttccagaggtcctgagttcaaatcccagcaaccacatggtggctcacaaccatctgtgatgggatccgatgccctattctggtgtatgaagacagctacagtgtactcatataaataagatatattaaaaaataccgtatgtctctttgacatacaacacttaggaaatatgaaaaggcaggtgtggtagcccatgcctgtaattccaacactcagtaggcagaagcagagagaatttggcaggtttgaggccagcctggtctacataaaaagctccaggccatccagggctatatcataagacccattaaataaatagatagatagatagataaacaaacaaataaataaatgtaaagaagagataagttacaatttgctcttgccatattttatcaattcataaataatatatacaaatacatttcagattttttaaatttaattatttatttatttatttatttatttattttgagacaggatcccgtgtaatctaagccagccttgaactctctat

SEQ ID NO: 35447 - DNA, 1572 bp, Mus musculus
gagagcgttggccagggctctggggaggactatctaacttttgttctttcttcttgaaatgcactgtaggccagaaacctgtgctttcagatgttcacgcagagctagacagaatcacacggaaacctgcttctgtttctcctacaacacctacatctcctacggaaggagaagcctcctgaagataccaaacaaagccatttgttcattcttctgggtaatgacagcttgcctctgccctgcccttccaagttggaactacgatggggccggaagcttttacaaacagacaaagtttatgtccttatgtccttttttttttttttttggtggctgcccatttttaaaagaggaactacacagaagaaagacaggtttttttttttttttggtttttcgagacaggatttctctgtatagccctggctgtcccagaactcactttgtagaccaggctggcctcaaactcagaaatcctcctgcctctgcctccggtgtgcgccaccaggaccggctaagaaagacaattttacattatgtagaataactgtttgcattgccattctgcaaaatgaagaaattttgatttttgaaaaaaaaaaaaatgtcaaactgtttaagactgcagtaggactaggcgatcctctttcccaggcggtaagccaacaggaacatttagggaagggcagaaaaatacgtacttttggcagttgactgactcagaagtctaagactattccaatcatttttaaagataccatgtttttctgaagaagactggtcagttgtcagatttcacacaccgaccaatagatgtgtatggcacctgaggtgtgctgagaaacccccataggctcacactccgtgatcccatgtgccaccatcaagtggaccagaactactggccaagatgctatgctcctttaatcaagaagaaagaaagcacaccacccgagggtgagagatgctgaggttatgagcacggaagggagaactggctttgcagttgtctatacatatatatatatgtgtgtgtatatatatggctctgccttaatatactccttttttgttcatgactttcaactgtaatcagttaataaagtatttattctctgcattcagggtcaaataacgtgttgccttttcttatattccagtttgacttgtcagcaaaggagtggaatttgttagaaatgtaaaatatttgacttaataggactactaagcattcattcacaggcaaatgaccaggtgaaattcactcacaggtttccttaatttgggagttcttgattatcccttctcccacggcatggagaattggttggtttggtttgttgagacaggatgccttatctctcgtgccgacctttaattcactgggtaatgtttccctaccaccccttcgggggttttctgcttttgtttgtttgtttttgagatagtctcagtagccaagactggccttgaactcctgatccttctgcctctatttccagccctgggattatggatgtggaccagtgtgcctggttttctgtggtgctaaagactgaactcagggctttg

SEQ ID NO: 35448 - DNA, 2399 bp, Mus musculus
agtgagggagctgatagtctatctaaagaccaaagagagaagagactgtcccgcaccgcgggtgtaatcacatggctaggcctttgcaactcggcagagatgtgagggtcggtgctgtgttcacccgtgcaaacagggttgatggcgtcaaactagagacttgtgggtctccctccgggcagatggtttctgctcaagcgagcacagctccgcaggcttctctgcagagcctaggctgggatctctggcccgccagattctccttcctgactttctctagaatggtcccgtgccctgccgtgtgccgtctgtgaaggccagtgctcgctcttcctctctgttctcttcccattgtcagccgtctccaggccatccagaggtgtgtcccttctcaccaggagtctgaggcagaggtgtcaggtccgtgttccctcccacaggcctctgcttgggtttctttctctccaggggagaggtcttgaagatgtaaacccctgaagccctgctagtgagtactgctggtggtgtggggaggccgcaggcctcctgggactctggaaggatcgcttgctgctggagggctgtcttagaaccactgggcgcccttccgacccgggggacccttcttcccttcttgccttcttcctagagcttgagcgagatccagcacgtccaggccttctgtgcactggccaaggtttcccaggctgggctttctctttggagtggtgcgatggatcgtgtttccggggattcactgtaaagtccccgtcctttccagtgtcttgcgtgcctggtgtgtggaaggagatggtttcagtttcctagtgaggctgtggcagttcttggaagtggatgaatctgggcacacagcttctgccctgtccctgcctcactgcctgatctgctgtcctcaaggtttacatactggtgatgtcaccatagctgctctggagatcatgaaactgatccttaacattgccttactggacatgccattccagagaggggacagtaggctcttgaaaccaagaatagagaagttcaaaagtaaccagtctattgcagacaattttagagttttatatcaagctgtgctgtaaatatcatttagacctattgagaattaacagcaaatctgagctactttagtgttaccaactattagtctgctgactgtttctataacaaaatacctgagacaatcaacttaaaaagaggaagggttggggaaaaggttaatcttggcttgcagttttgtaggctttggcccttagtcagacctgctgttttagacagcaacacatcacttggggagtttgttgtagatctggaagcaaggaaagaagggcggtggcttgaggtcctgaggtcacttaagggcacaccctctctgacctaagacctcactaggccccgcctctaaaggtttctgacctcaatagtgccttcctggagaactagtttctaactctcaggcccttggggacattgcatctcagtagtaggtgcctctctacctgtgtttggcttgttcatgattggcagacactctgcctggctctgcacagcagcggctcagcatcagcatccagctgcttgctgtgtgttagttgtctcacagctgagggctctgcctcggctacttcaggctttccggttaggaagataatttggtcacttgtgtctgtggccactcttagaattttctcttttgagggaacctgtgactggttggcttttgcattctatggagggagatggggttaaagactgtggcaacacacaccctccagaagagctgggaccagagactgtcagcacagaaaggacaatgtcttttttagtagctgtggcagacttgagttgctgtaatttatacaaattgtttagaatggtttttaagactaagaagggaaatatacttattgcacaagacttttataattactatacttaaattatgctctatgtggggactgagaagtgtatttctacgttgcttatatctgatcacttttgtatttgttgatttaaagcctgtgggtcttttttttaatcactcttaatatcaacttttataatcttttaaaataaatcctcttaattccagtgtttgtgccttcacagttgttcattaattacagacttatttagatgaggccctcacttgaggggttagctgtccccatgtctgtacgtgtccaatacacgggctgtcttctggagagtgggattcggacttaaacatcatgtttgtcggctgtggcagcacaggagtctccaatgccatcacttagggctgaagcaggaaggtcaccagcttaaagccaacctggtttacatagcagggaaaatactgtaagagctagctgtggtggaggcagatctgtgtaagt

SEQ ID NO: 35449 - DNA, 1336 bp, Mus musculus
ttatttttcaggggtgggatcctactcagttttagagttttggctctgctgagtgttttgttactaaatgtttctctattgaatgctcgcacattataattatcgttaaccctgatacacatccttgaagctttttacccttaaattttcttgaggggaggggtgggggctagccagtgtctacctgtgtagcccagactgcctttgagtttgtggcagttcttttgcctcagcttctcaaaattctaggtttacacgtgtgcaccaccacaatgatgcatgcatgctgtgttcattaaaatctgtaaaaacacgaggtttgtggtgcatgcttgtgatctcaactgtgggaggctgaagtgggcagaccctcaggtcaaggcaatcattttacaatcctatcaaacaaaaccacacacacacacacacacacacccacacacaatttggagcccatggcttctgagtgggttctattcccagaaagataacctaactctccatttctctcccaagatgcatctgcctgatgaggccacagcctctggaggaccctcgccatggctgtggactcttcaggcgacaaggcctgtgccttccctgctttgccaggatactgggctcctgggcatctacagcctcctttcacagtctgctgcagaggacatccctccgttctgggctgttagcaccactcaggtaccaaggactgctctgagcacagtagagagacttgtggatctgcctgcatagacacgcctttcttcataccctcaggaccgagaccacacagaggccgaagaccctaatttatctggcctgtcaatctggtcttgaagcgtctctaagtgaagagccagaagaaacactatgtggccatcctgtctcctgcccctatctctgcctttgtcactgtgggtgggggtgggggtggggaggtgcatagtttttaataaaatgtcaattgcagcaggtttccttattgcatgagatgtctctaacactaggcctttctatgccagcttgagtgtggactccttgctaaatgcccatcctcctagactggcttcaaactaaattatgtagctgaggttgacctagaactcctgatcctcttgcctctacctcccaagcactaagattagaagtgtgtgctaggacacccagttttgtgtggtgctggggatgaatttcctccatacatattaggcaaccaccctactaagctgacatcccatcccccagtcacacacacacacacacacacacacacacacacacacacacatacacacacacaagcttcccatcttacatagttttgggttggccttga

SEQ ID NO: 35450 - DNA, 1207 bp, Mus musculus
tgacttttgtcacctggcagagttcttcggtgcttcagctggatcatgccacatgccagtcaataataactcagtgtgcactcgctggtaaggacagtggctgagttactccctttgcagccggaagcagccgactgttattttagctaacatgcagcccaggcgccccctgcaggtaccttcaaacctccagccaattagcgtgggaataacctggattgttgcagcacatcgcagggacagctcagctggtttcccgtttgccccctcctcctgggtgcccgagcagacatgtgccaacatctccatatctgccacaggtcaccctgctgattgccttcatctgtgtacgaagctccgttccgatcgactatggtgcccacagcttcttcgaagtcgtcaccatgtgcgacctgataatgatcctcatcttttacctggtgcacctcttccgcttctaccgtgtgctcacctgcatcagctggcccctgtcggtaagagtgagacttggccccactatcagaatgcaggaattgggacgtggccacttgtttcttcttgtctgcccattccacatctctagcccccgaccgactctggtgcttccacagacatctctgcctgcttccccggggtttctcaagctcccttccagggtcagaggcccggggctcctctcagcatttatctgttgtgtgtggagagttgttgcaggactgagctggtgaggatggtaatgatctatgccactgggtgcacggttgggagagttgaatggtgacacttagtggctgaaacacactggcagaggctgagaagataaatcagaagggctctgtctcgaagacagtactgtgtaaaccaggctggccttgaactcagagagatcatgtgtgctatcacacctggcaaatgcacttaatttggtactgtgatctctacctgagcataaaggccctctgtcgattataacagagatctagtggattccttaggatccactatgtaccaaatcataccatccgcaaataccaacggctcacttcttcctggctagtctacatgccttccatctgattgccttgccttatacagaattagccaaacagagtggtcggatgttggatagaagtggcaggagcaggtgtcacggctttttctgggagcactgaagggaagcattgtatcttccctcctgaatatgagg

SEQ ID NO: 35451 - DNA, 1243 bp, Mus musculus
ttcaggcctggagatttttcagtgtctacacattaatggcttgtccacagatttcaaggtgccaagtagaatagtagccataattttaatcatgaatttggtgcctggcattctggaaaaggaacagcgactggctagtcggtcatgctttgaaatgcttctgtatttaattaatgttgacgatgactgtggaaagttctagaaggcagagagccccacaagtaggagatgtcatgtcccctggaagagctagctgatgctgtgctgggaaccacaaccagaggtgaaataacacctcctagaaaaggagggtgcaccaggccacagggctgaataggggaaaaggtgtggggtcccctatggtgccagtggttgggccacttaggtgccaacatgcccacagatttttgttttgtttttaaataatctagtgggtcccagagacgtcctgctccctcttgctttgctgggagcggcacccgggaacagagtagtccttcagattctggttggtagagaaggcctctctctctctgtctctccctgccctggtttcctgcctggcccaatgcatctgtttcctccctgccatctgcctaccgcctgtgcctctggccaacctccaccctggctgccccatctgacctgccagcagccgctttgccctgtcaccagcctggctgctcactggctggctgcagtccctgcatctctcacaggccagcaaaggcattctgggctctacagagcttggacccagctgggagcctgagggactcccagaagtgacagatcatgcctgctcaacttactccactccttgtggggtatctgtagctgctgaggcccagcctccaccagacagcaggtccccagctcatgctggcagttagcaaggctgagacctgagggtaagtgttttctggggctctgaaaggacagccatgagactcgggagaagtcctttcttatcacggagatggatgggaagacaggaagcaggggagatgagaacctgcagcaggacctcagggctttcattcccaccttcctgaacagctagctggaactcccatcttgcttaggaagaagcaaaacaaacgaaagcttttcaccacttcactgtagaaatgcggccgttaattgaagatgggctggtgagctgggtgctttctcctgtatccttgctaaactctcactgcctcaggaggttatatcccatgcccttgtttacggatgagta

SEQ ID NO: 35452 - DNA, 3489 bp, Mus musculus
cactctcacacactccaagaggcacagagcacaacctaacatgtccttcctacccctctaggtttcccctcttcactgcagtgtatcagatctgctatgaaggcaggcctgtcacgcagatgctgtcctgcctgcagagccacccagagcacatctgaaggagtcaggcagccatcaggaacagctctgctgtgcccactggaggaatccggggcttggcagtgggatcctgctgaactgtacttcgaatacatccaaattgttacagctttgtctctgtgccaggagaagcactcctccactggctaagatgtgtcgggtaacaactacagacacacacgcacatgagtgaatgtgtgtgagagtgtttgtgtgtgtgtatgtgtgtgtgtgtatatatacaagtgtgcacctttctcattctgtgagtgtttctctgaacccaaatcaggtgtctattgatcacattttaaatttcccctccagggcagcttgtgaagttagaactaactcagctaaatgttatggctgtgactcatttatatgcaagggaagggaggaactgggtttttttccctctgaaacagctatccagcattaaaaacgtctgcatatatgtgtgtttgaagaccaccacacttttaaacagcatctcagagccagcagcatgaactcctgggttgtggattgacggctaaacaatcaggtgttttaattagatactccacagacaggtgtcttcttgatacagagaccacattccttgcctctttcctcttcatttgctgctagaatgggctttcatacagacccagcaaggcagaggaggaacatccttgcagtggctggggacacttcattatgctcattgctaggtggactttttttttgcagctgtgtctcttcaggcttgtggaaggaaccctcaagggggccactgtcacttctcatgtaagaagccatagctgtacctggtcacctggggacatggggacattcctccatccctccaggatgggacctgcgaggatgtccctgggcctctctgacctgctgtttgtaggaatgatgtgcctttcctgagggccaggagggctacttgccttggagatttgtgtggcaaagagtgggaaagtcaccacccacgtggtgtccccagtcagcaggggcatttcactcagcaggatcccactgccaagccccagatacctggtgttcctccaggaatccagtgtttccacatgccttctatgcatttcggatgctcactacagcagagagccactgcactagagaatttacagcctttgctgaacaatgctctataagagacaagtgtcctggagtctcctggctaagccaggtggaccctggaatggccaagtaagtttggccatcccagctgcctgacttttcacactttcctagagtggggagggatcctggatgctaggaacccataaagctaatacgtcccaaacacattagactatgagagtcttgtttttcttaactagaatattaattaaaatttctagagaatactcctatagagtgaggtgaccctcactctccacaggaattcaggatgactaacttcctgtgagagttctatgtagcctgggctggccttgaatttgtcaccttcttgcctctgtctcctgagtggcctgggctttgcagttctggcctaacccctgagaaagctttcaggatgcagggtcaggcacagacaaggggatgtcgacctcagtgaaacgcacactatatggagtgagtgctttggatgctagaattagaacacaaatgattttatctttatttaaaaaccaggcgtcccacgggggtggaaagagcacacggaggtcattgtcctgtgctttagcctatgagagtttccacttcccctccctcctcctgggtttggttgcccccaccctactctacatcccttctataactgaaaatgattgtaaaataaatttttatgagaattttaaaaactgtccaagaagactttttggagcattataaagtcccacacctaaaacgcacagcaggctgaatatttcagttttcttaatgatgtcaatcaattttttcttgcctcctaagtcttttaaaaaacgaaactctgtacatatgtaacaaagagttactttttaagatatccaaagggctgagagctaccgtggtgtctacaaagtagcacaatgcagagttgttgacgtgttttgcatcctcgtgtacattcaccctctctctggccttgtacttccgcttcttccttccctaatgaatgaccttacttactgactgacatccccctgaagtcagctgatgtgcttataacccacccaggagggaaacaggtaaatttcttgtttgtgctctgaaggccagaggcattgctgtatgcgttacctgtttttgtaaccttgtaaccacctgctgattggtgtttcttggcgataggctcagagacacctagattagaaacttcacctgtgaatgtaaaactaagctcttgccttgctactctcctctccaccgcagttttggacaaatctttggaaacccacccctggggcagagcctgccttctggtgttttcatagctggcctaagaagggtgctgtggtgagatcgcagtgtctaaacagaattgtttctctgccacttctgactggctggcctcctacttccatatgtactgtatttgtttacggactgtaggtgggtgtatagtgtaaaggcttggtttaataaacacaacctctcagacctgttccatggagcctatttttcctttcttgtttttataaattattattggggtgtgctgtacaaaattgtgtctctgttcttacctacccaaggcattctttgattggctttaataaaaaatcagatggccgattagctgggcatgaagtggaaggtgggacttcctgggagggagaaaggaactctggaaagaaagaaggaggcacgaggggagacaaatatgattttggtactagaaagtagccacatggctggatagggctaggtggctgggttaacttagatgagctagttgagagtctgcccagctaaggcctaaagctttgaaatattaaaagtctctatggttatttggggaaaattggataaggaataattgccattgtattcatttccagcattaattaataaatacagaattttaatatttatattataacttgattgttgtattttataggtatggatgtatttggcctgcatgtatgtatgtatgtatgcacactatgagtgtgcctggtgcccacagaggttagaagagggcactgggtcccctggaactggagttacaggtggtttcaaacctaggtcctctggaagaacagcagccagtgctcttaactgctgggccatccctctaacctcgggttttctgagtcagggtttcatgcagctcaggctagtctcaagcttactccttag

SEQ ID NO: 35453 - DNA, 1116 bp, Mus musculus
gtgcttctagttactcagtcctataacttctttgtcctttctctctttcccctcctccctccttcagctcagaggaaatagccatgcaacatcatgacaggcctcttgtcttcccaacagatgctacaaaggttgcatctgtattggagaatattaaaaatgttgagatgaccctgaatagtcaggaaaggaacactgaatatacatctctgctcatgaaaggaggaagttacacacacatacacacacacacacacacacacacacacacacacatgcacacacatgtgcacatatgcacatgcttacaggcacactcatattttaggcttagttatctgcaaaatttaccaagtcagtgtaaagattctgttactaaggaagtgtttgctgtttgttctcatggaagctgatataaataggcaatggccatgttctctttcagaagttgattttataagatgatgtggctgaaaatatcccttacagatcctggagtccctctgtccctgctggtgcatctgtagactcatggtagttgaacatgttttaagttcagcttggatcgcggatctgatttccattgcctttgggtttgacttccatatgtcagtggcttgagaaggctctggatttgtcactcctgtgatgcctgggatcttgtccgtggtatcacaatgtccccttttgctgagtgtgtgctctgtcacttgtatgaccaggcttggagctctgcatgaatcgcattcggcgctgctgtgtggcctctgtccatccctctttgccagccaatttctgtgagtctccagtgagcctgtgctatttttagttggcttatatcacacagaattctcgagcgtgctggctttctggatgtgtctgtggcatatgtgcagatttccacagattgcatctctgtattttaggtttgcggtaactcggggaggtaagctgaagtgttgaggcttcccagggcttcagcctctgcactatttgatttggggctaatagtttgttctgggtaccactctctgagccgtggaacgaacagcggtgttcctgaccttgacccacaagatgttatgggcacaaaaatatctcgagaatttgtggaaa

SEQ ID NO: 35454 - DNA, 1175 bp, Mus musculus
ccactccttcctcccctccctctctatctctctccctccttcccctttccgtttttctctatttcctcctattattgagaccacatctttcgctggcctagaactcccggagtaggctggttggccagtgattcccaggaaccctcctccccgtcctccgcaatgtgctgggatcacacttgtgtgccacaaggcaagcacattttttgtttttgtttttgtttttttaagttggtttaggagatcaagctggggtcctcctcaggtttgtaaggtaagcaccccactgacagagctctgtctttagccttgagttttcttccctccatttatttccttgggctgggcatgcctactgggacagaggacaacccctgggattgactcttcccttccaccacgcaggccctggggaactgaactcagaccatcaagcacctttacccatgggagcgtctcatgggacgagtggctgcacattcctttctgtggtttgtcactcaggccactcagttcccagatgatggttgtccctgctgtaggagcgcctagctgggcttcagggggaagtttatgcttccccatcaactgatgccattcctctaggccccacattctcacgacttgctattgtaagtctgtttattgtagtcattccagtgtgaatgtgagacccgtctccttgcagcctcatttacatattgctagcatctaccacgtgtcccttctcatttgcttgtgcagcgtttcatgctcgtggtcatcccagttttgtttctgtcactgtgataatacaccttgacaaaatgcaacctagggaagccagagtttcctttagctccctgttctgatacattgtgacagagaagtggagacagcaggagcttaaaacatccacacagatcacagctgcagtcaagagcattgactgcctgcctgcttgacactcagccagcttccttaacatagtccaggaccgaagggcatggtggcgcccgcttataggctgagtctccttacctcagtggatgaaatcaagacagtctcctcctgacatgcctacaggctagctggatttataattaaaaccacccagcacaattaccaacttcactgggatgggtcacctacctccatatgtctaagggtgtttccagagaggcttatctgaggag

SEQ ID NO: 35455 - DNA, 2019 bp, Mus musculus
aactaattccatgtattcttctctctttctagactactaaaaggaagcgtggctacgttaaaaataagctagtgtttaagaaaggcaagaagacctctaagaagactgtttaaatgcgctgttctggcctcacttgcagcagtccttgagagaaccggtctttgccttctgctcatgtcctgtttcacagcaccaagggtacagaacatcgctgggccaagtcaatgtacaaaatgttctggcaatgcctcatttaaaattaaattggtttattgagaacagctgtttctgatgtgtaacgtgaagcaagacagagccctgctgtgagcagctggcagaagattttttttttttaattattggtacatattacccttcaaatctgagaatttggactaattgcaccaaagaaccctctaatttggtccctggcacatgcgtacctgtcaactttttttcttttacaagacctgcattttatttgaactacccaaatagcaatatgtaagacagaaatgcagatgtgatgagagcttcttgaccagtaaacaaactagcccaggtctgagagagacgtgctaaaggagagtctacgtctgggaactctatttattttcctgtttctccggtgtgaagaatgtttcatcaaatgtccactttgtcgctcactgccgctgtaagcagccgctgctgacggtgggcctccctccgcgtagttagctgactagatgtttgtgttcaggcatccggatgcactgcggttagcgggcatcctcaccaggtactcacagagcagattccatgcattcttcattcaagggctaaatttctctcctttgggaatcatggcaagcgcacacagaacgttgctggccaggatggctgttacctcagtactgaggtcggctccatgttcccacgcagaagattaagggaaagcccttacggtggacaggcatgcagagttcatttctgtgactctacacagtgacaaaggatttgtaaactttgcctggattttcctcattttataccagttttgttcatcacgatggtttctgttgaccgcttcatgtttttataccttaagcatttgatgaaacactctctagtgctctctaggcgtttcttacttttattacaaatgtgacaattgtcaaaagatgcactaaaatataaatggagattgagcctgttcattttccagcttataggcaactttatacagacttgaaatctttatccagttgtttagtaaagtgagagagaggtttcctgccacaggagaacttttacacaacaccccactgctttagtgggacagttgagagcagtgtgtcccttttatgaagaacccgtcatttacagcgctccgggagagagaatgttactgcagatcccttttccacggtgtagatactctgatttatagaattcattcttgatccagatgatggttctttcacagaccaataaaaaaaaaaaagtataactaaatctggatttctgataccttgtcatttgggggattttatcttactttgctttacagttccatgcagagaagttatgaccatgagggaaataaagcttattcaatttgtgtcacgccttgtctcttgcagaccttgtgtttgaaagaagtgcagagttctaaccccagactcccctcttctcaccttagaaaggtctcagccagtgtgtggaaagtaagtgcgttcataacgcagttttaaattccacctttttactcagaataagcacacctcattatgactttggggtcagaagaaaaggcagccaggctgtgagggcagccattctgcacgctcagagactgcatagcccagcattgagtgcagttttcacaccattcccgcaccttcctcgggtttagggagcaagtttggttcaaggcttggtgtcagtgaagcacacagtatgagggtttggatctcacagtgctggagtggggaagtgacaagttggcggtttcaccacactcaagtgtcagctgct

SEQ ID NO: 35456 - DNA, 1175 bp, Mus musculus
tttctgaagcttatagcctttggtctgaggctgtcaggcttctttagagcgccggctgctcaggcctgattgtcctttccagtgctacctgacagatatccgtccgttgtgttcttcttttccgtgttggctttaaagaaggtttaaagccagacgttggtgctggctttctgaggctgttttggttccgtaaacttagagtgcctaatgataaatgcacacattcattgtcacctgtcagctatggatattataatgtatggagctataatttttttatatctgtaataattaaatttgaatgatagtacatttctctaaattatttttatttagtcaacaggactaaataatttaaataggactattggtcaatattgataatttagaaacagttgctttgtgagatgccaactttcagatgtattctgtgctgtggtgatgaacatgtggtttcccgggacatttttctgtcggtgttgaaagagaacctgtctttgcagtcgctctgtatgcgatcagtgctgtctactttgccggagtgatggtgcggctgatgctgactctgaccccggtcgtctgcatgctgtcggccatcgccttctccaatgtttttgagcactatttgggggatgacatgaaaagggaaaacccacctgtggaggacagcagtgatgaggatgacaaaagaaacccaggaaacttgtatgacaaggtgagggctgtgctgtctccatcttcccagcaccagaagagtccccagatgtagaagagtgccgagatgcgagtacctgaagctgggccttctgcagtttctctccattgcttcctcctgagctgagccttctgtagtttctctccattgcttccttcaaagctgaaaccctagttgctctttgagctcagagtaaacagaattagtgcttaggtatgttagcacctttcattttccgagagcacggctcatcagatttcccgatgtgcaccagtgcttgcacttgtccttagtctgcgtttgctgcgaccttgtgtggttctacctctgtgtattagatggtaacttggtattcaaaagaagtgtttggttaaacacctgtttgttaacataatgaggaatttaacctgcataacaggacaaagcctgtgttggacacaattataggaaagacttagga

SEQ ID NO: 35457 - DNA, 1099 bp, Mus musculus
tctgaagacagctacaatgtacttacatataataaataaataaataaatctttaaaaaaaaaataaataaataaatgactaagacagttctcagaactgagaaagataattaataaagatgattgcatattcttattttaatattttaaatattaaatattaaaaaatagaatatcttattcttggtttatattctctctgttcttttaagtgtatttcttataaatttgatctttgtatctattacaaaaagattttattttgtatcatgtaaaaattttccgttcactcttaactacaaatgatgtatactaatacaaatggaagaagttgtgtgttttgtgtgtgtgtatgtgtccccactttgttcactatgtaactaaattccctttttcccccctctctaggtttacccagggttgatgataacagctggccttattcattggattttaaatacattgaacataacagttcacataagagatgtgtgtgtattccttgcaccaacttttagcggccttacatccatatctacgttcctgctaactagagaactgtggaaccaaggagcaggacttctagctgcttgcttcattgctatcgtaccagggtacatatctcggtcagtggcgggatcctttgataatgaaggcattgccatttttgcgcttcagttcacttactacttatgggtaagtaccaggtaatgttagccgccttaaatgctggtgaccttctgccctaaggctttagggcacacatgcgttctttaccaataaagtttcacacagatctgttactactcatagtacatttaacaaaagttaccatttaaaaagcatacaagccaagtatatcaataactgtattaatatgtctatataaattttaattttcaccaccttattgtatctactttataatcatagcttaaaaaaaaaaaagctaatcccagcacttgggaggcagaggcagacagatttctgagtttgaggacagccagggctacaccgagaaaccctgtctcggagaaaaggaaaaaaaaaaagctaccaggagcagcctgtcaactatgcacaccttttatgtgaacact

SEQ ID NO: 35458 - DNA, 1616 bp, Mus musculus
atggatcacaggtgagacttggtactgtgtgatgagaccagggtctctgaggacagagcagaagaggctgttggtaaaggtgtagcccctgttttagtagaagggtgaatggggtcatgttgagacactgaggcttggcaacatatggcaagatcagaattcctatgctgactaattttatgtcaactttgatgcaagcttaaatcatctgagaggaggtaattgcaattggaaaatgcctctataagatcaggctgtgacttcttcttttcaggaaaacaccaaatggcagatgacgccggtgcagccggagggcctggaggacccgggggcccaggattaggaggccgcggcggcttccgcggaggattcggcagcggtcttaggggccgtggtcgtggccgaggctgtggccgtggtcgaggccgcggggctcgtggaggtaaagctgaagacaaggagtggatccccgtcactaagctgggcggcctggttaaggacatgaagatcaagtccttggaggagatctacctgttctccctgcctactaaggagtctgagatcattgacttcttcctgggtgcgtccctaaaggatgaagttctgaaaatcatgccagtgcagaagcagactcgggctggccagcggaccaggttcaagactttcgtcgctattggggactacaatggtcacgttggtcttggtgttaagtgctccaaggaggttgccactgccatccgaggggccatcatcttggccaagctttccatcgtccctgtgcggagaggctactgggggaacaagattggcaagccccacactgttccatgcaaggtgacaggccgctgtggctctgtgctggtgcgtctcatccctgccccaagaggcactggcattgtctctgctcctgtgcccaagaagctcctgatgatggccggtatagatgactgctacacttcagccagaggctgcactgccaccctgggcacctttgctaaggccatctttgatgccatctccaagacttacagctacctgacccccgacctctggaaagagactgtcttcaccaagtctccttatcaggaattcacggatcatcttgtgaaaacccacaccagagtctctgttcggaggacccaggctccagctgtggctaccacataagggtttttatatgagaaaaataaaataattaagtctgctgataaaaaaaaaatcaggctgtgagcaagcatgttagagcattttcttaattagtgattgatggggagggacaagtccattatgggtggtaccatctctgggatagtggtcctgggctctataagaaagcatgtgaacaaagccagtaagcaacactcatctatggcctctgcaccagcttctgtcttcaggctcctaccctgttcctgtcttaattcccttccatgatgaacaatgatgtgaaccttttcctcctaagttgcttttggtcatggtgtttcatcacagcaatagtaacactagctacaacaggccctggaggctgttggtaaaggtgcagcccagttgcagagaccctgatattttggagctcccagtcccatagaacaattattaagaacatcagccac

SEQ ID NO: 35459 - DNA, 1167 bp, Mus musculus
ttcttgtgggttcatctatagtgaaatacctatttgctatcttttattcattttctaggttggctcgcctgtataatgtttcggttcaagtagtaagagttctttatagctcgcagttgaaaatcccttgtcaaatatgtagtctgcaaatatctcccctcccctgcctatagtttgcctttttaccctctcaacaggattttcacagagtgcaaatttttcattttattaggtcgtaggatagttaatcttcttgtcaacttgactagatttagagtcacctcggacacgcggctaggcatgtctgtgaaggtgttttcagagatgtgtaagacagaaggctaaccttgagcgtaggggcaagcatcttatatgctgggtcccagactaaagaaaaagtgaaaagccagaccgcagtgaacaccagcagccaacttgctctcactgcatgtgcagaaacagctgtgacacaaaatgaggtctatggccgtgccaccctgatcgcgccggatcccgaatgacctcggaagctaagctgggtcaggcttggttagtacttggatgggaaaccgcctgggaatgtcgggtgctgtcagctttaaagaaagaaagaaaaaagaaaggcgaaatgaggagaggcaggtgctacacacggcctgtgcaggggcatgcatctcttctggggaccttttgcctctgctcactggcccactctcattctcccaactaccttttctttcttaataaactgtgtctatttttatttctaacaatgtgttcctggtgcaatccttcatcctggaccacaagagcctcaaacgtggtgccctccgaagtcagacttgcagcctggctctaagcaaaaccaccctttcttcttctcttcttcgcgtctttttcagataccggcagaagcctaagccagtttcccctaacactctggcctgtcactctttcttgatagacaacccttggccctaacccccaccgccgcgctccgcctccctaacgcaagagggcgtgatttttttctcttccttttccctatctccctcttcccggaagcttccaaggtttgcagcttacttgtcctatcccaagtcctttgtttttatcaaggatgtcgggccacactgtcaaatgaggtataatgacactgggctgttt

SEQ ID NO: 35460 - DNA, 1212 bp, Mus musculus
agcaagccatggggagcaagccagttagcagcacccctccatggcctctgcatcagctccagcctccagtgagtaactagcctcacatgaccttcaggtgtaagccaaataaactatcctccctaaattgcttttggttaagtttttttttcttcttcttcttcttctttgtttttgtcatagcagaattcagtgtactctaggaatgaattagagggaggaggattagaaattcatggtcatccttgactacatagcaagtttgaggctcgtttgatatacatgagagcctgtatcacaatcatttaaattaaattaaactaaactaaattaaaattttcttagtaggtgaaacacaagatgagtatgcattcctcatcattccccagagatgaccactgtcattaggtctcctgtgtatggcacattcagatattttctaagtgtatttaaacacaagtgccctcctccagatgcacacatacaaggtgtgtagaacactgctagaccaggtgtctcagcctgtttcaccaccagctgtgaggctgacatgcattattgaactgtccactccccattttaactcccccattccctcctttgagatgctaggatgattctagtactcctgtcaaagggatgctgtgaggacttgttcataggaaccccaggtagggatcttattaaaggagcaagaggtatctcaagtgggtctccccataaactcatccatttaaatctttggtttcggttggtggagcagtctggagaggattggcaagagtggcctgctggagaaggtgtgtgctggactttgaggttccaaaaagccatgccatccccagtcagcttttactgccttgtgccagttgagcaagatgtgaactctcagctcttgtactggtatcagccctgtctgccaaacgccatgctccccattgcgttaatcatggcctctaaccatctggcactgatgccaaattaaaagtcttcttttataagctgctgtggtcatagtgtcttatgatagcagttgaagagtaaggaagacagagtagttaggagctgggaagatgctgggtggttaagagcacttactgttcttgatctgagtttgttcccagcacccagatgagccagttcaaaaccacctataattctagcatcaaggaatccactgcccctttctggcctccacaggcattgcactca

SEQ ID NO: 35461 - DNA, 3366 bp, Mus musculus
ttatgttgcgtcaattaaacacaccagcccaacaactcaggacatgaagggtttatttggcaacttcacaactgcagtccattatttctggggagtccagtcaagaactcaagttgctgatcacaccatatccacagtcaagagcggagaggcatgagtgcaccatgctgcatctggctctctcctgtctcattcagctcaggagcctctgcctagggagtgacgccacccgcaaagggctgggtcttcccgcgtcaattaaaaatgaagacaattccccacacgcatgcccacagacaaacctaatctgggcagttccacaaatgagactgtcttcttggctgctcctaggttgtgtcaagttgacagttaaaactaaggaggactccgtctttcttgattgactaaccagggtggaccagaaaaacgtgatactaagcgattaagtactacttggctcttcacactttggatgtcctagaagggggtcagacacccaaccacacagtctgcattgactccctcgagtgtgagtcaactaagagtcacctctgtttcacagttcaaggatctctgagaactctgaagaccccacgattatccatagtgagggatgttgagtcccagggctcagaatgtcggcagctctagacaaacattcagttctctgtttacagtgcgtgtggatgccccttcactggccttgaagtgcagaggcaggtccagcttacacaggttctacatggtcctgatgaagaagttatcacagcatggtaggcacccacagattatctctctccagcgctaacaacacccccaatcccccttcttccctcttctttatctcctgtgtctccactgttgaagagccagggagactccagtgtcatggactgggtgttaatatgtagcttcttggtgatcctgcatattgaaatccctccttaaagagatgataaattctaaagtgagaaaggatgccaagctggcctacataaagcaggagcttaagggaagggcaggagatgtcaccagagataacctgcaacttgtttaaccacagctgtatgctcagggtcttctggcatctccatgagcgactaactctgccttctttggtacctcttaagggctatttccagtacaaaatgaccattctaacacctagctagccctcagcccacccactacccaagcatgtacaaacaagatgtactatttctgtatccacaggcttgcctcccttctctccctgctttttaaatcctgctctggtctctggcctttggcttcatctttaatccaactcctcaaacatgagaagcctttatatgttcaataaagtagcaataagtagcatggagcccacgcacagaaaagctgcattattctttgatggtccctcctcctagggaggcagggaaacttctgtggagtgatatcttgtagacaactgtgacagaggctgctagctgttcccgatatcctcagtgtcccctcacatactcggtcaattctgtttcttaggcacaggagcttgtgtagaaagactttccctctaccctctgagcgcttgatacccaagtgcatgaggtgactgctaaaagacagattggcagctgagacagaactcatggctcatggttgtcacagggatggaagtcaatacctataaaaccagagggatttagaaactctaaaaccttgtcacttaggcaggggtggtggcacacatctttaatcatcccagcatttgggaggcggaggtaggccgaccattgagtctgaggccactctggtctacagagtgaattccaggacaaccaaggctacacagagaaaccctgtcccaaggaaccaaaagaaactttcatatttgtgtgtgtatgtatgtgtagtatgtatatatgcatgtatatgtatatgatatgtaagcatgtgtgatgtgaggaggagtggtttacaaatgtgtgtgtgaagctatgtgtatgtggcttgtatatgtgtggatggatatggatatgtgattatgtatgatttcatatgtgtgtgtgtacatgcacatatgtatgtatttgggaaatgggtgggtggtatggtatttatatgtgtgtgctaaagggggaatgtatgtatgcatgcatatatatgtgcctatttttttgtgtagtgtgcatatgtatgtattttgtatatgtgtgtggtatgtatgtgtgcagtgtgtgtgaggcagtgtatgtgaaacagcatgcagtgtaaagcagtgagcagtatatgtgaggtggtatacagtgtgtgaggcagtgtgcagtgtgtgtgaggcagtatgcagtgtgtgtgaggcagtgggcagtgtgtgtgaggcagtgtgcagtatgtgtgaggcagtgtgcagtgtgaggcagtgtacagtgtgtgtccctatgcagtgtaaggcagtatgcagtatgtgtgaggcagtgtgcagtgtaaagcagtgtgcagggtatatgacactgtgccatgtgcagtgtgaggcagtgtacagtgtgtgtccctatgcagtgtaaggcagtgtgcagtgtgtgaggcagtgttcagtgtgagtcagtgtacaatgtgtgagacagtgtgcagtgtgtgaggcaatgtgcagtgtgaggcagtgtgcagtgtgtgaggccctgtgcagtgtgaggcagtgaatttgggtcccttttccaagcatctgtgcttgggtagaagaaacagggacaggccgtccgtccctgtacccactgttgtcagtacatcagagcagagggcttcctgaacacctatacccatctgtaagatctttaaaaatcctgggagaagattttccaccacatagctgtgggcctcatgcctacctataggctgaggaacacagtgttgataggaccagctgtctccacaggagctatctggtcagccttcagagaaaagaattcggagggggtctgttcctgcaaaggtgagagaggccttgggcagataaaagactacaagtttccatggggggcttttaagcttctgaggcgggtacttcctgtttgcctggcatagcccttctgtggttgctgcggaaggtgggctaggctaattgccaatttgtgtgtgaagtaggaaaggctgggcttctttcatcttgaacttttatttcttatgtgtgctgccctgataaatctgcttatcatggctttctctggatgggtcctacagccttcatggtctcctgtgtccctgttgaaagtcttattcacacacttgtgtgcacaccttgattataaacaattttattttttacttctctgcctttggcttacttcaaacccattgactccaccaccaggatgtataaaacaa

SEQ ID NO: 35462 - DNA, 1185 bp, Mus musculus
ctcacacttcagcctggatgcccacacttgaggcacaatgtgtaataaaggatctaacaagtgcgtgggtgggtgggactccacagcagccctgtagggtcagcctgataaacatgcttccttttgtacagatgggcagactgaagggcagcaacttactgaaggcactgtactgccaggcgatggcccgagaatcagagcccaattctctgactccaggtctagactttttacagaaattactagtgtttttcatttttcagaaaacagtgatttgcgtgacttatttggaatgcacattgcatttgtttgtgtcttttccagacctgtgctgatgacagggcagtaggtgtctgagtgtgtatttaactcatgctctgttggcttctgttacagtcgggtgacacacagacttttgcgcagaagctccagctccgagtaccttccatggagtctctgtttcgaagtcccataaaggaatccctgtttcggtcttctaaagagcctttggtccggacgtcctccagagagtccttgaaccagcttgacctggactgttctgctgcggcctttgaccccccttctgatatggagagcgaggctgaagacgcaccatggaactcagacggtctcagcagagagcagctgcttcagcggctgcgcagaatggagcgaagcctaagtagctacagagggaagtactccgaggtaggagcgcggtgggtgttggcatacacaaaacgcgccccttggtcgtgtccatagcgctgcattgttcttaccctgaggctggccctggccctggtcactgagggtggatagctggtggcagacctagctcaggtctttctgtggtccacatcccttgcagcagattggcattttggttttcacgttctctgctgtgtctgtggacacctaggtcaaaggtcagtctttgttttctgtgttccccatgcgactcatctctgactagagtaactttagaagtcagaccgacttctcagacagtcatggttacgtagtctgatgtcctcagcgatttggctcattctcattgtaccaatatgtaaatttaaaatttttattttctttcatgtgtctgtatgtgcatgcatgaatacatgccataacacatgggaggagaggctagagaaagtctcgtgggagctggttctctcattc

SEQ ID NO: 35463 - DNA, 1195 bp, Mus musculus
gtatatgcacttatatgtgtatatacacttatgtgtatatgaataataaaattttaaaagcttttaagtatttgcctttgggggtagaaaactgagattttttttcccctcaaaattgttataaaagtaataaaatactattataaacctaaaagcatagagtgtggagatccatcttcctaccaagcttgctatcattatttgttttgtggtttattttctttttgactatcccattagaattttttgactagagatactgagatcattatgggatggtaaatagaggaagtgcagagctgagtgtgttcatgactgcattggtgactgagcacagcagattgtcgcccttttcttatgtttggtctgctatgtgaggcattcaaagaacagcctttagataggccctgcagtcttttatcatcactagtaaacaagtatgctgttagtaaaatacacccaattttcattaacagagaattcttgaattggaaacctctttggaaaaaagtttacaagaaagcaaaacacagtcagagcatctggctgttcatctggaagctgagaagaataagcacaataaagaactcacagccctggctgagcagcataggacagaagtggagggcctccagcagcagcaggacagcctgtggactgagagactccaaagcctctctcagcagcatcaggctgctgtggaggagctcagagagaagtatcagcaagagaaagatgcactactgaaggagaaggagagtctcttccaggcccacatacaagacatgaatgaaaagaccttggagaagcttgacaagaagcaaatggaactggaatctgtctcttctgagctgtcagaagcactgagagctcgggaccagcttgcagaggagctttctgtcctaagaggtgatgcagataaaatgaaacaggctttagaggccgagctggaggagcagcggcgtcaccaccagcgtgaggttggcagcatcagtgagcaacaagaactaaccgtccgcagagctgagaaggcactgaaagatgagctcagtcggctgggggctctgctggacgagagggacgagcacctgagagagcggcaggcccgggtgcaggacctggaagctcatcttcagaagtctgccggggagctccagcaggccttggccaaactagatctcttgcactctgagca

SEQ ID NO: 35464 - DNA, 1330 bp, Mus musculus
attaagcagaaagcaaaagaaatgcaagaaacaaagaaaaagttgttggatcaggaagccaaacttaaaaaagagcttgaaaatactgtcctagagcttagtcagaaagagaagcagttcaatgcgcagatcctggaaatggcacaggctaactcagctggaatcagcgacacggtgtcgagactggaggagaaccagaggcagcagatagaaagcctgaccggggctcatcagcgaaaacttgatgatgtcatagaggcctgggaaaagaagctgagtcagcaagctgcagagctccgggacaagcatgcagagcagatggaggagaaggagcaggggctgggagagctgaggcagaaggtccgcatagtccagtctgaaaaagaggagctgactaaggaggtggcgcgattgaaagaggcggtcagtgggcaggacgtggcactagctggcctgcagggacagctggagcagaagtctgctgtcatcgtttccctttcggagcgtgaatctcagctgcagtcacaagtggaaaagctggaagctgatttgggttgttctctgagtgaaaagctttcccttcaagaagagctggctgagctgaaactgctggcagacaagagtcagctgagggtctccgagctgacgggccaggtgcaggctgcggagaaggagctccagagctgtaagtctctgcatgagctcagcaagaagagcctggaggacaagagcttgaacctcaaaagcttgcttgaggagctagcatctcagctagacagtcgctgtgagagaaccaaagctctgttagaagccaagacgaacgaactagtgtgcaccagccgtgacaaagccgacgctattctcgctaggctgtcccaatgccagcgccacacagccacagttggggaggcgctgctcaggagaatgggccaggtttctgagttagaagcacaacttacacagctgacagaggagcagcgcacactaaagagctcttttcagcaggttaccaatcagctggaagagaaagagaagcagattaagaccatgaaggctgacattgaaggtcttctcacagaaaaagaagccttacagcaagaaggaggccagcagcggcaggcggcctctgagaaggagtcctgcatcacacagctgaagaaggagttagcggagaacatcaatgccgtcacactactgagagaagagctgtcggagaagaagtctgagattgccagtcttagcaagcagttaagtgatctcggtgctcagctggagagcagcatcagcccgagtgacaaggccgaagccatctctgccctgagcaagcagc

SEQ ID NO: 35465 - DNA, 1129 bp, Mus musculus
cactgaagctggaactcccgtggtggattgaccctcgggaacgtcccaccaagacgtggggtatggacctgtaccaccaaacctggcttttccctgtgaatcagggctgtgtagcagacactttatctgctgagtcagcccctggcctctctgtgctgcatctttaaaaggttttcactttaatttttatttagaaaagcttgaatcaatatagtgagaatcactttcattcttgtttgttgtttttaagggacagaacctctgcttgtctctctcctccttccctcttcctccttttcttctttctgttttgataaactagggatttgcacagggcctggtggtaccttgttggtggctccaggtccagagctatttttaagttctggacaatgtattgggatttttttctaatgcttagaaggcttgccttagcttatttggtaatctgcagctatcaaaggaagtgtcggacatagctgaatgtctgaatgtgcctgagtaagtagctatggagtctgggtagccacagggatgtgcaggtggactcaaagcagccaaggcctcggacagtgacctttcagttacagggcaatggtattgcgtgcggggctaggtcggtgtacctcgctgaggagacgtctgatgcccagcaccacagcctgggctctgctgctttgtttcccgtagcttcggaaagtttcatgagaagaatcggatttttcaagtgtcctgtgctcatcacactgtttgtgcctagccttctgcttgtctttgagaacggtgcttcccaggcgtctgacagtccgctcctgttcagtgacgcctagaggcggtgctcactcagcgagatcagttagcacagaggtctcgcatgatgtctgactgaggcaagatctgagtgcccttagaacacaacagaaggtgatctgtgtgtcagacttctaagcaggaccgtggggacaaaagtcatctaagtcttttctggttcagccttgtctatttttcgtttgttgtattatgttacttgagcactgccggcgtgatgtgaggacggatgggtatgaaatgtgcaggtcagtagacaagcttcaaggaccaactcgtgagttacccagtgggaaagtac

SEQ ID NO: 35466 - DNA, 1515 bp, Mus musculus
ccaaggccttcactgtaagccctgtctgaagagctgccttggtgggagtgcccacacagcacaggctgtgcccgggctcttgtcagcgctcagcagcactgccttctgggattgctgacaatcaatcatttgattgacagtttaaatcattctagaatattccaacaggaattaacatttgtacttttttactgtcatccctagagtgtgaatttaccttatcttgaagaaacaaaacagatctcacacaagctggctgtaggagcttacttgtttgtttccttatttcaccctagtgtccttttttcttcctttcagtcatggctccgaacctcatcttgaagaaatggagagagtgaggctgggcagccgctgcctgggaagctgtccacctgtggggcttttagagaatggcgctgtcattacaggccattggtgtagcttgaaggcagatgctactctggcctcagatacattgctgtggaagcaggcgcttttggtggggagatggtggtgggtttgtccttttttattcagttttttcttgggaagttttctgtggtttaaaggctgttctgactggccccacctggcttggctcttcagtgtctttttcttgtgttctccctctctttaaagaactgtccatcttccttatttattttagggtggtttctttttcttcctaaagacttgtgcaatatattttgaggtgaaacttagtgaatttttttctgataaattagagattttaattgactgtttcacagattgattttttgaatatttgctaaagcctagttctttatgctatgataagtcccaaatggcagtacctcatgtttacctagcttttggacttatattatttttcagaggaaaaaatactactgtaaattgtaaatagtacataatcctattgtctgcagctctgtgactgttggccatgtcatctcagaggatcagataaataaagtttatttcctatataatagtgttcattgtgcttctttttaagttgaaatcacttcaagatggctaagcacccgtgttccagttcaggttggtaatggagtgagggctgtcaggccagctgactgctggtcagtaggacagatgtgcgtgtgtatgttcaaagccacacgagcaatgaggaggatatggacacacacacacacacacacacgcacacacacacacacacgttataggagggtttctgctctgggagtcactgattgttcttatgcctaatgaaaggaagtttctgggcgggaagctgtgagaactgctcagaagggtccacacactcctcacatccgggggaacatggttctcagactcttagatctgtaaaacctctgcacgggatggaatgttggttatccagccagcctgccaccctcttggggtttcctgcgctgtgagggaggggccacccacaccctacaactgtagctcccttcttgtcttttatgcctcttccgagggtaggagtttggcctcttagtgctc

SEQ ID NO: 35467 - DNA, 1166 bp, Mus musculus
tggcctcagcaggttaaatgagaaccacgtgtttctcagcagcggctgatgagctctgtttatcttcagcgaaatttgtgctatggacttctttaacatcccattatgcccacaccagcaaggctgggggtcatgtttgttttaagggctgaagggaagctaaccggttagctctcacttttaaggcctattcatgttgggggccagaaagcaccttgcgcgtaagctgcattccaactggcccacccaatggcagcgaggagtcacggcagctgtgacacaatacattcaggctccaagtgataagaatgggtaccctcagtcagctaggagatggcactgctggcttgatttactcttgatatccacatagctcagaggtcagactctggcttgaatgatgtccatacagccctggctggcttgtcactaccttccagagcatatgaatggtgtacagacacagctcagggacacacaattttgccttgatcactcagatcaaatgcccagaaatgtaactatcactccacaattcaataatctctctttaactgcagaattcaggcaaacatttccccctctttataaagtatttggctcttgttgagaaaaaaaaaaaacaaaaacccagatcttaccctgaccctatttatgaaactttactatgtggctcacatctatacatgtacataaagaagaaaaaaaaagtggtttaaagctattgacaagatcagtggtatgtaaagggtgaggtatgaagaaatatgattccataacaaccattcccaaagtttgtggatttctcattgaagcttttggcagtgtaggcagttctatctgatttgaaattatcaccttctttttgattctcagatggaaatgaaggcaacttttgctggtgtgtgagtggcatttttttcaaaattggctctatgtagggattcccagtgactataaaattttcagatctttttgtacataaggaacaccctgtagatacattgtagagtttattgatagctaaggatctatcttccaagcccatggcagaaggaattatatctggtggcggtgtagctgatgtgggcagtggaaattttatttctcctagtttatattttcccccaggcactgagtgtggacatatacagagcacagggcca

SEQ ID NO: 35468 - DNA, 1158 bp, Mus musculus
gctggatctcaaatggtgaaccgccatgactagtcacatgctcagatgtcgatacaacttcaggaggcagattttaaggaaactatatggttgctcaggaagcaaatcctaaaaggcaccataggggagaggaggcctctttgcctatctgataatgttgagagctaggggtgtggctgcctggcacagaggcagggaaaggggtggagcattgtcttggaattctctcagctgagttgttcaatgtctccatcccagtctccctccagggatcaggaaaagtgggcaggtggattgatgtgcctgtgttagctctttctagaacattctttttaaaagcccactgtgtcgcctgttgtagccttcctctgcctctgagttcattctgcagacgttctccagggcgctatcaatagcctgcttgtttttcagttgtgtcttctgtgggtttaaccagctcaagaaagactagagcatccccaaagtgaaccctgccacagaaaggctatgacgtagacaaacaagaacaccagcaagaggggctggtcgattgactagcgcacaccctgtgtcctgccactgtggtctcaggcaatgatttgggaaagcacctcagggcccagcggtttgacaggctgcatgaagttgtctgtccgagtcccccatccatctatccttgtgctctaccactcaaccccctacccaacccacccccacgcaccaaatatcacatgacctactaaagccaaaggcaagggaaagtctcaataaacagcatgctgttgggacaccccggggaccagtgacccttgtggtgtggtcaagccccagtgtggagggtgtggaaatgttattcacatttatttaaggatgacacatacgtgatcatatatacctgattaccctggaaacataaacctagagaaggggtgcccagtgtcaacttcctgagatttagcggcactgcaaagcactggcgtttgatgagtggcgtaggatgcagctcagtcacagtgcttgcccgacacaggggaggcatcatttgggggacctgtcccattgataaacaaaaggcagaaactgaatattctcagaatgacttccccgagaacacagaattttagtcgatgtgggtttgggtagaggggtatgtgttct

SEQ ID NO: 35469 - DNA, 1624 bp, Mus musculus
accctggctcaggggacccgcccggcctcggctcactgagtgcagcccaggaagactccgtgctccgggccacagggtgaatgtcaccatgcctacctggtttgttttgttttgtttttttaaagaacagaaacaactattttaaaggaaaaaaaaaaactcttttaatagatttcataaacggactgcattttacaagattcgattttcttaaaaacataccaaaaagaaaaagaaaaaaaaagaagaagaaaagaaaagcaaaaactttgatatctcccgacttcctttcaactgacctccccttccaagcagacaaacctgtcctcttggtcccggtttggagcagctgacccaactcagaatctctttcctacaggatgaagtgcctttttgaatgttattttaagctgaaagttaatttttttgtatacagcctatttccaaacatcttttagtcttttacggtcttagatacttactctgagaagacgaacaggacaattttatagaccccggtagcctgtgtgtggtggggtaaggatgtggtcggggagagcaacgggtcacaggagcccgcctcccaacatgagtgactgtcaaccgtggcgtgcatgggatctcgctccccctgacatgacttttctcctgactgtccttgtgtcgtttccgaccaggctggaatgtacctgccaatggcccaatgctttatgaaacagccggttccttttatgatggtttctgaggttgttaaaaatgtgtcttgaggttgcatttttgcccttgggaagtgacattgtatcgtcacatgtgctttcccatgactccacgtgtctgtcccttgttgttctgttgtcgttggtttgaggagagcagttagagaaagccctgaagcccttggatctattaagtccttcctttcagaagctgggtgcacatggagctcgctgttcggactccgctgctactgcgctcctgacaccaaatggaactgaccagcggctgtcacactgttccttagccactgtgcctatgcttagaagatgctcaccgctcagctgcagactcagacagggtcacagacaggtgtcccaccccatcaagcacggcacccttctttggcccccagccaccgccaagaatgccgaagggcacaaaagtttggggacaaaaacaaaactgaagggccaaagcaccgctcaggtgcggcatggcgttcactttacactgcagtcaacatcagagcctaagctggaactcgcctgtctcacctgagaacctgtggcctcaaccagccgccatgctggtgtggctcaagtcacctctcagcctctttggaagcacagcctcttcgagccaagggttggagaagcctgccttgatgggagactcatctctccaaaccagggagaagggcttctccctggagcctgggggtctcttcccacccgttcccagtttggtgtttaatctgtgttacatcgaccctctgaagaacgaacagagcccttttgtgttggcaccaatgccttagtcctctgtgggttgggcctcagccagaattctgctgggagttgctggcgttgacaagatttaaagtcaggggtcaaacttttaaaaatat

SEQ ID NO: 35470 - DNA, 1175 bp, Mus musculus
ttctgagggctctgaaatctgcaccttatctgaccaagctccaataatgccaatttttatttcctttttttttttttgaaaacaaatccgctttatgtacataattgaaaaaaatctatatttttaatcagttacgtgtaaatgaagcaatagaactctaacaaggccaagaaaggagacgaatgttcgaggtttattttcttaaggtaaatacgggtattgcttttaattgtaagtttattaaaatgcgggcttgagaacgtatcagccatttctctgtgccatatccttcccacgttaccaaaacactccatctctttagccaaaagaaacccctgacctctcaagtcccgtggtcctctcagctccgggttaggacccctctcttagacaagcgctttcgatgcgagggtctaggacagggtggcttgggttggtggactccagcctacacctttagcttgacctcaagtggggcttcctgacccctgacccctgacccctgaggatgttaatgttcttgtcttccatttgttctggaatcctccatgtcggtctgtggtcccctgcactagctgtttgtaaacaatacgtttgtatcttaatcacaccacctgtcaccgatggcagtgggtgaagatcctgctgacacggtgcgatgttgtgaggtgactttggggacatgaggacgtccacatgacactaaatcatcccggtcacagcatgtgaagttgggggtacggagatgaatcctaaaagtgtgtagagcctggcagcattttacaaccctgtatttcaaagacggctttctaataaaatccagaaacacacagccctattggtcaaacactcgtgacgtttgtgcctctgctcctcacggtgctgtgctggacagctggcatgccagggtttgagaagagcggatggcctaccgtgctcgcggttccctgggcaaacttgctggctgcctctgttcctattttactgtaaatctgaccatgtctatccctggagtcgccctgaggataggttccccccaggggtggtgatgttggtgtctggggagttacagttttctgctggatgtttgaatgtgccgtcccagtgccacttgggaaataccacatgttgggatgtgcacgatgctcggggcaagtattgtcaatcagtgattt

SEQ ID NO: 35471 - DNA, 1385 bp, Mus musculus
gatccgcctggggctggctcttaacttttctgtattttactatgagatccttaataatccagagcttgcctgcacactggctaaaacggcttttgatgaggccatcacagagcttgatacactgaacgaagactcctacaaagacagcaccctcatcatgcagttgcttagagacaacttaacattatggacatcagacagtgcagggagaagaatgtgatgcagcagagggggccgaaaactaaaggcatccagggcaccaacctccttcccctcaagaaaacctttttacatctccattccttattccacttggatttcctctagcaaggaagcccattcgtgtgtatgggatcaactgtttatatagtcttttcacactgcagctttgggaaaactccatcccttggtttgtgttatctccgccttcctggtgtgcagttactgctgtagaaaagtatcaatagcttcatttcatgtaaacacgagtaacttccagacacttgtgtagaggagtgacagcacacttggtatttaagtaatctgaaccggttctacaagtgactgtgttttgtattactgcgaagatatggaaaatgtagtgcattacaatttaaagtaattgtaataataacgtcttgatttctacattccttttctgaaccttcttgggggtttcctttcagaagcaacttttccatgcacttattacaaattcctttttagtaggaatccagaagtgttagattgaatgagaaagcgcttaatgcatctgggcttggggtcacagatcgaaatgtctcctgtgtcacatattctggaggttacatctgtctgtgacaacagggagtttccttatgcattcttcatttgctgctgtttaagttgacaacttccttcccaataaaaattcacttacacctcaaaaaaaaaaaaaaaaaaaaaagagagacattcatacagaagagtgcaacctcacactcagaaatccgcctgcctctgcctcccgagtgctgggattaaaggtgtgcgccaccacgcccggctcagaatgttctttaaacagacttttcatagttttttcacccagtctaaagccccagaatcttctagggccctagggcccattaagaaagccattctgctaggatcagttaaaaccagtaatacctttattttatccctgaaaaccccttggaattttttacttagtgttttatccccttgaagttttcatttaattttttcacacaatatactttgatcatattcattccctcccccggctcctttcagaccctccctacctacccagcttcctgttctttaattacctggagtctcccctgtcacatggaagaacaggctacttgtcagtctaagcg

SEQ ID NO: 35472 - DNA, 3185 bp, Mus musculus
tgccatttgaaaaagattctcacttatggaatagtagaacaaaaacagatcacaggctatactcagttgcctcctaatcacaggcttttggtgtcttaacataagtcatacctttttactccactgttgctttaggggagtcaagacaatttaaagagttcatttaacagtgactcaggacttatttattcagcctattgatcagtgatagctttgctttgggaaatgactggccctttcttcccattctgattgtccatcgaagattcttaactttcacattaacttcaacattttaggattttatgaaaatgtatttgtgtagctactcactaattttctttgtatgattgcagtggcagccaatctgcagaagattgtggaagaacctcagtcaaaccgatctgtcactttcaaactggtactcacccttcctctctagacagctgttccatcccctaactgccaaggctagagagtatgctgagtcagtggggcagtggtggtgcacgcttttaatcccagcatttgggaagcagaggcaggtggctgagtttgaggacagccgaggctacacagagaaaaaccctgtcctgaaaaaccaaaaacggctctgccgagttgtgttcgttcattttgcccaagccctgactgcactcttagtctgcatggcctcacttctctccttcctagaagctacaacccaggcctctaactcttccaaggaagttataaagctatttgacatagttatacaaacagccccagcatttctagaagaaacacagtggcctctttatatctcagggacctttcacctaccgccttcctttctgcagccccttatccgtttttattgctacccgaacttttgtttataaattgccacaccttgtcattttgtttggttcgtaggcatctggtgttgaaggctcggatattcctgatgatggcaaactgataggatttgcccagctcagcatcagctaaaccacagacctggaagagtcagcctaggagatgccacacatgcacatgtctgttgcttctgttggcctgaacctacaactgccaaagaacccagcaacaaacctcccagcttggagctttagtttttttctttgtttttcttgctgccctcctccctgccccccttttcttacaaggaaagaaaagttggatcgtcagtggccagcctcccctcagagagttccgttggtagatacgctgctcatgtcccctctccctccatctgagaagcagaagcggccagtgtgcctcaaggcccaggatggaagactctcaactcattcttgccttactacagtgatggtcccagtggatagagcagctgcactgggcaacctcatcttgcctgctctcccgcacctgctgggacatgagcatcttgggatatctctttaacactcaagtagcaattaaagttgattgttcagctggagcccagagaatttaattactgtttttttctttgtacctgatgtgaattctagcaacctttgttaggaaaaagcacagcctcgaatggaggcagcctaaactcttgtctgtcctcttcatggtgtctcttccgtgttttgctgagctgttctcaggcaccccctcactgctccctcttgaaagggttgctagccttaacttcagctggtgcgaaacatctgactgttgtcagactccagccatctgctcctgcagcgtgcagctttggattgtttgtgcagaaaacagcaagcgatggctgataaatcttatcttgccagaggtagtttttgaacaagaaaaagaactttgtaaatcatatcattgggaaagtattttcaatatttaaaaaaattaagctgaagaaaaactgatctttgatcctcctgtgaagatggacttgcctggccttagtcatgtggaaatggtgtacccggctgagatttttacagcaataaaggggactctcactaggctagaggccgccttctgctcctctcttgcactgactctgtggagggggtcttcattcactaaactgacccaggatggaacacgaaaccacacgtgccgtgacctttaggtttatgagtagacagtgttaatttgattttctacaggaattatgtaacttattctttaggtttaaaaagaatgctcaaaggctatacagagaagccctgtatcaaaaaccaaaccaaacaaacgaacaagatcaatgcaatatgggaataatcagtgaggttggcttttttccctactgttaaatagcatttgtctaattgctaataagcctgtcgttaccaaattttatataagaatggaatagtcagtctggccttaaagagacacacaaagatgggctgtgagcccctagaaagggactagttagttgcctttgatagaattccttgcacctgccattgttggtttgatgaacacgattaggtacccagtgtgatcccaccctcaccccacctcacccagagcaaaccgtaggactgctcctagaagcagctctgttgacttctcttggaacacacctgaacgctttcctcatttctaacctgtgccacctcttgtttcgttcatgctgagcctgtagtttcagtcatggacttttgtactgttgagtgcaaaggcatgttgggaaaggtgttggggaggaagagaagatggatttgagaggggagttgggagactagagagttcaaggtcccagcaggttggtaaaaggaggagcctaccaagttaggagggagaaaaaagattaaccagctagttagaaaaccatttatttttctttcttctttccccacttgttagaggtagggctatgaggaagcaaggatgggaggtggggttgaggtttgggaagcaggcagcaagcgttacctttgcagaagactcgtgtcttgctgtagaatccagtttggtttcagcagcttgacttaatgcacttacaggctcaggaaggaatttgctatcactgttgtggcttttgacttggggtggtccagtgccaggctggaagtaagcacagcccatctcctgttcacattctctagaccgtcatcacctttgccctgctctgggggacagacatgacagtaaaagtgtcccgggactctttccgttcattgtttgcttttttggcaactaggaggttggcactaagacccagg

SEQ ID NO: 35473 - DNA, 1173 bp, Mus musculus
tccaccgtgtggtccttgggtttgaactcacgctgtcaggtttggtggcagtggaaccttttcctactgagccacgctgacgcccctgaggttctgaagcttgtgctctgcagcttcctcgggtgtttcccctcgtccgtcgtccactgtgggacacagcaggctcagccgtcattgtttaactgtggggtgctttatgtgtgtatttatttacatatgtgtttgtttgcagggagtggagcaactgccgtggtccaagcagcttactgtgcccccaaaaaggagagagtggcgatcaagcggataaacctggagaagtgtcagaccagcatggatgagctcctggtacgcgcagctcaggctccctccacggagggaggagtgtgttcttagagttcatgttaaaaaaagaggtgtttagtttcttttgagaacgtgacttattttcattaataaatgattataaaatttataaagttaaagtaagttgaaaaaattacttacaattttattactctgaggttaacatttaatacatacatttttttagactgaatattttaatttcttagcatttttgagattttgctctttttgtgtattcgctctgtccagggactggcttgtaccactgtctgtttgctcgggtaggtttggtaactatgtgtgtactatgcactgaagaatgtacatagtttagagcatatgtcctggtattgtatgattgatgtttgttcttatttatatacatggtggctactttcgttctcatttctttaagtaatacgtgggtttttgattcctgggttaagaatcttttaaaagatactgtccttcgagaaacagagtatcaatgtgtcttctgtatcctgatggaagatgaggagagagagagaacactgatcctttacctctacttattttaaaagcttgttttttttttttttttgttttgagacaaggtctcactacgtacctcaggttactctgcaacccttagattcagaccatagatcaggcaggccttagactctcagtctcacagagatccagcagcttctgccacctgagtgctgagattaaaggcatgtgccaccttgttggtttaaagtttttttagcgtttactttgggaggaggggtactcatgcgcacatgtccatgtttgtgggtc

SEQ ID NO: 35474 - DNA, 1102 bp, Mus musculus
cctgcagaactcagggcggtgtccatgtacacaaggacaggctgacggtcacctctccggtcctgatgtgggtccaggtaagcatagggaggctcccttccctcctcagtatgcagcctgtggcactgctggccccgcaatggcagctcttgggggcatccaatgagactgtttaattctggggttaaaataagccagcattcattgtttgtttgtttactttgaaacagggtttcctatgtaatcctggccatcctggaactcactctgaccaggctggctttgaactaagagatccacgtgcttctttctccgcagtgctgaggttaaaggcgtgcatcaccacacctgactggctgtttgtttatttatttatttatttttgtttgtttgtttgtttaaagatgaggtctcatagctcagggtggtctcgaactcattatgtggccaaggatgaccttgaacttctgaccccgcctttacttcctgagtgttaggactatagtatgtagctggatgaccttgaacttctgaccccgcctttacctcatgagtgttaggactatagtatgtagctttatgcccagtgtatgtggccctgggacttcctgcatgctagccaaacattctaccaactgctgtgtcctgagcctgtgctccctttaaaaagacacagagccaggctttcctagaccctgtcatcaggccaagcatggcctcagggttttagtgtcttagtatttgtccccactacagggtcacttagaatgtcgtcttataattaactagtcaggctgaggtcaaccctaagctagacctgcctggtcaggaccaccctcctgtggccatatctggtgacccatacaaggatccatctaacacgaacatgatatgtctgagcttgcctcatgctgatggcaccaaaatccttcagcttagaagccaaccaaaggccccacttagtgtgtctgccaaaagcctttctccatcctccagtacccattgaaccatctcctatattattatttctttttaaaaaaaaatagactactgtgagttctgttttatctacctgatcatgagtcagacaccgggagaacag

SEQ ID NO: 35475 - DNA, 1275 bp, Mus musculus
ggtgctgaagcgtgctcaactttgtaggagctccggggcgggcttagggcagttccaggaaacgtggacagtcgggcattaagactccagagaaaagatcgtggagattaggacggctggtgcccggtggctggggctctgggtcctgcgcgtctttgttcccaacccccattacacatgcagctcgggtcccctgcggcccgaggtggcagcagcgcggagtctgggaaacccgcgaggggcggggcccggagtgtagggaagggctgggatcccccttgcagctgcgggggtgggtatcccagatggtcattgcaccccctcacagggatcctcactttcaatcttttctattacaaggtagtgagggttagctgttaattccgaccccgagagtttttgcacgagcctgggtgcggtggagcatgagtgtacgaaccagagggcagagataacttctttgctacccgagcccactgttgggaagcggtttcagtgctgtcctggagtggtagaggcaacgcggtgctcagggtgaacattttgtttctttctgccactccccgaagtgttgctccagagatttttcaccccaagaatgagagcctggaagtgatggaaaacagtggtctgctccggggagggcggcagcaggctgaccccaagttataggaccaacctctagtcggctcttgacttactggatttctgcacctggacatgtatgtgccttgcctcttttaagtttaggtttgttgaaagcattgtctcaggaccgttcgcctcagactagaagtctgtatgtacatcactgctcctgtttgttccagtttgacctcaccagtcacttcccatttggaggggcagagtgagagtggatccctggtaccacatttgctgcactgtttgggggagtgcataacggaacacagaggcacgtgttctgactcaacctgtggttctgcctttggggatagagtcacctgtgttgtggtggctgctgctttctcttttgaggaactggaggaaaactttgaagggttggggtagagctggccttcctgtgcctctggcttcagagatctttccttcatgtttctggcttgatattcggaattactcagctctgtggtaaaaaggagagatctgtatattggtgctgccagcgggaacatgggctcgacagatatattcaacttaaaaattcccaacagccctgttagtaaaagaaagaaatagctgtgtctttagtgttttctgactgctttcataccg

SEQ ID NO: 35476 - DNA, 2073 bp, Mus musculus
gtgtattatttcccgtcctatatctaaaaggttcatggggtcatagtggggcaaaaaaggggcacgcgcaggggtaggggtggagtaagtgggcaaaggtgtgatgagtgtttggtgtgttcaaccatctgcaatcgtagcttagccctcctgtctgagaaaagtgacccttggtgaccctgggagcttacccttttcctgtaagcgtagctgttcttcagtacctggtgaacacaggtgagaaagagcgcaggaaggtcccaggaaggtcccgcttccaggttggtgtgggcagggaatggaggaacactagcctggtcttcgtaaaaggtgttgatgtgtgggtggtaagggggccagtatcgagagcagaggggtgggttggcatcttcaccaagcaccttcagcaggcgtcgtctccaggactggttacaagtcacctcaccgtgctcagcctctcttctctcgggcgcaggttccgggcgaggggaggctgagactcgggagtgcatctactacaacgccaactgggagctggagcgcaccaaccagagcggcctggagcgctgcgagggggaacaggacaagcggctgcactgctacgcctcgtggcgcaacagctcgggcaccatcgagctggtgaagaagggctgctggctagatgacttcaattgctacgacaggtacacaggggagcgggagcgttcccgctgccgtagcccgctgcacttggccacccactgatctcagggtctcttcggaggcactacccagaatcccaagcccctgttctggtgtttgctctcctcagctcaggcagcatttccatgcctgcctgcccctctcagccttgagtcacactcttcaagggacgtggggtcaccctaactgctgatgtttctgaagctgcgctgcctggggggaggggccggggagagtctttccgtccctgccggggagtttgtaacggggaccctgggccctcaggcaggagtgtgtggccaccgaggagaacccccaggtgtacttctgctgctgcgaaggcaacttctgcaacgagcgcttcacccacttgccggagcctgggggcccagaaggtgaggggcctgtgggaagagggtctgagtgtggcactgtggagccagtggggagtgcttgcagggccggctggagtgttagagtgggcgggctgtgtgacacagggctccatgtgtcccccagtcacgtacgagccacccccgacagcccccaccctgctcacggtgctggcctactcgctgctgcccattggaggcctctctctcatcgtcctgctggccttctggatgtatcgtcatcggaagcctccctacggccatgtggacatccatgaggtgagacagtgccagcgttgggcagggagaagggacggctgtgcggactcctttaagcccttgcctttccaggacccggggcctccgcccccatcccctctggtgggcctgaagccactacagctgctggagatcaaggctcggggccgctttggctgcgtttggaaagctcagctcatgaacgactttgtggctgtgaagatcttcccacttcaggtgagcttttgggggtctccaggccatcttctctcactgtggtccaagcgggagtgtctttccatggggcagtcgactgtccaggattctgattcagtactgagagtccatcagaggattagggtcagacgccatgttggttttgggttctgccattacttccgtgttgtgtatgcagtttgcatgttttgtgtacgcacaggtctgtgtgtggaggccagagaatgaatccctttattggactcctttttatttttttggagacaggatttcagtatgtaatccagactggcctagaacttgtcatatagaccaggctggccttgaaccaaaagtctacctgcctccacctcccagatgctagaattaaaggtgtgcaccaccaaacctggctctctactttttacagttctttatttttattcctttttaatgaaaaaaaaaattttttttttttttctgttttttcgagacagccctgtgt

SEQ ID NO: 35477 - DNA, 2602 bp, Mus musculus
acatccacagggaagggcggatccctttctcatcactgggctaccaggcctgctgggccttcctgaccaggcttgagcttctagcaaggtgcgtgatcctgtctgttctggtctctcttcatccctggcattgaccatgcccttgactctctgtcttgctactctaccctactctgccctagggcttaggctctgtgaaggatttttcttggtggccagcctacataggtatttaatggttgccatgtgctcttcggctcagagagcctgtcatgtggcatttcctatgctcggccactgaggcaaagaagtgactgtcccatctagagctggagggccggatggttctctcacacacagactttggttctctcacacacagacttttacctttgtagtgtatgaagttcctggtgcatcctggtggctaggagaatgtcctcgttgtttttcctacttaactaatgcagtaaaagcttactgtgctgtgagttgaattcctgccgttgttcttaggacatggttcattagatgaatccctgaatctgaggagctctcaggtcgctcagcttggtctctggcatcagctgttgcatctttttgggcttttggagacacagctttggacgtgatcaagcctggtccacatctcaggcaggacttgtagaggacagctttcctaaaagtgtgggaaaccgccaggaagggatggtgtcccaggaatcctttcctctcagaacctggagacatggctttttcttcatccctggctgtctgtaaaggctaaattgagaagtgctcagcagctggcttgtccagcgcagtgatgaggttaaacctcagctaacatcatgttatataagtaggcccagtaactcagctgatgggtttcttagaatctagatgctaaacgctccatgcattcaagattaaatgcctagttcttcttcacacacagttctgggtagttgactcgtagccagcagccctcctgtggatgtaccccagacctttagaaagatgttgaggaaagtgctttttgcgataccaatttagttttataggaaaaagaaactgaaggtcaaaacactcccttggaaatcaactagttggttcaaccacgttaaagaagaaaggaagaaggaaagagagtttaagaggcgcgtgaactatcgtatcaataagtatgcccaagttcttttgtgggatccttgggatagtgctatttggacctatctgtgattaatgactgtgaaccactgttgggctgaccgtttgcagtgagatcaggaatgcctgcgtctgctggcactaaaccaagctgtagcattttcatgctggcatcttccaggtgtgaaggaagcaagactttgccctcctggtgctccgtggagctccttagtgcccagaccagcgccatttcccccatccacggcagctccgggccatgatttccccaagaattaaagttcctgttcctcatgccggtgaggggtagtgggctctgcgctgaccccttgctctccaggccggtgtctacactgcttaggctgagttagtgtgtgcagccctatgggtgcgtgtggtaatcgattcagacgggtgttctgaacacctgcagagaacagttactgcattcggttgtagactttgtgcttttgagtttacagttgggggaagtgtgacccattagttttttcaggcacgtgaaggtgggttattgtgaataaacgagcattgcctcaagtcctggggcacccaccctgcatgggcccattctggctcctggtcactttacaccagtgttgttagatagtgctgtaaataagagtaagttatataacagacgccacttgaaattttactttaagaagtctatagctccacacatatatttagttatatctcttgacagattgcctccacacagtatggagattgttttataccacagattatttttataaactagtgagtcgaagtgagaatgcgtctgtaatccaagccaatgagctttactgtcaggattatgtgcaccctggagccgagtgctgggagcttagcttagtgcatgcatagcttcctgaatacactggcagcctggagttggcttacgggttcccctttggcagtggtatctgtcctgcttcctgcctgtgagaggacagcagccaggccaggcaagggacctggagttggtttgatttctgctgaacaaagggttctgaggttgaaagtttgtcagctccttccgtagaaagtagtcccgcaagttaaagagcaggaggacagaagctgtgtgccccacgcctagagaatgattcgggctataggaaccattgaaatggggattggtggccgagttccactaaccagaactatctaggaccaaactgagtcatcctttggaaacggcggggcacatggatgtcatggtggaaataagtggagagttgctgagcaaattttgcccctttcagtcggggccattcatcccagaggctgcttgctttctgctctaactgtcgagttaatcaggaaccaatggaggaagctcagaaccccagtctcctggcaggttatctttccagttcttgcagag

SEQ ID NO: 35478 - DNA, 2078 bp, Mus musculus
ccagggccagcgtgttcccggtgggtttcaactcagccctctgggtgtttggtctctgcctcacttagcggacttagtccttagtccttgtaagtgctttagccccagtggggttttcccagagcactgccacgagttgagtgtatgagtttagccaaataatttctccactgggaaaagcactatcacggaaattgtacctgcttcaaaagagaccagagtaggaaagactagttgcctaggccgtctgggagcaagcagttgtcacgtgcgggcaggagatctcatctgaaaagctaggtccaccagcaggggtgcagttgttaaaatgccagtggcttgctttcccatgtccccccacctaccccctgaattctgtaactgcaaaggaaactgagtggtactggagaaccgcagggagggtaccacagatgagagacaacgcttctagacttcagttcatgccacggatgcacacgatgccgtttcaactgtacgggagaatctgcttacgaacctgacgtcatccctgtgatggcgtcagaggccacagttttcacacgttaccatctctgcacatttgtcctcgaatctgagtcgcattattcagtactgtaaagttaacttgcgtcgagtttgatgtcgattcctgtgaagaagagcttttggcacgtgacagacagtgagttacaaaacacagcaaagcacggaattttttgcagggacaattttggaaccaacagaaaatgtcactttttagttagcatcttatgtatcacttttaccggctatttctaactttggaagggaaaccttgaagcttgtgtaacttagtggaaatgtgtgtgtcgcccttaggatgggtagccaagtctcactaagctgtgttaatctaacttgtatatatgaattgtaattaagagtttggattcacctgtttctcacggtttaaaagtgatgggtcattgcgaagtctggagatgtgactagtctatgatttcaagctgttagaagtcaggaagctctctgaaatgctaaaactaagattctagttttgggctcaaattcgattaagtactgtttgtatgccagagtatgtgaggtgtaaatgtagtggggtacttttcacccttgtagctgtaaaattcacattttgtagaacagaaaatagcttgtactactgaattaacaagttatactaaagtatcatgtcttaaaaacaaaaacaaaaatacatatatctatctatatatatacacacacacacagagttaagcttgttgctgttaccctgtctggatttgaaaattgtgctgatttatataacacacacacacatacacacacacacacacacacacacccctataatggcctgaagcagacatacctgtaactacagttgcaaactgcagacattttggagagaacactgtaccatagctcattcattgcgtggctctttgctcctttttcctgtggtcattttagaaacgagtgtcaagtttgaaattagatctgctaagttggggttctgctgctgaattctgcactgggtccccaaacaaaccgatgtgaatgtagtttttccccctgtgtgaaggagcagccacagccccatcagaataggaggaaaagtctagaagtatctcaaggtttatctttttgtatatgaaaataaataataataaataaaataacctcgtctgtattttttttttaatttgtgattatttctgcatgtgtgtatctatgccatctatgtgtggatgcccagaaaggccaaaactgctcagagaggccaaaacttgtgatcagatcctctggagctggagttacaggtagtggagagccgacatgtgggtgctgggaattgaacttgggtcctctggaagagtagcaagtgtccttaaccactgagccatctctctagagccctggctgacctggaaactcactttgttgaccaggctagcctcgaactcagaaaaccgcctgcctctgcctcccgagtgcagggattaaaggtgtgcgccaccatgcccagtgcacagggtgtaccccatcgtgacagggaa

SEQ ID NO: 35479 - DNA, 1146 bp, Mus musculus
gctccatctgccctgcgctgctctgctctgggggctttaaggaaagcttgctctagaaccctgtcacccatggacgttctgtgtgctgcagccatgcatgccattgaggaggatgtgctgggataaagcattcgtgggcaccagccatctcacagtcttacttgtaagggtctacagatcttgtcctgttgtctgtcagccagggagaggcacagcaggattggtgggggcggcagcttcttcccatgttcctctattttctgactgactgtcctgcctcagtgggatattgggtatatgccagtacacactgttgaaaggttggtgagatggaatagacaaaaaaaagggctgagaggaggcttgcagactgagatgtctgggtcattaacagcaagcagacctgcttgtcttgagctgggctgtcagtaatgctattcttctcacagtgcttcagtcctcctgaagtaagataacattagcttgaagttagtttagtattggaattggcactagaaggctacacctcaccatggcttggcttctgttggtgcccattaggtttcttatgtaattcgagatgaagtggagaaatacaatcggaatggagtcaatgccctgcaactggacccagcactcaacagactcttcacagcaggtcgagactccatcataagaatatggagtgtcaatcagcacaaggtaagtaaggcaggagccgtgtgtttgggttaactcgcctcttggaccagtggctctgtctgatggaactcctttcctcagtcccggctttaatctctgagcactgggcttcttaatatattctataaagacatcaccagagttctgtaagcctgtgagagaacgcctccaggaaagtttcacaagtatttttacttaactcagggctgccataattagtttgctgtaagagtttgctgccacagcggagtaaaagtattcagctggtgaggaatgagcactttccgtgggattttggcttaattatgaacccgaaaagtctcttgataatggtgctgagagtagaaaaacacatgttgagtgtgtacttttacaaaagtgactaaggacctcacagcacactaggggcttactggctaatgtggtagatgtgaagctgccggg

SEQ ID NO: 35480 - DNA, 1158 bp, Mus musculus
acaacagaaagcattgaattgggtactaatcaggagattagtccatgaccatcatggtggggaatgtagtggcagacaggtatggcgctggggcagtagctcagagctcacagctggtccagaagttgcaggcaggcagagtgtgggcctggcataagcttttaaagtcacaaggtgcccctcagtgacacttttgttcctacaaaatgacacctcttaatctttcaaaaattcaaatatatgagcctgtgagagccattctcattcagagtaccacagagccttgtgggtttgctctttgtttgtttggggatagttgtaagtttttctttttaagaaagctcaacattctctccttaagacttgttggggatttcttgctggttgactcagtggcttcctgctgtgattgggtatgtctcatgtacctgtgataactcaacatttactagttctacagctataacattctcaactcttgacaagcctggagaacataaaatgctgaaattattaattttgttcctttagacactgaagggaattcataattttcgagcctctggtgattatgacaatgattgtacaaaccccataacgcccctctgcacacagcccgaccaagttattaaaggtaagaaggccccaggcaagcagactttaatgaggttacagttaatgagcatgatgactttcaaagtggcggcctttctttaaatgcagtgctgctatagacaaaagcccagtaacctgtgcttgcttttagcacaagaaaatgatggtaagagatgagaagggtttttaagaacgtgtttgatgtattctttgactgcttctgccatgtgtatcgcgcgtcgtcatcatcatacctattcccaggtcatctcttctggtcccttcacacctcctcagcatgtcccctcctaccttcatgagtgatttttaaataaccgactgggtcccatcagtgctgtccatatgcacaggagtgtggggcccacaggccacctaccagcagtcacaagaaatgagtttttgattgatttttttttttttaattaatggctattggtggtacagatgagggcttgcatggggtgcttcagtacatgcatgtatagcgatgaggtccgttctcccagacctaagggttgcttt

SEQ ID NO: 35481 - DNA, 1198 bp, Mus musculus
cattgggcctgccacctagaggctatctagggaccgtagaaacactgtttgtgggcctgtgagttccttgatgttagggggcccatctgcttctagcatatagaagtagagaggctctgcttgagtaaaacatgcttttggctctattgtcctcgagtggaggtgaggcacaggtagtcatttatgagttggaaactgtgactcagcgatggggagaaccttgtgccgcagtgaggtgggggcagccaggccagtgctagacatggtaggccgcatggtccccatttgcacctggattcaagggaggttcagagaacaggggcattacctgtgggtacctggggatcccctcggggagcggcagaaagcttccccagtatgtgtttgtagggaggatctggctggcctcccatcacggggaggaagggcagtgcttgccgtgcaagggctctagttaggttgaagtgaacatctgtgcaccggaggtttctaggcactggcctaactaaccctcagtttctcccttcctggtacctctaggccctaccacaagtccctggtagctttatggagggacagctccttgggcctgggagtcccagccatggcgctgctgactgtgggggatgcctgcgtgctatggagatcccgcttcagcctccacctccagtgcagcgggtcatggacccaggtatggggcaggtcctgaaagagactgcagtacctagagccctgatgctaaagtgggctacaggctcacagctggacttgcacagcagtgccccagctttcctcaggacctgctagcctctgtcagtccagtccagagtagaggaggcccactctgggtgacttggtagatagaggtaaagcaggatttgggccaactgccatggtattactccatgatgttcagctctgggttctttctgtcccttagacacaggtggtgggagtctcgatggggttggagggaaggcatctgtggggctgagggcgagctaggtagcccaggaatatggcagagggaaggcaggctcccatatctccagtagttggaggttttttgttttgtttttttttttttttgcgagcaaagaactgggtttgctttccctctccaggcttcctggatgtatcaggcatgtccctcctggacagcagcaacataagcgtgtgccccagcctgtcatcttcc

SEQ ID NO: 35482 - DNA, 1157 bp, Mus musculus
gcgatgtgttcctggtacagcttgtgatgggggagctggctgtactttggagacagcagtaagttagtaattgagaggggcagggagcaccgagagcaggggtggggagcaccgagagcaggggtgggtgcagctgagcgcatgtcctgaccctgggatccgctctccttcactgtcagcctgtccctgcctgctcaactggagctaggcagctactcagggtctaggcgcttcagaatctggccacaggctgccttgcccagcccttatagcaaggtctggctgcatttctcctgcgtgtctgggctttcctgcccaatcccagttttggggtgggggtggggtgatatcctttaggtgccccttactccagggctatctgagtcctttctggaagcattcgcgtatcacggttgggaaacttatgtcagggaaggaggtgagtgggggggtgggtgagcagagcagtctgcggaggtgagaccttcccactggtccagggtgggggctgggctccttgggccgtgacgcacctctgctctggaacaggtacaagagaactcgccggcccagcaggcaggcctggagccctacttcgacttcatcatcaccatcgggcactcgaggctggtgaggctccccactgccccgtccccacaggctgctcctgttcgcttctgcctccttttttcttcccctgtgaccagggccacagagggacatttggaggcatccagcaggcctaagaaggctgcctttcaagacatatgaggccttaggatgtggccctaagaggccttttgcttgctttgttagttttctggaaggcttggggaccaaagcttggggtgcctgaactgggtgatgctggctcaggtgctgcctggagctgggtggtggctgtggtggctgcaggcccaaacctagcctgtgaagccgggcccagcaatcgtttcagtttgccctcacaccctgtgctccatgcctctcagtccctgaccagtctaagggttctggcccaggggtgggaggtctcagacagagccagctcctccctgaccctgcagaacaaggagaacgacacgctgaaggcattgctgaaggccaatgtggagaagccggtgaagctggaggtattcaacatgaagaccatgaag

SEQ ID NO: 35483 - DNA, 1208 bp, Mus musculus
tatagtctgggacctcactatacttcccgaagggtgtcgggcagcccggatagccttgagaccttccacccattgcccagcttctctccaccacgggatgcgagcacttgcttcctggagtctctcgtgggcctgtctgagccggttacagaagtcctggcaccccttctggagagccagtttgaggatgctgccttggcacctttgttggagcctgtgccagtgtaaggattaaggtgccttcttcctgccctgagaccctgttgctgctctttgtgatcttggggttccccgaggtctatgtatgtaacggtctcctacgggctggtcctgctcatggtgccatgtgggcaccctctatttttacattaacactctgaatttatttatttttttatgtttttctgtactgaagaagggagggtggggagggtacccctctttcaatgcctggtctctttatgtccaaacagaggtcttccacctcctactgtatgcctgaaggaggaaggggcggggctctcctggagcctcgcagtccctctttctgtactgtaagatgctccttgctccaaagacagcgacggctgagcgcagggccttaggggcttctgtgaaccataggagctaggtcttctggactgtgaagatgtaatttatatctgtaatttatttggggatggagacggcagtggtggagcctctctggcgggtgggcaggcagtgttggggccgaggcttcggtgtaccctgccagtctgggcttcggtgtggtgtgtgggttcgagtttatggctgctctattaaacagcggcctggctcaactgagcagacagaggctgtgcttgaccagcggtgaccaaaaccccttctgcccccttcccagaaactctacttgccctctttccaattccctctccccaaggccatggattataaagcccctctgtaagatggtgagccaggggccctaagagggcatgaagcacaccctgatcactgtctcaggcctttctgggcactgactcgaccctggcccacctcacgcccccaggccagttggcaactggtggctcttgagagctcttacgcccttcattagctgatgttggattttatatgcatttttttattgtctctaagtgtcagaactataatttattcatttctttgtgtgtgtgtgtgtgccaagaaacgcaggctctggg

SEQ ID NO: 35484 - DNA, 1217 bp, Mus musculus
caaaatggggtttaaacttagagcttttcacatgctgagaaagtgccctaccattgagctacatgcttcttcagctagccctgtagactatttcctgagcagactcagccacccggcagcttctgtgtaccaaagctgtgtgttgaggatctcagaccccagattaccacagataaagggcaggctgactcccccacccccactctgcttgtcctctgtacacatgtacatccaggactgaagactgaagaaagggcccgtcatcctccccaccctcggtgccatttaggcaggacagaaggtcacctccctactacacccgggggaggggagaatggaatcctgagggttggactagccactgacagcattcatctaggacagtcagaagaacccagaatgcagcgggagcggggctgggagggggagggtcgagcttccacgaaggcttccaggaggaggaggcagtccttgctgagccatcctagacgttgttgggattccctcaggtgagcagagtgagggtgaaacgttccaggcggtgcagtcagaacgggagagaaaagcgctctaggtactgggtcgaactggccctgccgtgggctgacgaggactcgggtgggctcctgagagagaagttgactgctagaacacactttcttctgcctagtagtacagggagttggctgcgagcctaaggaaggtcttggcgggagcagaggaggcagcaatccgctgtaagtagccagggtccggcctaggagaaaccagattctttttttttttttttttaaggagggatgggggtggggaagctggttccagcaatctctactttaggtattgttcggagtaagggctctggcccgagggcagaggtgaaggccaggccctaggatgaccttttcttctctcctcatccctggctggtctccagtctgagctaactttctgcgggatctgggaaaaagaggtggggtgagggccggggaagggtcctcagattgaattgataataatctgccctgggcgggtggaggcaggggaggagcttccatcgctcgcagcctcagtctacccagtctgcagctcgggactgctcggcgtggagaagcgggcatctctaggacccggctctgcacgaagctcggctccgcgatcttaggagccgagcgcggagcagcggcgtcgcggcccggtcacagtccgcggggagg

SEQ ID NO: 35485 - DNA, 1548 bp, Mus musculus
gaactgagcctgtgtgttctcataagtgaatgttaagagatttgttagtgtttgggggaagggggtcattttgtgtgtgcccagtgtattcctgtacctcgggcaatgagctgccatttgggtgtgtggaatctaagacttgggctggtgacatgagtcgggctggcttgtgtttaataactatcctccttacagggagctcactcagtgggtctgatgtggtggatgctggccagggaagtactccgcatgcgaggtactatctcccgtgagcacccctgggaggtcatgcctgatctttacttctacagagacccagaggaggtaaggctttctctagtatatgctggggccacaagggatgggcagaccttggttctggttcagtgaagctaattttgtcccttctgtgcttttaaaaaactagattgagaaggaggagcaggctgctgctgagaaggctgtgaccaaggaggaattccagggtgaatggaccgcaccagctcctgagttcactgctgctcagcctgaggtggccgactggtctgagggtgtgcaggttccctctgtgcccatccagcagttccccacgggtgcgtatcaaggccagggcatcaggctgccagggagcttttacagtgtggggttgtgagagattggcgaagcttcagtggccatgagtgactctgggtgacttcagtggctcctgacactggatgggcgggcgggtggatacactgtgtcttgacactgctcttggggtaatttggggaaagttatactcctttcctagagctgatgattttttttttgtactttcttaacagaagactggagtgcacagccagccactgaggattggtcagcagctcccacagcgcaggccactgagtgggttggagccaccactgagtggtcctgagctgctgtgcaggtgcctgagcaaagggaaaaaagatggaaggaaaataaagttgctaaaagctgtcttatggtcctcactgcagactgtacctggattggcatttggctatacaacagaggcatggtcctactgacatgttttgtgttgaatacttaagcatgtgaacacatgggttttttttttttttaatgtaaaatgtagtaacacaatgtttaggtggctttggtgttagctctggagacttcatgtgtcatctaggtgaggtgttctttaacacagggtctctgttctgtcatgcctcatagatccttctacctccagattggagagggaaaaggcttatgtcactgaacctggccagattgggattttgtgtcccaggaacaaagttaatgctaaaaagttaatgccttggtgagactgatagtctgatggtgtgaattcacagtaagtggttgggattgccagatggaattccctgagctgccgtgacaggtggcattgcagaagtgaaggattcaggaatttgagtgttgggtgggggcctgtgaatagcacttgggctgggaggggagactgctgcccctgaatgtcctggaattcaaggacagtacctggttaaa

SEQ ID NO: 35486 - DNA, 1142 bp, Mus musculus
aatgtactggttttatcaatacagaaaacagtgctttgctgtatctattgaggaaccatggtctttgttcattattgttcatttttcatgcgtgatggtttatatcagctgtcaacccaacaggacctagagtcacccaggaaaggaacccttgggtatgtctgtctgaaggcatgcctgtgaggcagtttcttggttgtgctaactgagataggaagatccatcctaaatgtgcttagtaccagtttctggtctgagttcagtgacttgaataaaaaggagaaagtgagctgagcaccaccatcatcgctcagtgttcattgctcagtcttcatcacgcttcactctggctgtggatacaatgtaacgagctgttgcaagcccctgcagccattcagactctgccatgatagactgtaccttggaactgtgagccaaaataaagccttccttccttagattgcttttgtagagggatttcatcacagtaccaggaaaagcacctcaagcaatgttagccttgcattttagcataactgctagcattttgtcacactgctggtttggcgtgatattggtcaggaaatttgaatctgtaattgtaagggtgttggttttgttgtgttatatcattacactgtctctgtttgcctctagtgtctgatgatgtttgccccctttaaacaagttgggaagtgtcttttctttgttctgttcatggaagacctatgctcactcttccttatgtgccatatcatcagtgaagtcacccagtcctctgctttccttcctggaaacattttgttgttgttgttgttgttgttacagattcagtctctttactagatatttgtcaactcagagttttcatctttcctgaatctgtttcggcaatgtcttcttaggaatttttctatcttatctagttcatctaatttgttgctttttaatttttcattgcattttttttcttaatcccttttgtttctctaaggtctactgatgtctctttttttatacattaatgatttggatattcctttccatggttggtgtcactaaaggtgtgactattttggttatcttttcagagaatgcgctttagtttttgaggacgtttctctactttttgtattagctgc

SEQ ID NO: 35487 - DNA, 1184 bp, Mus musculus
gagctcgggcgggatggtagcgcgttctctccacgcacacctgactctgctagaggctaggtcgtgacacctgagacaaacaggttaagcttagtagagactgcagcatcggaatcccggggcttggaggaagggagaattcccaggtggcacccacaagggttctgcaaggaactcaggggtctcgggaaccctgggggctggggagggcggcggaggcgcagagcgcggtccccgctggttgcaagtccagacccccgggggcacgtttctcgccgttgcacccggaagcgcctccgcccggcgcctcgggcgggacggaccgcggctgcccgcagtgggctcccgcccgctcctcgctggcccccggctcggcgctccggggcggacgcgcggtgcgtgcggacggtcacgtggcggcggcgcgcggggctaaatacgcggcgccggccattttgtgcgagaagccgcagcgccgcctccctgctcgcgccccaccgccgcctccgcgtcttcctgcgccccgggcttccgccgcttcattgatttccgtttctcgccgctgcagcctcctgacacggtgatccgggcgggccccgcgggaattctatcctctcaccggcctcacactagtgtcgcatgtccactatccagaacctccaatctttcggtaagggccagtggccggccgccgcccgcgtccctctgggctttgtctcggcgcccagaagatggcgacggggggctccccgcgaccctagcccgggggatgcccctctccgggcctcggacacggccttaagtgggcctgcgactccgtagaggcgagggcccgaccggcaggcgcttggggaacttgacactggcaggaagacaagggtctcggggactcacaggacggtcgggggacacgccagggctgcagggggacccgccagaggctggggggactgacagaaaggccgggggcttcagagacccgtaagggagctacagtacttgccagggctgcagagactaggactaggggcttgcagggaacctgacagtgacaagacgctgggagtctctggtgttatctctcttgtggcctcggggctggccagggctttgcaaggagactggaggggtggggcccagaagctggagaacctgacagctttagggtgactgcgagacctgtg

SEQ ID NO: 35488 - DNA, 1462 bp, Mus musculus
tgcccgccagaagtatgtccgaaaagcttgggagaaggcggatatcaatacgaaatgggcagccacaagatgggccaagaaaattgatgccagagaaagggtaaaggcacaaagctttgagttctggagggcgggatgtgcttgagatgtcaggggagatcagttgagttttgtttttcttttaacagaaagccaagatgacagactttgatcgtttcaaggtcatgaaggcaaagaaaatggtaagtcttcagatgtacatttatattggctgtagggtaatgagggaagagtagccagtccctattttgtggtgttgtgtgtaattgatgtttatagctcttgataggttagggccagcaagattgctcagggtaaaagtagctggcttaatgaccaaatgagtcttggaaataatctctctatagtttatgtgtgtggaagcagtttaatttctaacaatggacataaggcgtattgttgtgtgagtgtagcaagtgctcttctgtgttttttcagaggaacagaataatcaagactgaagtaaagaaacttcaaagagctgctatcctgaaagcttctcccaaaaaagcagctgtggccaaagctgccattgcggcggctgcagctgctgctgctgctaaagctaaagtcccagccaagaaggccacaggaccaggcaagaaggctgcaggccagaaggctcctgctcagaaggctgcaggccagaaggcagcacctcctgctaaaggtcagaagggtcagaagaccccagcccagaaagcacctgctccaaaggcggctggcaagaaagcgtgaggctacacagaataataaaggttctttttgacggtggtaaatctcatgtgtggactctaagcttgtcgccaagtgggaaatagactggtgggattgtagataggatgggctacttaaactcattctacccaggccttagtacttagcatacagccagagtcaaactgatcctttatacagggggtaccatgacagtacaacagtgtcgttaaccctaacaaataaatttcccaccaacgggtggaattccttcattttgatgaaccatagtcgagtataattgttgaaagatacgtggggctgggcttgcctgcctcgcatgtgtgatacatttggcatttcttctctttccacagcatgattttgataattttggattataaaacaggctttgaatatttctaggaaagtggatgattggagagaatcttggtcctcacaaagggtggactcctgaaaagcaggaagtgttatttgtgagaagtgggggtggattacttgcagggttattcccagcacactgggtgcttttgagtcttgttgtccacagtttacacctggacaggtggacactggaataccaggtgggaatgaccctgcatggggggagtcctgtcattgtcaacagcatttgtgggctctg

SEQ ID NO: 35489 - DNA, 1680 bp, Mus musculus
caccgtatgcctacaatctgtttctactgagaagagcttcctgacaccgtggctgctgtgtatttttagtgtatgccatggtgaactggcttttggtgtcggggcacatagcctagtataggtagcagaatcacggtgacctgggttaaaaacaaacttaagttttaatgacttgatggaatttttcagggtacctgaagctcagcgcacagctgctgtgacaccgctgcgtggacaatggctactcaaggtttgtgattcagatgcctgtctgaggatctgcctcatagccctgctgcctggccagactgcctttgttctcttcccttctgcacactaccactggcttggtgaaataatcagcaagccaccgatgggatctaatgagtgctctcaggccacccctgtcccatggagctcatactgaccctcacctgctctccttggctgcctttctaacagtatttcaatgggtcattgtcgtagatggcttcttcaggtagcattttcagttcactaacatactctgtttttacagctgacctgatggagttggacatggccatggagccggacagaaaagctgctgtcagccactggcagcagcagtcttacttggattctggaatccattctggtgccaccaccacagctccttccctgagtggcaagggcaaccctgaggaagaagatgttgacacctcccaagtcctttatgaatgggagcaaggcttttcccagtccttcacgcaagagcaagtagctggtaaagcatttgtgtttggaagctagcattaagtttcttgacagggctgtgtgacagctcagccacagcacaagtgggttgaaggaagggcggagggtagcggagtcccacatgcctagtgagtgttggatttacctttttcagatattgacgggcagtatgcaatgactagggctcagagggtccgagctgccatgttccctgagacgctagatgagggcatgcagatcccatccacgcagtttgacgctgctcatcccactaatgtccagcgcttggctgaaccatcacagatgttgaaacatgcagttgtcaatttgattaactatcaggatgacgcggaacttgccacacgtgcaattcctgagctgacaaaactgctaaacgatgaggaccaggtaagcagtgatgtaacttgcttttcagtttactttgagggaagttctcaaggggatgccaatggctgcctcacactaagttttggaaactaatggtgcctcttcatcctttattctaggtggtagttaataaagctgctgttatggtccatcagctttccaaaaaggaagcttccagacatgccatcatgcgctcccctcagatggtgtctgccattgtacgcaccatgcagaatacaaatgatgtagagacagctcgttgtactgctgggactctgcacaacctttctcaccaccgcgagggcttgctggccatctttaagtctggtggcatcccagcgctggtgaaaatgcttgggtaagagaatggccagggaacttgaagggtaggaagtagaagggtgctggcatggctaacaaaggctctcctcttcccaggtcaccagtggattctgtactgttctacgccatcacgacactgcataatctcctgctccatcaggaaggagctaaaat

SEQ ID NO: 35490 - DNA, 1113 bp, Mus musculus
agccagagttttgttttattttttagtgattttttttcatacattgttgtttcgcctgcatgtatgtctgtatgtctgagggtgttagttccactgggactggatttgcagacagttatgagctgctgctgagacttgaacctgggtctgctggaagagtagccagcactctttaacagctgagccatcgctctagctcgaggtggtgtattcttgagaaaggtggtgtgcctggatttgagcagaattgtagcacaggagtcacatacctgggaccccacttggagactgtggatcagaagggtccagagagatacatttaattgcaagctggctaaagttcttacatgtccggtaactcagtgatgaatggcactgttctctagcctcatgacttacagttccatctctctctagctcatcattctggccagtggtggaccccaagccttagtaaacataatgaggacctacacttatgagaagcttctgtggaccacaagcagagtgctgaaggtgctgtctgtctgctctagcaacaagccggccattgtagaagctggtgagtacacacattctgagatcactcacagtacttgtttgcttgccccatgttacttaaatttttttgtcagagacaacaaaaacaccctgctccataaagcttgtttctgactttgattctggtaaaggtgaggctgggcctcactagcagccctgtgaatctagacaacagcttagtaccagagaagtggtttcgtttggtttgaggtttgttgttaaggtgttctccccagtgatagaagagaaaatacatggtttatgtccaggcttcctttcagtaagcaactaatatctgcctaggcttcagaaccaagtagaagcggaaaatgatgaaggcatcatgtagaggacggtgctgagggtgagacacagggttgtagcaaccaaccatctttgggccgttgggaacacttcaggttactgaggtagttgctaacagaaaccatgggcctgagagagacacatggtggcttgtttaaatgtaaagtttatagattgataaagtccataggtagccgggatagttggaaatggatgtgtgtggatgcc

SEQ ID NO: 35491 - DNA, 1099 bp, Mus musculus
acagaaagtctttgaatcactttctagtagtcctccctagaagtatattttaaaccccacagtcagctagagcccaggtctcagtgtgatgcaccctgagtgcagtcttgggtttcagagagtgagtcatgtgggagcgagtcagtaggcatcgtaacgtgttctgacctgagcccttgccatttccctacccatcgcatctggaagcctgttcccacaactgcctctgtctgggtaatggcggctttgctagtccagctactcatgctcagactgccatttcccactgtactcagtgatggagcatctgtcagtgtttattcctgcacctgtatccttggaacagccattgtctctcatactgtagatattcattcagagagtgagtgcttcaatgctacatgcagtttgaggtgtttgtcttctgtgatcttatgtttataaacactcaggtgtggttttgaaattttatgtccttcttgtacccatttatatagactgcagatcttggactggacattggtgcccagggagaagcccttggatatcgccaggatggtatgtcataaagcccttgtccacgcctggaacctgggttggaagaagtggtggctgcacttaaacatgcagtctgaattccagagtcagcagcagtgtggagcacagggagcttggccatggcctgctgccaatgcatactcctgccagccgtcgcctggcttttcgttggtcacacaacccttcatcataccttttgtcttggagaaggaacagggagggtatgggagtacggtggtctaggatgggtgattcatagctgatctatcagagttttttgggaaattaccaaatttgagctgcataaggtgctgttgctatcatcactctatcccagaggctttatccaaggagctgtgcaacaccttggcttctcatctgatctgtgacaggcagatcagactttcattctcaggaggtcaggcacagtaagctgctgccactgctgcatgctctgccgggatcagaatcaagtgtgaaggcacactgctgctggtgtgtggtagatagtctcaggaactgtgtgaggcctggctttgtg

SEQ ID NO: 35492 - DNA, 1599 bp, Mus musculus
gaaagcagtgttcctggcaagatgtccttaccacagttaatcagtctctcctctttcctttgcccatcttgtggacaccctgactcctacagatcccagctaccgttcttttcactctggtggatacggccaggatgccttggggatggaccctatgatggagcatgagatgggtggccaccaccctggtgctgactatccagttgatgggctgcctgatctgggacacgcccaggacctcatggatgggctgcccccaggtgatagcaatcagctggcctggtttgatactgacctgtaaatcgtcctttaggtaagaaagcttataaaagccagtgtgggtgaatactttactctgcctgcagaactccagaaagacttggtagggtgggaatggttttaggcctgtttgtaaatctgccaccaaacagatacataccttggaaggagatgttcatgtgtggaagtttctcacgttgatgtttttgccacagcttttgcagcgttatactcagatgagtaacatttgctgttttcaacattaatagcagcctttctctctatacagctgtagtgtctgaacgtgcattgtgattggcctgtagagttgctgagagggctcgaggggtgggctggtatctcagaaagtgcctgacacactaaccaagctgagtttcctatgggaacagtcgaagtacgctttttgttctggtcctttttggtcgaggagtaacaatacaaatggatttggggagtgactcacgcagtgaagaatgcacacgaatggatcacaagatggcgttatcaaaccctagccttgcttgttctttgttttaatatctgtagtggtgctgactttgcttgcttttattttttgcagtaactgttagtttttaagtagtgttatgttctagtgaacctgctacagcaatttctgatttctaagaaccgagtaatggtgtagaacactaattcataatcacgctaattgtaatctggagacgtgtaacattgtgtagccttttgtataaatagacagatagaaatggtccgattagtttcctttttaatatgcttaaaataagcaggtggatctatttcatgtttttgaacaaaaactttatcggggatacgtgcggtagggtaaatcagtaagaggtgttatttgagccttgttttggacagtataccagttgccttttatcccaaagttgttgtaacctgctgtgatacaatgcttcaacagatgcggttatagaaatggttcagaattaaacttttaattcattcacttgtgtcattttgtttgtttgtcgtgagatggttgctcagggtgatgaaggcgcccagcttgcccaggggaaggaaggggcgctgtcggggtacccgggctgtctgggtagagaaggaccaagtctggatgggagtgctcggtgacccttagcagtgtcacatcaaaacccaggcaaaccacaggaaggaagcctttgtaggccttgaatattgtcactggctgactgcacttctgaccaaagggctgaggaagcctgtgtaaccagcccttcagctcaccctctcgcccaggagcaggcaggcttc

SEQ ID NO: 35493 - DNA, 1117 bp, Mus musculus
tgtggtgagatgaacaaatactgagcccagcaactgaattctgtggtccgttccttttcatttggggaccgagtctttgcctttcctaactttcctgtgtctggatcatagattataaggcttctgcttgaagttgctcctcctcttcttaacatccgtgagctggaccagagaaatggctcaacaattcagagcactggctgctcccccataggacctacaacacatacacgtcacacacacgcataccacccacactcacacatatgattatatgcatatcacatatacataccacacataaatacacattacacacacactcataccacatacattcacacacagatcccacacatacacatcatacacacacacacacacacacacacacacacacacactaatatacattccacacacattgcccacacatcacatatacatacgtgggtgcacacacatgtgtgttggagctaggggattcctggcagaatggagaggggtccaggctggtgtaaagtggtttaactgtgagttgctgagtgtcaaggacagagctactcagcatctagggagaagagagtagtgggcaggtgacacaggtgtctttgggaagggtaggagtaagcagagactgaataatggaagtggatcatgggaactgtgcagggagaggttcccagagccagcaaatagtaagtggcaggactaggcagggccattgtgactggctgaggcctggagtccctagggaggtgatatggaggcagagggacctggtggtggtcagggcaaatagacacccacatcccactttgacttgcctggtgagaacttagattatgatcagagtatgataggaagttgctcaggggagcaccatggccctgttgctatggagagccaggagagtgaggcagaacaggctccaggaggaggacttcagagggagggtcatactgcaggctgtggggactcagggcatctggctgtggacaccgagagcctaatgtgaggaccggatccatgtaccttcttaatggagtttgtgatgtcagagcgtgtttacctttagtggtgatggtggtttgacagtaggtgttctgtgtaattg

SEQ ID NO: 35494 - DNA, 1129 bp, Mus musculus
aagttttgaaatgcttattgctgctattagcagcacaaccggctgttcttcgggtctgacaaccctgccttttctctgaaaacatttgtgggttgcctaaggctttctctcttcctttttttttttcttttctttaaatgtccctttctgccctgtgtgagaagagaacagagagtcttacctttgtgaatactctgtcctaaggcacatccccggcccttcaatttatttatttttatttttaaaggtttgctatttttatgtgtattagtgtttcgtctgcatgtatgtctgtgcactacgtgcatacagggcccattgcacccaaaagagggaggtcagccacctggaactggagttacagatagctttcagttaccatgtggattctgggaatcgaacccaggtcctctggaagagctaatagaccagtgcttttttcttttttctttttctttttctttttctttttttttttttccgagacagggtttctctgtatagccctggctgacctggaactcactctgtagaccaggctggtttcgaactcagaaatccacccacctctgcctctcaagtgttgagattaaaggcatgtgctacaactgcccggcttctttacttaatttttgagacccgggctcactgtgtatctctggatggcctggaattcacagagatccacctgcctctgactcctgaacattgggattaaaatgtgtgtgcctccatgcctagcatagccgtggacttttgagacagggtttctaagtagcccctgctcatcttgactgacctgacttgcaacctccccgtccctgcttcctgaacactgccatgaccagcatgcactgcaccatggcttttctgtgtggatctagtccttatctttacagtctgagcgtctttttttccttttacgtcactactagattatggcaggaaccatggttggatgctgagtggcttgggcgagtgcagacagccttgtcttgttcctgatcttaggagcagatgttctgtcagctgtgatgttgcagaagtcccgttaagggtgggaaaatgtggctttctgattctggtgttgaattttgtcaactgctttatcactgagatggtcatacac

SEQ ID NO: 35495 - DNA, 1160 bp, Mus musculus
ccccttcccctggaccccttttagttcccacacacattcatctatccacccattcatccatccatctattcatccatccatccatctacctacccacccattcacctactcactcatccatccatccatttatagattcatctattgtctaccaattcacctacctattcatccatccagtcatccatccatccatccatccatccatccatccatccgagtcaatggtgtttccatgtgctggctctcaagtagggagaaatattaccaacgatttaacaaataaagcatttttgcctccatgtgcctggttttcatcaacttttcctgcgtggctcctgcacatgtgtggccaaggttattgctctttaacaggcatctagtacctggatggcgaactgttaatactcttactgtttctgggcatgcccatctgacactgaaccctgttggctcctccaggatgcacagggttaagtctgcattctccctcttgcctttcatagaaagagcgggatttggagctggctgcgaggatcggtcagtcattgttgaagaagaacaagaccctaactgagaggaatgaactgctggaagagcaggtggagcacatccgggaggaggtgaggactgctggcctggaagtagtcagggagatgggtgggagtacgggcaggtgtggcaagacttgtactcaagagaacccagacttgacatgtagaccttctctgctgggtccttagaactagcaggtgcaggagcagctgcccttcttacactgtgttaagtacaggagcggtgcaacattgtggcctgcagtcttcattgtataagctcggtgcaacgttgtggcctgcagtcttcattgtataaactcggtgcaacattgtggcccgcagtcttcattgtataaactcggtgcaacattgtggcctgcagtcttcattgtataaactcttcatttcatggtgctcaggctgtcaggggagaggacagctgtggactatttcaccatcaccaaggggagcctagagtcaggaggaaggatgctgactccctggaagtgatgtttaaactgcatggagacataacagtcagctggggttgccagaacagggatttggaggtcagagcccagctgtccatggaggcttctctcc

SEQ ID NO: 35496 - DNA, 1658 bp, Mus musculus
ctgataaccagggtttagttgattttaaagcttgccagtgcttacagcagcatcaggagaaagaagaactaaacaaaaggtttagggttgttaaagaaaaatccatctctatataaaacgatcagcgcactcttagtggtcaggtgatcgaacagagtgggctctcatcttattgagcacaaagcccaaattagcgcaggactggacttctggaagtgcctggctggctcaatcacagtgaccttgaacctgcttgacacctgccacgaagccctaggctgtgatcaagtgtggtgtctgtccatccatccatcccccttgagctggaagccctccagtcaggctcagacaagaacaaggacttcaccaggaatttggggtagtcattccaaggagccctgccctttgtacccccaacctgaggcctgcgaggtaaacacaatgtggacttgcagttgagccgggcattgtgcttcggtgtgcagcatggtcttggtgactccggttctgaacccaagccccagctctgcaaagggtgtttcatgtctctcactgtcaaagcttggtggcttgaggattcaatgttttgcttcttctgggacaaacaggaggggctgtggggagtccttcccagtgaaactcactgtctctatattgtgtcccaaggaagggaggcacagctgcgtcccggcagtccgtggtgacaccgagagttcgagcacccaggcatcccagtggtattgtggaggggccgaatctctctggctttggctcttcggacaatcaatcctcttggtcttcaaagctgcccgttgttcctggggagtgggggggtgtgaatttttagcagccttctcctctctcccaaacccatttggatgggatgggttttccttctgatgattcaactccatctctaaaatgacctcctcggagattgcacacccgatgggttagggaggggcagctgcatatcctctccatgtgtccagatgggggctgcacttctgattctaatcccgccttgccttgttgggttgttattgttagtgttcctgctacagccattgtcttaatgatctgcctgcccctttccctctctgtctttcccaataacccttcctcccaggcttcctgttggttttgttcctggactttgtcgctgtccaagacttgtgattgtctggctgaccttttcttcatagcttggtccttttttgttggcgccccgcagcaccttctcggttacccgagctcaggagcctccgctcagatccaatgctaaagccatggttcacagaagcagttcccgtgcttcatttgcttgtgtgtctttctgtgcctcccgccaagcctctgcttgtggtcccagggctggctgccaccccaggtgtctgtcacccagccctcatgggacacacagctgggtcacaccaccagcaggcacgcggccaagctccccttctcttctggacaccatcactattttgtgctccgactttgtccccctgtggtgtgtttctagccgactctccacccactcctttgttttgttttttgtttttttttttcttgtttgcttcttttagtttttagttttattttaacacaaagccagatttttttttttttttaattttcaaacctaagagaaaact

SEQ ID NO: 35497 - DNA, 2294 bp, Mus musculus
gatcataagcacataggcacaagcagatgcgggggcttcagggtcctcttagaggggccgagtggagagagaaaggccagggtttcagagatccttagcagaaatgggggaggctgctgttctctgcctttgttgtggcagctgggtgctcgccactgtagcattgctggagatgtggccctgtgcacctcctcctagagagacttcccaagttaattactgccccaaacctctcttgagcacctaattagagcacggggcctcattttatggacaggtattaagtaggtgttaacactcaaaagctttgtgtaactggcacttctctgtaaagctgctacggcttgcttctgggtaagagcccccgtatctccagtgtgggtatctggtggtactcaagaaaccatgttggggttcacccctctagcttgttcttggaatatacccaaaatttcatgggttgactcatgaggctccacaagtgataaaccctgttttggtagttttaaaaggagaatcctgttaaaattgttggctgttactggtaccctatgttaatcagccaccaggtgtcatttcaggaacgaggctatgtgactcaagaactggattgaaaaagtatctccattttaattttctttccttataagagaattttctatttttaatcaaatctttattgtctgggtatgaatgtcgtattggcagcttcctcggacgtgaacttcagcctcacgtcaatgttgatctcacgtacgttcgtgtctactgtacaggcaaatgctcactcttcctgacacagaattttgaagtgggaaagaggaaagcagaagaggaagaaaattcttttaattcaaagcacacattcaaaaaaaaattttttttaagtaattaaaaaaaaaaagtcagcctaaaactgtattgttttcctcctgatcctgtgtggttctctgttgctctagatctggacaccgcacacactctagggtctgagcctgtggttgttactgacactttacacttcgtaaatgctagtgggagtgttacctgtgcttggtgacacggctcgggacttatcatccagacagggttccatactgattcttacaagtggaaggaaaaggcgtcctgaagggaaacgatgcaccgactgacagagtccagcctagagaagcctcacctccctggaggagggcagggaagacagacgccccagagacagacaccctggggcttcaggtacggtgggtggttcaggattaggtatttgtagcccagtgggattcttgatgccaggacaatctggttccaaggcaggcgtgtttctttgcctgtcgctggctgctcttccggaggatgctgcttgcccagcagctcacaggaaccggtgcagacagcctaaacggaaggtgctttcctgttcggtgccacctgtctgctgttagccggtgagcgggcttaggcagaaggcttttgggttgggttgctttttactcagccagcctcaccttgaccggaactctacctggcactccccttttggagtggaggcagctgggccatctgaggtcgacttccccctcagtcccagatgctgcacagaccccaccggagtagtagggttgtggttcttgctatccgtgaaccctgtcgacgtgcgtgtgggcctcttcctttcttttctagtcaccatgtgctccacctcccctacctgtttccgcccacctcctacattcctgcctccagatggagatgcaggctagagtctgtggagagacagaagcctcccatcagtgatggagagggaggcagctttggaatcccatcctctgccccaccttggctcagtactcaggggaagcagcgctttggtcgtcagcactgcttggggtcaagggccatagccagcaggccgaagcaggtggctatctggagcataggagttggcctgaggtggggaagagaagtggctgtccgtctgtaggtgccctgggtgtgtggagggctgcatgcctcactctcattcagtcctttactgtgctgcttcccgagggagccgcctgtaacagcaacacttccagctctctactgtgtgtttgacagggatgacatgtgtctgaggctgtacatggccaggggtactgtcagctgtgtccagcaaacacttggctaaactgttgcttgcatctgactgtctctcccaggtcgggggggccactctgcctgtgtgccgtaagagcccagaatggtggagaaagagaaaccagggtgcccttgagagatgaggtggggga

SEQ ID NO: 35498 - DNA, 1189 bp, Mus musculus
cagagaattgtttgatgagcccgaaagacttgctggcctgggttagtcttttgtagccaagctcttcccaaaggggcacagggtataggagtttgagagcctgactcatttttgcccatgagttttgcatatacttgttgagatgaattctcagtatgaagtgtcctctcttagcagattcttaaccctaaaatggccagcagctgttgacagcagagactgcgtcccaccttgtcttgagatgagctgtcactacttcctgttaggaagtagatttcaagttgtcattcccttataattggttcataacactttggtttgtttgtagttgtgtggatagtttttgatacccgttgtcccaattatgttcatactgtaattattaccagactaattcattccttggatttatattatgacagggttcatgttgtttttggactggtaatatctggttttgaagtaattgaacagattgaaaatctgaaaacagatgctgcaagcagaccttatgcagatgtccgagttattgactgtggggtgctggccacaaagttgacaaaagatggtaagagcctttggaggatggggggagtctggaacagagaggtgtaaagcatgtgtgtgggtagtgggagtgttgatgcctctgtgctgtgctgcatcctctccaccagcagatgtttccagctcctcctcctgctactacccagctgtcagctgataagacctctcatgcctggattattgtagtaccctcacagctgcctaccttacctctctccctgtttccctatggtcgtttgtcagcaggcatgtcctcactaatttctttgctcatgcccttggtttactttggtttgtattcagcagctaccagagtgatcctcttaagggacaggtaatccacatccctcaccccccactccccatccccaccccgcacagacactacagtggtactctcagcacagagccgcagctttctgttgtcttttcaacatttttccatactcattgccttccagctacactgatgtttattcagacactagggactttgtgcctgccctcatgtatactttaggtctctgttccagggtaatcttaagctacctatatctatatgtatctctctgttcccttgacatttgtttattctgtcttagctctcattacttgtcacgtt

SEQ ID NO: 35499 - DNA, 1613 bp, Mus musculus
ctcactgtggcaatagtagcagccctgccccaaccatcctattccctgtttgtgtcgagacaccccccacccccacccccacgctgccccctgactccatgaagccctgcctgatggaggaaacccaggacaaaagttgggggcagcagggtcacaggctctgctgcacagaaaggggttcttacggctttgtgtggctcctccaggaagaatctaacctgtaaaaactagtgtgggtttgtttctttgttttgttttactctttagtttgcattctttccccaagtgtacttaatcaccttagtgccggttaaatccagttcacagacttcctgtcaggtatatggtgtagaagtctgtactctcctatcccacccaggccttgctagtgcatttgggaagagtaaaggccttgggctggaggaaattactaaagccctggccagatggaggggaagtactggatatatgaaagtagtcttccagggccatgtggctcagtgatatatagcatgtgcttagcatgtaagtagctctgggatcagaggtcagcaccccacaaataaataatggtgttactctgtgatgtatgtaagcagcattttggtggccagccagctattgttcaccatgtctgtaaattagttaattagaaggataacatcggaactcagtgcttggcgggttagacatgtggtttatagtgagtgggtccttctaccccccccccctttaaagttgcctacaaagaagggtgtttgaatctagtattcagtaggaagaatgcattcagagcccaaataaactggcaaatgtaattagtaagaaaaggtcactattgggccatatattcttatttggttgctgtgtaacaagttatcccaaatttctcagcctaagagtgcctatgtgtcattgacaaacaggcaatggtagggttgactcatctgctcagggtctcaaggtaaggtctggaagagctcatttctcagaagactctgggaagacgtgacttgtagctgggcccctctagagccctcggtggatgcccacatcgcctgctgtaggccttgccagcttcaaccagcagggaccctttgagtcttgtctttttttcaaaacctctgccctcctcctgctttaagggtccatgtaagtagatcagactccagagataaatctctactcgaagtcccgtggccagaggaattacagacattgtcgggttctggggattagcatagcaagaggaagggcatccacctaccacctactgctgcatggacagggcttaacctgtaccagcaggcactcatgttcagtaatgtcaaccttgctgtttatactcgactgaatacagaaatggcttttcttcttatccacgatcattctgtattttgaagttatttttttaataaaattgaattatgttgtgtaatgtgcttaatagaaaatgctttctttattggatgattttgtaacatcctgtttactgcaagtggcatagttgatattgttcaaaaatgtagaaaatacttttgtacatactagcaatgtctaatttgtatatacttctatgaaatttctctacaacttgaaaaggatcttgtaga

SEQ ID NO: 35500 - DNA, 1195 bp, Mus musculus
ccgcccccccccaaaattgcttccaatgagctgctgctttttgtctgtggactatggtacttctaaacttttattttgaattataaattctaagcatataagtagatttttaataactaccctgactcattgtatactgcaactgacttaaggcactcaaaataaaataatagaaagaaaatccacaagttgattgtctctcttgttttacaggtatccattatgatgttgacaatgaaggccttatttccaacagatatactcatatgagaagacccacttcaagcacttttaagtatctttctgtttgttgaaccagcatggcagggttcaagcgaggatatgatgggaaaattgctggattatatgatctggataaaaccttgggtcgaggtcattttgcagtggtcaaacttgccaggcatgtcttcacaggtgagaaggtggcagtgaaagtcattgacaagacgaagctggacactctagccactggtcatctcttccaggaagtgaggtgcatgaaactagtgcagcaccccaacattgtgcgtctctatgaagtcatagacacccagaccaaactttatctcattctagaacttggagatggaggagatatgtttgattatataatgaagcacgaggagggtcttaatgaagacttggccaagaagtactttgctcagatagttcatgctatatcttattgccataaactccatgtggtccacagagacttgaaaccagagaatgtagtcttttttgaaaaacaaggtcttgtgaagttgacagactttggcttcagcaacaaatttcagcctggaaagaaactcaccacgagctgcgggtctcttgcatactctgctccagaaatcctgcttggcgatgagtacgatgcccctgcagtaggtaggtgacctacccaggaagctctgtggaacctgccactgctgttagttggttatgttggttgaaaataattccaaagagaattttgattatatatgtctttcttaagaaatttggtctcatgaatactgtgtgttcctaagctggcagacaggttatttcatacttataagggaaaatgtctaaaggtgtttttaaaacaaaggtaattagagtattgttgaagggaacctttcagggcattcattgtagctttttttcttaaagactgagtttactccctttc

SEQ ID NO: 35501 - DNA, 1231 bp, Mus musculus
ttgttgactcgcacatagctcagaagccagtgtattaaataaatgacaaatgatgtccttggacaaagtgagagtcttaaaatagacacacaggcaaaaatggagacaagtcatgtgccttcctgggattgctgggggaaggaatgtgctggggagcccttcagacggaccccagtcctggcttggtaaaactcagattttcttcccccatcagtaataaggaaagcttactaagtctgtagtgtaaccgcaaagtaagccagatagagtgcttagcccttgtgctaaaacctggcaaatcctgccaggccaccgttcgctctgtattttccattctctccagagaagtctttaaagcatgtgagtccttcaaatgtagctgctttccccagggagcagtctgttggttgccactgacctcatctgttttctaacaaactttaaagtctgtacatcttgtttccccaccagatgtaagaagcgtggcagaggtggaaagctttgatacatgtgttttatgatggtaaaaaagaaattattcaaggaaaagatgtaccattggcatcatcagttgagagatggtttcctgtagctgttgagcttggagcttcctggggaagaattactccagacataggctgtgttatagtcggaggaggggcactgagtgacgagcagccgggtcaaagcccagcctgcatatgtttttaaagcatcaactgctagtccttgacttgtgaattccctctattcattgtatctgcatattggatgtaagtagccactactgaatgctcatcatgcataggacacacctcattgttgttgcagacaaggctctcagtgtgctgtcaccagttcaccattcggctgcctcagcagccaaggccggctggggttatagacgggctctgttgagacacaccctgtgaaaaacacattcttaaacttttaattgctaagattggggatcctttaaaacagaataagctatgctgtttttcctactgacttacattgcctgggggtctcagagatatgacatgtgctaccatagacaagggattgtaacaaatgaagtggttgcaagactagggaacatggggttctagagaaatctctaggaactgcacgtttgctcatctctttctctcaagattagaaagcagaacacagggaatgtttgaattcaacaattattttaaataccacctaattaataggaaataat

SEQ ID NO: 35502 - DNA, 1178 bp, Mus musculus
gggaacagcgatagatgaacactgatgctcagcccaattcctcctctttattcacccatgggacttggtctcccagttaggctgggtctttctgcttcaattaatctaatctagacaacccctcgcaggcacacccagggtctgtctcctgtttgccatttctcgagccctttctatttttaataaaatcttaactctgcttctcactgactagccctgaaatccttttgtgtttcaaaaaccgcagacctcattttgcagcacagttcctaacagaaccagggaagtcttcaggccgctgaagatgatagcaagtccttgtagcatccaacggggtgactatcagaagccaccaaatctccttgtgtccaacacaatcacaaagcccgtgaggatggccaccagcaaagtgggtgagggttctttgtctctgacccggttgccttttggcatcttctatgatgctgagacagactgatttgttagctcacacatggataaaattcaaaactatgtgcatctcttggccctactgataacaggctctgctagttaagttacccactgggactgaaacccagcactgaccaggcaggtttctcctcaggtaagcactccaatggctctgtcccaaaaatatgttaggcacacagaagtacaaaaaagacctgttagccatttagcctgtcccttgctaagatgagaaattgaaaaggcaactagagccaaattgtgtctctggtcagtccacagatgtcaaacagtccttactccacatgacagaattgcagtcaaaacgcagaggtactaaagtagcacatttagccaggaattcaaaatacctacatgatacatccccatcctaacaaagagaggtttgtggtccacactacagggagaatgcaaaaaaatttacattattcctttccacacagatggagcaaatctttaaaatatgaaaataagcttctgtttttcattcctcagtgtcgacatgcaaaacatcagaacccttaatgaaaatttaaaggtcagtccctcttccatttatttctatttgatctgttgagacactttaaaccctgtgtaaaatctttgactataattgatttggtttaaaggttattgtcagatgttacatttcaaatgcaaatttgtataatcagaacaggacttct

SEQ ID NO: 35503 - DNA, 1197 bp, Mus musculus
taataatcgccttaaataaaggttgtccttctgatgtactgaaaaattgtgatttttcagctgagacttttctcaatttcacctaactgcttgttaggtgtttggtgttgcagtccgtatgccagtgtacctagtccatatgccagtgtacctagtccatatgccagtgtacctagcgacttctgggcctgtggtgttaggtgttgggaagctgcactttattttccttgcatgtatttactgtctctaacaactaacatagttaacccaagtatttttatgtaaaaagatttcaatttagaatacttcatttttgagatggagtttagaatatttcattttgaaatggaacgaaagggttaggttttgatgtaaaagacaggagtcaatcactagcgttaactttccttgttttcctgttttatgatcaaggccgtgtttcagcattttaaatgtgttccatggtgacatagtgcttacagcaacgcagttcctggggcccttctgtgtgtaatctacagggttctatgagaacatatgcatagactcagccattcaagtgctgagtagcccgaacctgaaacctgtcccctttccttccagtattcccaggacccaggatctaggtcccctcacttgcagggatgttaacactgttgcctatcgggaaaccaagtcccactgtgttctcatgagcaaccagcttacatggtgcttaaactggattgcattttaccactaacatttaaaactatgtggtgctgttacgtctcatggcgccagaaatgagatagaacttgtggttatttttattgaatattatgttaatctaaccacttatatacttgaagtaaaattatgaaaaaaatctattatgttgtttgaactgtttggcagaaaccaccattggatttataactttctgacagtgttaaagtgagagacaatttgaaactatgaaaaagctccatggaatagctggatgctgagaaagccttctgtctagagaacagagaacaaagagcattgttaccaacattgtttgtccaggagaaaagcagattacacaaataaaacctcgacctcacaaatcacgactcgatgacttgagctattacatttttagtgactagtcaggaaatttttttgaaaatataaaattatatcacatgtaattaactgccagcaagattagct

SEQ ID NO: 35504 - DNA, 1374 bp, Mus musculus
caaaagttaaataaccaaattaaaagttaaataaccaaattaaaaattaaataaccaaattttgcttaagagaaagattttttaaaaccctattgaatatatactattaacattgtctgatacaagtttactaaagcatcagtaacagagaacttaaatacatgatttcttctaccaattaaagtatcagtggagcatatacttggtgggcacaggcatcctcaagatgagtaagatgtaggattataacttagcctgaagctccttaaaaagctttcttcacttcttcagctctggcccaggcagagccctgtgctatggctcgctctcaggtgaagcatggcctcctttgtgctcagctgtctcctgcacagtgagaggcctgctctctgttcagagtagacccacagtacattagaacaaaggagatgctaaaatcagtttttcatgttttgggtttttatgaaacatcattaatttaaacagttcaaatgtatgttcaaaataagaaatggcttataaaaggattgtgtgtgccattgtggcttttgacccatgctaatgtgacaaatgttgctgtaaatactcttatgaaacagtccctaagtagatttggtggcacacatctttaatcccagctcttgggaagcagaggcaggtggatctctgtgagtttaaggccagcctggtctataaagtgagtttcaggacaaccggggatgttaaacacagagtaaccctgtctggggggtggggccgtcaaacctgacatttattagaaaattgcttggattgtaccgtgtctaatatcagctaacgtggaatctgctgtaatgtgtgttgtattggatttgtctcagaactaattgttacataataaagcaagccttggccaccacacagctgcgttccaggatttccagctgctgagtttcatgactgtagtggtaggacgttattagacgtgatcctttgcagatgattcattgcagatgtatgtcctgtctccacaacagagggtgcaggtgaagcctcgggtacaaacggtctccaaaggagcctgacactgtggttggtgtgcagtcacttgatcaaaagcatcaaaggcagacctgcctcagtctcaagcccagagggttacattacggtattgtttgccttgagactggccttttatataaagctttgtgggtcactaggagctccaaatggttgcagcccaattgttacagggcaagaatcctgctttcatttttggccctttgtctctatgtaattacctatttcctttgaaggagagttttccgtctgtgtggacaccttgtaaaacacagcagcatccagtcaagaagcaatgtaacgggtctgttattt

SEQ ID NO: 35505 - DNA, 1201 bp, Mus musculus
tcccttgggtggagtagatgagctcctgaagaatggaccaagctttacagaggtattgtttgcacattagttataatgtcgtgtctggtatagccctttgttcatagtcctgattatcctggaactttgtcctttaagctctcctgctcctatttcttttgaggactatgccttaactgctagtgtgacctgggttcccagttatgcttgtcactgcagcctgaccacttgggaaagctgtgctagggtgcatatgttgacagattttgcaaaacaagtgaaaaatgctgcttctccaatctgaaaaaaatgagtctgcacagtgcttatgttacctttgcctgggttcagttcctagcatctatgtggcagctcacaaccattggcaatcccagagaatcccatgctctgtcctgaattttgtgtgctccagacatgcacatggctcacagacatgcaaacaaaacacgcatacaaaatacattttaaaaatagcatgggtatgaaaacaaatctgtattttcaaattgcctctctgaaagaatctagttctgccaagacaggagtagaactgtattttaaatgggtcttgatcagataggttggggggtactttataaaacaggccttgagtccagtattgaatgaaagttgtactcaaaagtacacagctgctaggtacgagcccaattactgacgggtttgagtagtagagtgccagttgacagattctgattgtcttggcaaccctgtctaatcttgaacttggcctggaaagcacaggcttctttgagcatggcctttccactgcctgaggaactgaagttggggatggggataggcatatgggctgagaccattatggagtaatgggtatcagatggcctcttaactcacctggttagtgtggtcagttacatccttactgaaggatatcaaaccacagtgtgcagagaggaaaccatgtaggctttcttagtaatctcttagagaagttagtttttgaaagcttaagtatgaaatgggtggaataacgggagttcagatccccttgtaagtagattgccaggggacttggaaaggcttataaaaaaaaatgtgtgttctatctgtgtgtcccttcctggaccaatgtgaagaatgatgaacacgagtcaactcactacaacagtgtttagatagtgggacctacagaaccctg

SEQ ID NO: 35506 - DNA, 1173 bp, Mus musculus
tggtgtcaagaatgtggaaaaacctttacacgtaaaagaagccttttagatcataagggaatacacagtggagagagacgctttaagtgcaacttgtgtgaaaaatcttttgatagaaactatcgacttgttaatcaccagaggatccacactacagagcaaccacagtggcgtgataaagattttgttgggatacatgcccgttctgttgaccagagaaaacacagcaacacgctgcagtctgaatatggcctacattcagataagcctggcttatcttactgtcaggatgtaaggttaaatattcaggaactaagtggaaagctccgtaaagagtgtgataacccttctgatgagagttccaagtcaattgcattccagaatgtgcccaccaagaagaaagcctgccacaaatgcagcacttgcgggaaaacatttaaaaagcattcacatcttattagccacaagagatgtcacacaaaagagaggcccttcaaatgcatagtgtgtgggaagaccttcaggtggtcttccaatttgactcggcatatgaaaaaccatgttagaaattagcctggggtcttcgatgacagtgggggtggggaatagttcttggtcacattctagagaactttagtggtaggcactggggaaaacctttgtaaaggtccagtcctttttggcttggatgttcttggtgtggaatcttgatgatttcaaaactcaggaatttctcagtcttccttctggaaagagatgttgaaaaataacagaaagttctctggggtcttttagggattctggcccctaggtttagcccaggcctctgacagccaggtctccttagataattcttgctgtttgtgattattggaaagcatgtctgtagcctagtaagcgttgtctgttgggaagggcccatttagatccctagttcttcagggtcagcttgtgttggtgctgttctgctgactttaaaacctagaacttgtattctacatcagatgtctcctgggggcccctggttggggcttcagtttataattggtttttggttattagctatggtcctaaagtagtctcagtgtcaagtgaaaaggacagggtgctaggctccgttgcttgatctggacaggcagcattactccatcatttcagctaagatacaagagc

SEQ ID NO: 35507 - DNA, 1162 bp, Mus musculus
gtccttgaaacccagagaatgactcatgtaagttgacccctgacccctcagcatgtatgctgtgacacatagcacccagacacacaaaataaaaaattaacaaattcaggtatatctatttcttccactttagtgatcaaagtaatttttagctaatcccttttgccttttaatataaattgtagtatcatctttacattgctcttctcctgccaagcatcttttctccttttccctgcagttctgggattaactccagggacttgtatgtgttaggtaattgttctaccactaaattgcattcccagcttccctcccatcctcccgagattctgataggaaataaactaaacatcaacttggtaagaattgatagcttttcatgctatatctcccaatatgtgactgtagtatggtgcgtctgtctgcatatttagatgctctttgaccttttttatcagccacttgtgttttctagccctatgaatgtgttaactatatttccaccctaggtctcagtccgcaggtgctcatgcacatgtgtcttctcacacatcctcgagaacctagagaacctacctccatcatgtgtgtgaacatcattttcttgtctcttctaggactgagctcaatcatgtgtgcggatatcattttcttgtctcttcttttctgaacatcagtgttggttgttcattcttttaccagtgacttctgatgacctagcaaataatgccacacactgcaatactgtgaagacactcgcaaggatacagcagtgatttagtgaaagcaacagatttcttttgtgttcatctgtgtgaccctggataggagtgatgcctccaggcaggtggcatgctgcccgctcagctcaggtgtcaagggaacaaggctgccttcgaatggtaaaagaagaggaggaggatggctatatttcaatgcagactgccaggccacagacacttaaccgccctggccaggagctattccgtcagctctttagacagcttcgctatcatgaatcttctgggcccctagaaactctgagccggctccaggagctctgccgctggtggatgaggcctgatgttctttcaaaagcacagatgttagagttgttggtcttggagcaattcctgagcatcttgcctggagagctccg

SEQ ID NO: 35508 - DNA, 1476 bp, Mus musculus
gagacatacctttcacagcatacaaaacattatcccagcttctccccctttaacatctgatcacttaaggaggtctctgcagatccagagtgggttctcttcctgcacttctccagttttcgtcccacggaatctagctgcatttacttttccaaactctgaaccatttctcctcagctcagccagataagcaagctctctgtggactctccacctttactgtgccttgtgatccagagtcactttactttgttgtctgttgtccagtgttgaggacttgttgcatatttttggtccagtttcctagttacttaagtaaatccagtttttgctactccatcatggctgactgatgattgattgaaatcaatttgaaattgaaataaaatagaaaccaaattgaaattgattgaactccttctgttcataaggacaagcaacaagatgatctgagatttcagctgtcataacacgaactgatatatatatatatatatatatatatatatatatacacacacacacacacacacacatactgtctctttgtcaccaacatttgagaggactgtgaaaggtgctgtagggctgtggggcggggtggtttggtaggcttgtttgttttctacttcacaggtgttgggttaaggtataggtggaagtataatctccagaaatcaagttctgtgataacattttgcttttaatttttgtgtgaacagaacagaatccttattgtcctagtctcgatcatcagagatttttgtgtgcttactatgaatcaggtactttaggtatgctttataaagcagaagaataatgcttattatgatagccaagaaagggcactgagagagatactgtgcatgaggcggggtagcagagaggctggcagtttgtgtctgtgggctccacatctgctcatcagtacacaggaaatattcaggacaaaatacatccatctgtatagaatatgtacagaattgttttctagtcattctctaaataatacaactgagtacttcgtaacatttataccatattaggtattataagtaatctgaaattttttttttttttttttttttttttggtttttcaagacagggtttctctgtgtagtcctggctgtcctggaactcactttgtagaccagactggcctcgaactcagaaatctgaactcagaaatctgcctgtctctgcctgctgagtgctgggattaaaggtgtgtgccaccactgcccagctttggagatcttttaacatatacaagaggatgtttatggaatgacaaccattttaaacatccacagaattgttaggtatctggagtcatgaagtaaatctgttgctaacaaaggattatatatgctattacatagtgtggttggggaatgccttatttagaagataatatttgagggctggaaagatggctttatttgattaaaacacttaccacctagcctgatta

SEQ ID NO: 35509 - DNA, 1214 bp, Mus musculus
tgatgaggtgacagagctagatggctttctctaacctgcgggactgtcctgtggttcttcgccatgtgcactagctctacctccttccctagcaaggctttgtggggctgtggaagtggcttagtggttagagaagttgctactcttccaaggacctgatgcagccccccccactggacatctcataactctgtgtcacgcgcacgcgcacacgcacacacaataaaactgaaaacaaaccaagccacagccaccacacgaggtgttactgaattagctcgttaatgcagtgctctccctggaactaagagacttctaagttgctttgctgtgcagatgagcagaactctagcagatagctcttgtgctgtgactttcttttctgcagtgcaaatacaatgcttcattggctgacaaagaagagagcaaggaattgatcaggagacaggaagtggatatcctggaactgaaagaaactcttagactgagaatcctctcagaggacatcgaggtaggtattaacgtggtactttctttttattatttctattctctctctctctctctctctctctctctctctctctctgtgtgtgtgtgtgtgtctgtctgtctgtctgtctgtctgtctctcccccccgccccgcccttttttctctttgagacaggatctcattgtgccaaccatgctgatcttgaactcacataattcctctgcctctgactttttttcaaaggatgactcagagggtaaagttacttcctctgaagttgaccatcttatttgaatcctcaaaacccacatggtagaaggaagaactgttttattgttgaaaaaccaacagtaaaaattattaagtcctattcacaaaaataaaatatatcagaatcttaaggagaaaatttagcaagtgttaggctgtcagagagattccaagtgatgtaaaagaaaacttgaaaaggaaagtacaaaattactatagacacaaaaattcatgtattctagttcaaattgtaagtcttaaaagttgatgaaatctgggcatggaggcacttgcctttaatcccactgtttgggaggccaaagcaagtgtacacaggaaggtccatgtcagccagagttacccagtgagcctgtcttaaaaggaaggacagagagggaaagggggaatccaggtataaacataaaatgcatacacacaaacaaacataaa

SEQ ID NO: 35510 - DNA, 2023 bp, Mus musculus
acaccagaacccaatggccttctctctatggcaactcctgagattctactcagcactgcagctgataagaggaggcccagtgtttctgggccagaggctgcttgcacacctgcctcttgctttgaataatagttctttggtctacctctgtggctagaggcgccaattttttagcaggagatcctagcccaaagccttggacaacgtccttcctctcaggtctagtgtgtaaaacaagtgtcacaaacactaactgatcctccatggccccagcatagacagaggttattctacaagcatgtaccagacatctgcacgccacagaggtgggcatctgggcaaaaaggagtcaggacttggggttttctggtttcaagaatgaaggaaagatgacaggttttaaattaacttgacacaagctgaaggtatttgagaagagggaatctcaattgagaaaatgcctctgtaagattggcctttacacaaatgtgtagtgcattttcttgattgatgtaggagggccaggcccattgtcagttatgccacccctggatggaagaaaaaaacatgacgggcaagttatgaggagcaagccagtaagcagcactcctctgtgacctctgcattagcccatgcctctagggtcctgccctaacttccctcagatgcaattaaccctttcctccccaggttgctttaggtcgtagtgttttatcacagcaacagaaaccctaaggcaagaatggcctttaaatacacaaaataccccttattcagtgtgtactgagtatctctggaacacatgtccacttagaattacagcccttgagagaggttgaccatcacgaagaggacccagaccaagaaggccaacctggatccatgaaattcagaggcaatgaggttaaattaagcagcatgctggcataaaagaaaatttaactccagaccacttagccatcttaaagttgccagagtttaattcaaagcatagtggtatgtgagcagataccttaacagcagagcaaagcacagactcccgagaacagggcaggatacgttgcttcttcagatgttgtcactggccatagactcttacttaaaaaaagggtctacctcccatggctcatccagagcaagagggcctcacgccagcgtggggcctgcttctaagaggacagagccttgggataagagggtgtagtgcctgacccaggaccagctccaagatgctttctataagacttccagcacagcctccaggcacccctggacttgatagaatccatggtctagatggaagatgcctccagcccttctatatctgggctctgtacatggttctgaatccagatgacggtggcactgtcttctgaggccacaattcctaaatatgtatttgaaatgtttgcctgtgacatgtgcccaggttctctggctccctggagctactgcctgtggtgacatcggcctttgagctctgtcttgctgggctggctcttgaatgtgccttcacacgcataatcaaatttaaccatccctgacctgaaagctaaatgcaatttagaaaatgttaacatgcttagccaaggctcagagccaatcagggctcctgcctccatctccatggtatcaaatgtgctacttgctgatgagaacgaccttctcggcatgaacctctttcacttgtctggaaataaacttgacaatgaatttctggggtccagctttcactggggtgcattccatttggaaagtgatggtctttccaggtggcactgtcctagaaaattcaaaggcacacagtcagccaaaagtgccacagagagaaaatcgcattgcatgaggaaccaggcaggcatccggttccagtacagatcttgggaaatccctgtgctgcagagccactgaagcaggcctccacctggagggtggccacttgtctcagctgtaagacaagatggcctgctggaatggctgttttccagctatgccagtcacaaaccctcctgagagccctcag

SEQ ID NO: 35511 - DNA, 1189 bp, Mus musculus
aagacaccaacagtggctgctaccctgatgagtgttaccaactctgtcaccccacacttttttttccattaggattggggtcgggggataggaagggcaatagagggtacaggagagtagggactttctctgagttcctcttaacaggatgtgccaaaagtgatccagcaaaggaaatggtgaccaggatgtcggggtgggggatccacttctgcttcttgagggctgtcttggggaggctggggatcttggggaaggaatgctctaacatcaaggaagaccagcctggaaggctaaagagactccagccatttccaggaaagggattccttggctggctgactcgaaatcaacaaaggagggtatgctgagcctgcggtcagggcttgggcttggttgaaagagcaccctacatgcatgcatgcatacacacgtacagagtctacccaaatggaaatgagcctgagtcatgacagtatcgccatcctatagatacgagactcttccctgagacaacaaggcagtcagcctttctatagccacaagcatgcatcctagaagagctaggtgaagacatatattgaactcctggaaaaagtctgtaagacatggggacaggtgcaaccagaaatggcctcctttgcattttagagcagcgcccaaaatggtgcctcacagaaaactgcattgctagtcctaatgacatgccttattcccaacatttagagctggcaactaaacctctgttgctttgaggagaacctggtccacatggttctggctacatagggaaaccctgtcttaaaaacaatgaagaactgcatggtggccaggacatgcagactgttaagccaggaagaccccaggcactgctctcccaggatgagcttggacctagtctgtccactggagcttgaggtatctggctgttactgatagtctgggcaggctcctgcactccccagtccattgcagtggtggctgaagcggcagcttctgcagtctaaccagttagatagtctcaagaaacacacccagctcaactcaccccttgaaccattccccagcgtggctgccactgaccctggcagaggattgtatcacagctcctctagctctgcaaaagggcaggagtcctgggccagtggaacctgtgacctccatgacacgagtcaatcgaggtactgtc

SEQ ID NO: 35512 - DNA, 1142 bp, Mus musculus
tttctctacctgccttttgtcttcagggattccacattctactacttgtctctaccccatttctatcagttcctcagtcttaaatttgtcatgacctagatttttttaattgagaataaattcatataatgtaatacaaatcatttaagtgtatagttggttctaagacacttaccaaattcaggataaaccacttctgtctcattccaaaatagttccaccacagaccttggccctggtgaaaactgtaggtcagttattgttgtcaactgctcttgtgtcgggttaggcaggaggggcactggcgtgttacatttgtggttccctgtaactggaaacacttgctgctgatccacttgagtcttggcaattctgaccttgatggttgtgttaagtccattcctggaacgtttccctgctataaagtgaccactggcaccttccattattgatgtctcatgaagagagcacatgagatcagattattggttattgggttttttggtttggtttggttgatttaagacaggatctctttccctggctgtcctggaactcacagagacccacctgactctgcctccacaatcagctaaggtcagattctttaactgatagcttttacagaagtcaagaaacgtaagtccctgagatgttatgggaagagtgctagagtattggtatagtcagattagtctgtgtgtctacctcttccttacaaaagggatatgccatattccagttacaggagaaaattgcatgaaagagataaattaggaccatagaagtcttccttgggggtagagggtcttgagtcatgattgagtgcatcgatatctgtctgggaaactcagaaaattcccttagcttgtggaagaggtgaagaaagcagaggcctggctgggggctcagagcctttgtaaggatgaatctggaggtctgatctctgtgtatctataactgtttggggctttttcctacccatcaccttctttctgtggcctgggggccgagtcacagtcagcacccacagcaggtgagtggtcagcttgggagaggtcatgtggaatgtccactgcatgaacccacagtggcctgtgcaccttctggtgcccactgcatgtggcatctttgcttcccct

SEQ ID NO: 35513 - DNA, 1200 bp, Mus musculus
tcattttccactgtagcttcactgacggggccaactggttatctgaagccaagtatggaggagcacgtgtgcaaacccagcgagttcggaactggaggcaagagggtcagttcaaggtcatcctttgccatacagagagctcaggattaacctgtggtacatgagaccctacctcaaaaaacaaagacttcataaagagccaggtctatgtgtctgtagacccaacactcagcaagttagggccagaatatgccttaagttcaggagttcaagaccagcccaggcagcacagtgagcctctgtttaaaaaagaaaaggaaagaagccactgaaccgcttgttctcccaaacctggcccttcaactcccttctccctcctctacgctcccacggacaaataaaaacaaaggaacgatgactggtacttctaagatggcatgctagaaaccctctaggggaaaggcgccattaactctcttgtggaataaaggacacctggaattcttcagctggggtgatggagttcagcacttgtctaacctcagtgtgtggtctctgtagaacatgatcacctactctcatggtttctgtaagcactggataaaaatggaaggtagaatggtatgggcgggctttggtttctgtgtgtgtaacagctgcacaggagctgtgatttttccagtctgggtcaccaatgtctgcccctgcccctttcttacaatacatgaccgctgcgtgatacttcagagtactttggttgtgagtctgtgcatcttctgggttgcaacaggaagacgtttcgtgctgtgggctgcagtagaagggtatggagctgctgctcgagagagttggtatcatctgaccagctctccagagcttgctgtggggatgctggccagcttatctgctggcactggggtcctattccaggagtctcacaagccctgaactgatgcctgtggtccctgccacccttgggagccttaggcctcacacattcatgctggggtgttggtgcaatgttcaccggtcagactctacaggccgttcaggtgaggccgaggcctgctcacttgtgtcagtcactgttcgcttgagcctgacatggctcacacctgtgaatctcaggctgcagaactttgccttctggacacctttaagtctacaactcttagaaaaagaagctctggggtctgtttt

SEQ ID NO: 35514 - DNA, 2902 bp, Mus musculus
ctttcctgctttgaaaaggaagtgttcgctctggtcacctgaggcatgtggacatccctcccaaaactgcagagatggagcgcttgactgaaagtgtgattgttcttgttttcagggcatagaacaattgaaaaaggaagagagaagatgggctaaaaaaacaaaatggatgaacatgaaagccgtgtttggccaccctttctctctaggctgggccagcccctttgccacaccagaccaagggaaggcagacccgtaccagtatgtggtctgaaggaccctgaccagcattgccactcagaccacatcatggcacctcccatccgctcttgtgaatgtttaggccaaaactcttaaaacttttttatgtcttcagaaaaatggctgagcattgcagagaaaaaaaaagtcctcatgttttatttttaaaaaaaaaatcatcctttcaattttttgatgactggagctgctcttttcccttttaaaatcacttctctggcctctgtttcctctctgctctgtcagcatgactaacgtcgagggtgctgctcaggccctgccccttctactaattgaatgcccctgatgctgtgtatggatgaactggcccagtaggaaagccaagagggccctgacctcctcctgcccacagggcagcactggcgcccgcaggactcagaacctcttcgaagataatgctaaccccttgaagcctaaggatgaaaagattgggctggagccatcataagggtccttggtgcagtggcctcctgcccaagtggacagttcgcctcagtttcagaaatcgatgggtgtgggtgtacagaatgacttgggggaggtgggagaggtaaaggggcctttgtattctgaatcagcaattatgtcactctggcttttgggaagactatgaaagagatgtttcccagttcaaaaatgccttatacaatcacaagaggaaaacaatttcaggcaagctacaacaactttctaccccagttcccgccctttcccagcaagatgtcagtcattctgagggaaacagacaacctcctgtcaggatcatctcagttttaaccgtgtcatgagcatagactttctggagttgaaagtcctccagatgtgcacagacctgtgtcttatgtgtgtttagtctgggaagtggttgtagatgttaggtaacattcttagagttgccaggtagcccctactcacctgcttctcagcctgctacacagacaagctttcccatcagcaggtactgctaagcaaagtcacacagggaagagctggtcttgagctagggaggaaccaggggatgtaggaggtgctaagagaagactgctcttgaaccctacagccacgtggaacctgagcaccatgaagtcccccaaaccagtgggttttaaagcaatcaccacaaaactccctttttagcttttgcttggggtgggggtggggataaggtttttcattctagttgtgggtaggaagaaagttaatgtagccctgtggtttttcagaagtcggtgggacgttctgcctcttcccaactctgtcagtgcttccacatggaaacaatgcaataaaccttttccaaacctgcttctgctctgctctctccccacggcctgtgcagaagggcaggtggtgtcaggctgcaggctgagggagtttagttttgttcttaaaggctatggatggcctttctgcaggcagaattctctgcatgagttgctggtgagggtgccctatggctccaagaggtcagtctttctggagtctagggccagagcctgcccagcagagagcaaaagctgtgccaacagaaagtgcctagcatctatacccacagtgcgaggtgctgtttttctggggggttcttgttgatggtatctagtgatgacagatgaggcaacactgaggaactggccacctcccctacctccgtaggctttgatttgcctcggctgtgccgtttaggctgagatcctgggtgtgtgctcatgtggagttttacacataactatatatcgacatagataggtttagatgaagttcatagcatttgttctccaggtgcctttgaaattttgtttatttatctcttggtttatatgaaagaggtgtggcctgttccaggttcagcaggttagaagggtccagctgtccagccttgctcgaatactcaggttagatctgctgtggcaaagagcagctacactgcacactgcagctatggttctgttgtcaacatattcatattctctctctctctccctctcccccccccccaagactggaactaaggaaatagcctttagcctttaagggcattttgtgaatggctctagcttttgctatggggtttcacagtagatggcactgcaggaatttgaatcctgaaattaaagctcacactctaaataggcatgcgaccagcttactgcccaggcccttgtaagtctccctctgcattattacaaccaaaggctgcaaagtggaggtccttagtgctcaaactacagcaaaaaggcctcaagacaggactaccctagggtggcctgtgagtaccattgcattctctctgaagccaggagaatttttctgtgagcacagtagtgaccaaggctgtgtgtcaacaaatgactctgtcctgagtcttctgatccctttagatggagtaaaaggtctttctccgtggcctactggaaagtgagcctttgtcgcccatcttccagaatggtaactgggtaataggagtgaagaagacatggccagtagactgggtaacccacgtacttgtccatttcttcatgtcatatctgcatatttgcatgagcttggtgacatgtatacagtagaaatgtgtgcccagtctttccttaataccattttacct

SEQ ID NO: 35515 - DNA, 1195 bp, Mus musculus
cctgcaccagtggaggactacgctcaacaaaaaacagaattcctctccatgaggtagtaacggtttccacagccctgaggttcaaacagacaagtgtggaagagggaattttggtggggattgggaggggaccctgctggaaccctcaaggcactttcatcacaggctcaggtggctggacaggtgggaccttggtcttctgggagtttgtgcaattggagacacactttcaggaaggctctaatcaccagctgactaataaacaatgatgagaatattacatgaggctctggttaccctcacaaaggggcttcctctggcagccctgtgtgggctctctaaggtttataggaaattctgggagctagtaccttcaggtactttcctggcctgcctcactgcatctgtgtctgcattccacagctcttatcattgcttctttgcagggcaggaggactgttatttggccagtgtctgaagtcactttagctggagtctgttccctgtgagacatctcggttgcaaaagcaaaccacaacttgcatgcatctttgcatttcttaagaagtttttttttccgggctggcaagatgactcaacgggtaagagcatgactgctcttccaggggtcctgagttcaaatcccagcaaccacatggtggctcacaaccacccattatgaaatcttacgccctctctggtgcatctgaagtcagttacagtgtacctatgtataataaataaatctttaaaaaaaaagaagaagaagaagaagttgttcttctcctcctaaaattcttccataggatagatcctaacaaccagctcttgttccttctgccttgctggcctgctccagtttggggaagtggtgctctgtgtgaagcctccaacccctacgcacacaccctctggatcctatttgagttgttgtgcagcacaggtacgcaggctttgctccctgctgactttgcacagcagtgctacgtagagtctgggtgtattgtgcttcatagcttcagtgttggtgcactgctgggctcctaatctgaatgatcatatcctgagtacttggctgtgtgcagcaccatccaaggacctcccataaacttcctgtgtgccataaatcccaggtattggacgaatgggccacttaataggaagcaaaggcacagtgatgacatctgttgtggct

SEQ ID NO: 35516 - DNA, 1172 bp, Mus musculus
agcatgggaactagcacttgtttaacactcagtaaacagtgttgttattaaagaccagtgtatttaattcctctgcaaattataaccctattctcctaaactttagatagatacatttttttcttctcttccaaagtgttctaaaatttttaatcctgaatgttcatcatatcatcaagaaaaacctaaggttgaattggccatgtgctcacagatgtctgtcttccccaatcctattctaacaaaggcattttatgtgtccttgtcacagcttactattggcacattggccaagcaactcaccccaaagatgccctcagtcttggagccacactgtaacattatagcctccacagggcattcaccacagtgtattcccctgtctcctgtctcctaacaggccttggttaactgggatccagtggatcaaacagtgctagccaatgagcaggtgaatgaatatggctgttcatggcgttctggagccaaggtagagaagaaatacctccgacagtggttcattaagacaactgcttatgcaaaggtaagtggtggtcagaggctctcagtaatgcccagtgtgtgggtatagcatactgtcaactctgttgaaggagcctaagcagagtcctaagacatgggaggcagagagcctcagtgttgttcatgtacatacagggtggtgggcaagggtcctgaagttttaacaagaaagacacctggaggtcattacaattcttctttagtgagttgtcctcaaagcagcagtaattctatctgcaattatacatcgaaaaagggaatgagtctttgtgatgctccatagggcttgagttaaagtttctctgtgccatcatgtatagtaacccagaagtaaagagctaactggtctccaagagggaagaccagggagtagcagtaagctgggccaagtccagagctccagatgtggctctctgtgcctctgactgtttgtgcaggttgccctgggcctcagtttcctgataagtaagttgagcaattagacccaatgatgctccaagtaccttctggctgattctatgttcagagatcaagacaaagacagccatggaaacagagttccttagtaagtcatagtggcctggacaaagtcctgagttctgtatgtatgtaatactcagtgctgctgt

SEQ ID NO: 35517 - DNA, 1259 bp, Mus musculus
ctgtggactcccctcactctttctgttctttctctcctcagatcaacaacaaggcctgtggcaagatccctgtgccccagcatgttgcccaggaccaggacaaagtccatgaacttgttctccagagcgagctaggcatgaagctgctgcaggggagaagcatcaagaaggccttcctctcccccaggactgccctcatcaacttcttggtgcaggagtgaccagggcttctaggaccctccttctctgcccagatcaagggaaggaatgttaacgtgggaaaaaaggcaaacatcagggacattggcctttgtgccaggaccagcaggagtcagcaggaggcctaaggcgagctcagggaggacagaaacctcccgtggagcagaagggcaaaagctcgcttgatcttgattttcagtaggaatacagaccgtgaaagcggggcctcacgatccttctgaccttttgggttttaagcaggatgtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctgggattagaccgtcgtgagacaggttagttttaccctactgatgatgtgttgttgccatggtaatcctgctcagtacgagaggaaccgcagctagcttgtgtctccagtgtcttttaccatcacaggccctggctctgtgctacctccctagaatacctgtggttcatcaccttcagctcacactccattcagacaatgctcacttaggcctacaagcaagggagaggcttaagcacaaggtctttaagcttgatactgtgcctggtctcaatgcctagaaattccaacttaactgtcgctatcataaaggattttaaatttttttacaagtgagaacctagcatgtcaaggtcctaggttccatctccaacacgaaaaaagcaaggcaactctaccaaagaaactaattacatacttgtattcccaatatgtgagaagctgaggaaggaggatcatgagtttaaagccatccttggttacatgagactcttgtctcaaagaactaccagggatcctaatggacaacaaaggttgaaaaccattgaattaataaatgttgtgaaccataatttctacccagtccttcttccttcattttcatctcatctgggataagttt

SEQ ID NO: 35518 - DNA, 1144 bp, Mus musculus
cttggaccctccactgcggaattgaagttggaagccctcacccagcgtctggagcgagagatggatgctcaccccaaagcggactacttcggtaagtaagatgctttggagttgcctgtggtggagcgatggtgtccccaccaggatgctattatttctccttcctctttcagctacttctgctcctttagaaacttgaaagcagctgcgggcagaaagcagccttttgcatatgggagttacccatgtgagcagagtgaagcagggtgggattgctcataactgccctcaaaaaagggaaatgaagctgggaggtggtgatgctcgcctgtaattccgacacttgggaggcagacgcaggaggatctctgagttcgaggccagcctggtctattatagctagagttccagaacagccagggctacacagagaaatcctgctttgaccaaaccaaaccaaaccaaatcaacaaacaaaacaaaacaaaacaaaaaagagggaaattctgtgagtttgtgtttcaagggtttgaggtaccacctcaagcttcttgcagtgactggcttgagctgaccaaatttgtggttgttctacatggtataaatgtgtgggatgtgtggcttttgtttcttgtcttctgttcatatggtggttctgcaggtagccatggaccagcatcatatctttgcctagatgctggttacaaaaggaaatcattagcccctccctggatctgctgcagcaggagctcagggtaagatcggagaaggagagagacttctgcaggatcacgataacaactgggccaggtgcctcttgactcagtccacacccagcaccagccagcagcaggcgatacccgaaggtgtgacctgacacaaggtgaaggtgcttctccaggcttttacccaaagttgcagatttcattctctcttctaaaaaaaacccacacactctttacagacgactggcttcgacttttttttctacacgatgtttggaggcagcaagaacgtggctgtattcctttgttgaaaacagttgcctgtctcatgggagcgggtggcttggaaagacagcttgtgtttaggagtctgtggcttttttcatcttttaattttctctctctctctctctctctct

SEQ ID NO: 35519 - DNA, 1136 bp, Mus musculus
gtggggtgtgtagatagaggaggaagaagtcaaggaagctgcaggcagcttagccactcacacggtgggggtagggtagcttccgcctggtcccttagagagccccacaaaacccccagggacaagctcaccaaatcccaggcagattgggataaagtagagttacgtgctggctggaacatgcggttctctctgaagggacattcctattacactaagtcagacttggggctgtttgtgggaatgcagaggcacacaaacgtggaccttcatctgtctgctctgtgcctctgttttcccataagttaaatgagcatctggttgtagtgaaaactgagttggctaatgtagctatctgagctatccagtgtggaagactgcagacgcgtagctgctaagcacatcaccaggtggtccgtctgagctgagaagtcctttaagcatgaaatgtactctggagtttgaagatttggtgtgaagaaagaatgcgtattagtatttctatatgagctgggtgtggtggctcaaacctgtgatcccagcgctttggagacagaagcaggaagataccaaagttcaaggtcaatttgcatatatatatacatatatatatatatatatatatatatatatatatcacataaattctatgtaaaaatgagacttttggacactacaggctaagcaaaatgttattcagtagtttcactcttggagtatactgtttggaaatgtgagatcatgctggcttgtctcaagtttttggaagcactcaggatagaatatggcagatagtgtgggtcccttactgtttaagatgtattactgtattctcaaaagtaccaaggcatcatcagttactttccccacctgaaagatgatgccaggtgatgtgttcagagacacagagtcttaaagattttggaattgccacccacgctgtgcaccggaggcaaggatgggaggagttcgggtgctgctttggagtgtgtgctccctagggaaaagctatagaaggtctcaagctgctgcctcacagggcagggtggagcaggtggtgatgacagcggagataacttgctggttctttaaatgtactcttctgttagtgagtgaaggcagagtcctaagactgc

SEQ ID NO: 35520 - DNA, 2262 bp, Mus musculus
cctgcacccggataaccctcacacagcccatggtgtgacttaacagttcagtccacttcagagctttagctcttctgagaatacttcaaacacttgactgcattgcagctagaaagaggctctgcatatgctttgtacattggagtttgcttggtgaaggagagccaagcttggacatctgggaggctgggtctccctgctgtgcctctgcctttcctcctgcacctaagacagtggggttggggcagaggcttgccctgtcctatgcagccagctcagagagaactggtgcaggcgccaggcttctcgtccatgcttggtgctgtgttttcattgcttcctccagtctgtgacattggagttgcttcctcaaggtgagtctgaggcttcctcatatccctgtcaccttgttcaactcatttgaacatgaccgttgggaatcccagtccatatcctgggagagagctacttctaaaaggaaagttttgtgtgtgagatctcagagctagcaccagagggagtgcccgagcttgtttcagcggacttgtatctctctggtcctcttctcagcacagacatttgcttggtttgaggaaactaatataaggtacactgcttttgtctgtttttttaaacgtcattctttctctctaccttttcccacacacaaaacatacctcacagatagttttcaccaaatcacagatcaaagaggaattcatccatcctattggagactgttggtgtatcagcagtggccgttttccaactcttgaactacagctaagcagtacagtcgcaacacaaggtcttctgagactagctgcaactgaagtcatgagttcactctggcctcatgtgcctctgcatgctggctcccgaggttgccaggctaagatggagaccacatgctgtcaatattaagaccacttctgaggtggatatgtggacatacccgtcctcccaacatttgagagcctgaagtttgtgaagaaggagtttaaggctgtcctcaactacatgaggtcatgatctcactcaaaaaaaaaaaaaaaaaaacttaaaagagaaagaaaaaaaccccacccagcattgaagaacataattaactttgcctatcacttcccgaggccagaggtcagtgtctccttggaagttcaaatgggtaaaactggaaaaacaaaaatgaaatgggtttccatctgctgtcttatcttcagggagtgtcccgtgacttgtggcaggaaggctgcagtgtcttacttcagcagtcaggctgggtacccagcagctggcttgggtggtgaagcaaggccggtagagctcctgccacatgtgaatgtggactcttgactaggcctcagctagacctggtagctactgcaatcctgctgacctccattgcctatgagaagttcagaactagcactgtggatcaggagcatctttttcatttttatcaggttccttctgttgggatcctttggccagatgttactcgtttcctgttctagacagaggcccccttaaaaaaaaaaaagctatgaatgtatggggtcaccgagatagaccctgagaccagcgctgttttctctctttggtttcccgggctggctttggcaagggtggcagggaaaggagaaaacacaatgtctttgccttcctggaggctctggtagagtctaattttgtgtcaagatgattgatgaagattgcagtggaattagtgtctgaggtagatgggatttgtttgcaaattgaataatttaaaactctgtgattaatttttaaatgaaattaaatgaaattcctgattgaagtgattcagatctgtttgcaaatactacattttatattatcaaaaaagcaataaagaaatttgtagacttcccagaacccccaagactgtcttctttgactgtttgctggagaaggcaccactaagggtctcattgtttctctctatctcaggcctgtgcaataaaacatgaagatatattcacttatctgggattttaaatgttctataaattttggccagatagagctgtaaggagattatacttatagctatgtaggagggaacgaagggaggtggtagggatgctatgctttgaaagttagagcaaatagccttttcaagaatcctgtataactcttgtaccttggataaaaacaaggagatggaggcaatctcacttccagggctagcctctgctatcaccctccttattctgaccataggtttcagaagagccttca

SEQ ID NO: 35521 - DNA, 1139 bp, Mus musculus
aaaaaatgttcttttcctattttctgtttgcatactcatccattttaaaagagaaaaaacgtttttaaatgctttttccaacctttgcttcagaaggttctgattctattgtttgtcagggctaagaatttttgtttgtaactcagattctgatagattcttatgttgggccatggtgaaataatcatgttaaagggaccttaggaaatatggttggtttccatagcagtaggccccttcactgttctctctgctcttctctgtgtgatgacttctataaaaggctgtttgagaaaaggggctattgcctcaactagcaatattcccatttgtgtaggaaaaaaatgctggactgtccactccatctgaccttgtaacttacgggttttactaaggtcatcttgtgagacctgtgtactaggagcagtgtcattgatgtatttagtgtactttggtataggagtgctcacacaaatgtgtttcagttattttttagtagactctgccggcaaggtggtgacaaaccaggacggagttttccgcagcaactgcatggattgtctagacagaacgaatgtgatacagagtttattagctcgacgttcccttcaggcacagctgcaggtgaatattactttactgaaaaaaattgtagttaaaaaaaagtaaagaacctttacttttgaaaaccagcaacaataagtactcacattgcctgcaccctaacctgactgttttatttttgtaccttgccattggtgtacaagttatccataactaccatcagagcacatttgtagttttcactgcaccgtgtcctttagtatttctgtaatcatagttttaatatagtatatattgaactataatttattaaaccattaatgttactatatttgggggcatcaagtaatactataatgtatctatttttaatattattaacttgaatactttcctttgggttttagttgcctttccagtcactttaagcaagctgacaaaatcgatttagggagcaaaggtttattctagttcacaatttcaggttgttgtccatccctgtgaagtatattatgaatgtatccctggggagacatgaacaaaatatatattcattccagttagggaatccacaa

SEQ ID NO: 35522 - DNA, 2523 bp, Mus musculus
cctcagtattgctgggaccctgtcacagaggcaacaacttcttaaggtaccacagatgatggtttaccgagcctgcagaattgagacacctggtttaaaacttaagatgttctatttttcctgtggacatgctaataaacttcagtgtgaagttgtgctatacaactgatcactaggtctggtatcaacaaatgatgtattatctttgtttttaatatcaacaggtgacacttggacagaaacactggcatatgtcctcttctggggagttgcaagcattggaacattttttattattctttacaatggcaaagattttgttgatgctcccagactggtccagaaagaaaagatagactgaatttgtgtttgtggaaagcggcttggcttggaagactccatgatgcagaactggagtctttactgacctgctttccacgtgagcccaaggtcttcttaaagcctttatccaaaagtacctcctgtggttttgggctgggtgatgtcttagaattgatctgatattaccgctttgatgatctcgttaccgttgggatggttatatttatgatttgaagctatagtataattaaaatgtagcttaaattcagctcacagaacagaagaaatctattcactgtcaagtcagaattcacagataagtaatatattttaaaaaatttaacttctttcacattatttaaaacaaattatttttctagctctgtttcattattgccattgtaaagcagtcactgttagcaagcatattttccatgtatctttgggcttttcttaagagtttaataatatgcaaattctactatgcttatagagtgtctcttaaaggtcaagcagtttgctaaattgtaatttcacaattgtaaggaagaggagaatgggatctagagtcatttgaagtttctagtagctgcctcttggcttcagccagcttgagctgctgtagtgcccgagcagcttatatgtcatgaaaagttcagatatagtttatcttttttaaaaggtataaatgaaatcaaagaatgtaaagtctgtctcttatgctaaaggtccaaagtcgcctctttttaagaactgctccattgtgggaaatacactagactggccagctgcttcctctcctagcttgtaggattttttattattggttcctcattgagacatgcaggcctcagagaaggtcttgtactagatttgattctcacttggggtagcagttgcttttccatgcatggcactctggctctatcaccctgtcaaggtttatgttggctgtcaataagtgtctgaaatttagtgcttccaggtagccatagttctccaaatcaaggaccaactttaatttatgcataaaacagactgaaaactacgcttcagaagctgtgcatagttgtaagacaggttctagattaaaattgtaattatgaggtttagatattagaacagtatataaggtagtatcattgcactatcttaaaacaattcagttaaacactgctatggtacatcagtgttttgctttaaaatatgtaggttttctaatagtaccttatgttatccataaatatttctaaaagcgcctttaacattaccttttttcaacattatcttttataaacaataagggttattgcttttaggaactctggggaaattctgtgtagcttaaaatcagtcattaaaactcacaatagagtaagtaaatagagccacctgttctgacatgtaaataagcatagtttgttccaaagatggaacattgaagcccagctgtgtctactgtaatatattactcaaaagctactgggcgttttacagtaagcacttcatgtcaacagctacagcaaacaccaaatctgaaccactagtgtggctgcttcgcaaggactaatgtcagagggttaggctgcaagtgatcagtgtttgacagccctgcagtgatcttctttaactcatttactgtacatccatatgcaaaaataaaatgccatattcttttctaaccgctgttggtactgtttctctgtttttatcgtgttttttttttaatcttaaagcagtgtttgatcattatagaaatactagtcactacaagtaaacaaggtaaataacttctaaactgttttccagtaatcaccttagacactttttatagctttgtttttttatagataaggctaaggcaacatttagtaatatataacatttagtgatgtttaatatccataaaattatctgtactttcaaattataatttgtttcaaagagatacaggttgcagggtgataaggaagtatgggtgagtaattgctacagattgtaaccaatgaatgggaaaatagtatgtattttcttctgtgctcgcttccaaggacaagttttgacagttgtcacttcaggtctcattctatccatgatcaattttgggtaatagactgagaggtcagcctggtatgtgatgtcaagtgacctttaaatctcaatgactgttttttgttttta

SEQ ID NO: 35523 - DNA, 1225 bp, Mus musculus
catcgctgaaggctctcgtaactctaccgtcatgtctaagtccgagtctcccaaggagccagaacagctgcggaagctcttcatcggagggctgagcttcgaaacaaccgacgagagtctgaggagccattttgagcaatggggaacactaacagactgtgtggtaatgagagatccaaacaccaagagatccaggggctttgggtttgtcacatatgccactgtggaagaagtggatgctgccatgaatgcaagaccacacaaggtggatggaagagttgtggaacctaagagagctgtctcaagagaagattctcagcgaccaggtgcccacttaactgtgaaaaagatctttgttggtggtattaaagaagacactgaagaacatcacctacgagattattttgagcagtatgggaagattgaagtgatagaaattatgactgacagaggcagtgggaaaaagaggggctttgcttttgttacctttgatgaccatgactctgtggataagattgttattcagaaataccatactgtgaatggccacaactgtgaagtaagaaaggctctgtcgaagcaagagatggctagtgcttcatccagtcagagaggtcgcagtggttctggaaactttggtggtggtcgtggaggcggttttggtggcaatgacaattttggtcgaggagggaacttcagtggtcgtggtggctttggtggcagccgtggtggtggtggatatggtggcagtggggatggctataatggatttggcaatgatggaagcaattttggaggtggtggaagctacaatgattttggcaattacaacaatcagtcttccaattttgggccgatgaagggaggaaactttggaggcaggagctctggcccttatggtggtggaggccagtactttgctaaaccacggaaccaaggtggctatggcggttccagcagcagcagtagctatggcagtggcaggaggttctaattacatacagccaggaaacaaagcttagcaggagaggagagccagagaagtgacagggaagctacaggttacaacagatttgtgaactcagccaagcacagtggtggcagggcctagctgctacaaagaagacatgttttagacaatactcatgtgtgtgggcaaaaactccaggactgtatttgtgactgactaattgtataacaggttattttagtttctgttctgtgg

SEQ ID NO: 35524 - DNA, 1235 bp, Mus musculus
aagcacaaggccctcaaggtgaccatcactgtcctcactgtcttcattatgtctcagttcccctacaactccattcttgtagtgcaggctgttgacgcttatgccatgttcatctccaactgcactatttccaccaatattgacatctgcttccaggttactcagactattgcattcttccacagttgtctgaacccagttctctatgtttttgttggcgagagattccgaagggatctggtgaagaccctgaagaacctgggatgcattagccaggcccagtgggtttcattcacaaggagagagggtagcttgaagctttcttctatgctactggagacaacttcgggggctctctccctatgagagaacttctcacagggcatatggtcctttttggaaataatgagatatatagccacaacacagtctaaagagacagtaaatagtaagaaaactgggggtggagggcaggaaaaacaaaacaaacaatctgggatgagcctaaacaacttttatcatgttcagtcagaatctaccaaagtttccaaaactgagcactccagaagcgcagcagttggtttttggttatagtaactgcagttctgaggaggatgcttgagcagcagcaaagacagcccagccttgcacatgctgatcatcagtgcagctgggttttggaggcagagtttcttcagtgttcccagtttctgttacttcagatctggtgctactcctctttagaggtgacagaacactggctgccaccatggtcccccctcatggcccccaaaaaaggcttattgataaccacctcaggatcttttctctatagtcctactggtgagaagactgtttgtatgtctcattacctacagattttattttattttttaaatctagaatacactcaaacattctgaggttgaatgccattctgattgatctctttgatctctcttgagccagggagaaccactgtccctagtttggagccacctgtcagacaggttagtcagccaatgtacagctgaccacatcacattacctggagtcttgctcccaatccacttctgtgtcaggcagaagataccatgtccaaacctagctgcaagcacaaactaggaaaggatctagcctgttccctggtgtggccctcacagaattaagctggagaatatgtttggatggtgggaacctagcctttgggacttcctcaggcaagaggcacttgc

SEQ ID NO: 35525 - DNA, 2184 bp, Mus musculus
ttctaggacaggcaaatagatagcttagatagcttcctgttctctctggccccttcttactcctaccaccaagaatttacccatgatggcaactttgttcagtgtgaagaagccagcatgttcagctgagcctttgaaggctaccctgggttcttgtgggtctgtatgtggcctgagattgctaaaagccaaattatcttacctttgaacccttctaccctcttgcaaatggaatgctgaagccagcttgttcaatagatcaacagcatccagtaccaaataggatctcatttttattgcttggattttccagggtatattggagacactggccaaactcatggccttctgctggtgtcactgccaccatcttcatcaagagccatcattcactgagttgctgctgtgttggtggcctgggaggggcctgagaccttacatttgagttcatcctgaactcagtcactcatcaggaggcccatgtggttcttgtgaagctcagacctgaggtgagaggctccagtgctgactgcatagtactccactaggcatataccaactctgtttttaatagtctatttttgtgctaaatgggctttgtactgtacttgctccagtctgctgagcactaggttactagagaacatttggccctgtgtaagtgtgcctttcatacatagctttatggttttaagtagtccccagttttactggggtttagtcattggagtaaatttttgaaaaatgcaattgacaactgaagaatcattaaggaagatgatggcccagctggatttaattacaccaaagatcataaggaaacatccttgagatcttggtgattctcttcctgagggcagcctctcctctaatgactcagcctattcctaacagtcaggtcagtagtgttgccagctgcctgctcgccaataccactgaagcactatgagacttcacccaccttgagacagagtggccctccgtgtctgagtggactttgagagtattgctgactgaagtacccaggattctagctagtcctagaccaagagcaggcaaaggaattctcaaacaggaatctggaactgaaaatttccatatggttttggaggtagaaatgaagagccatatataaacaaagatgttatttctgaacaatttcaattgcccccccccccaggtaatcaaaccactcctggcccaaaaagaaggaaatcgtgtagatatggtttgatgatcatagggttttgtttttaaactcaaactcagtggttcaacctgtgagaattctttaaactgagaaaaaaacattcttggctcacaggttttggaaaaggaggcagagaggagagacatctttgactcctcagaaccagggagtgcaatacaaagactattgagtgctgctcacatttacaaaaacgaacactacttggtagaatcttagcacactttccttgtctcatttcatttcttctgaggaaacaggaaagttaattcataatttccttttccctctcaagcactttttaaatttccagagacctctgatcaagggtcatttttagagccttttgatgtgtgtttaatctcactcaatgttcttttggtgactgcagtgatactgagcctccgtgggaaggcttaacagttagagtgcactttaattcattaattcacgatccatgtggccttataataatgggtcaaggaacccatttcattcttgcctgccaaagagttacacagaagcacatcaaacaccagcacttcacctgcacgaagggatgagactgggatccctgagtaaacttctttaatagtgtgtgctatgccatttggaaatgttttttaacctcaggttttaaataaagcaaatactgtggcatttggagtagcattgtcttttattcctctgacaaaaataagtcgtaaaataagcgacagagctacccagcaggaagcagaacatctcacaggccccacccccaacccatcccagctcaccccacccccacctccccgcagataagagtgtgactgataggtcctggcaaacttcctggtcctctctgaggtattgagacctgtccaagcctgtgattccttccacctaccatcctctgccattcataaggctccagacctctctcatgacatcagagcactcaaacttttcaacct

SEQ ID NO: 35526 - DNA, 1241 bp, Mus musculus
gtccatccttttatctcagctccaaactttgtctctgtatctccttccaagggtgttttgttcccacttctaaggaggggcatagtgttcacacttcagtcttcatttttcttgagtttcatgtgtttaggaaattgtatcttatatcttgggtatcttaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcacctgggttccttccagcttctggctattataaataaggctgctatgaacatagtggagcatgtgtccttcttaccagttggggcatcttctggatatatgcccaggagaggtattgctggatcctccggtagtactatatccagttttctgaggaaccgccagactgatttccagagtggttgtacaagcctgcaatcccaccaacaatgggaagcctagggcgtgggcccgggtggagccgctgcaggtgcagatcttggtggtagtagcaaatattcaaacgagatatttctatcttcggagttcttctttggtttgtatcttcagagacttacgttcttatcatagagaactttcacttccttagagtcaccacaaggtttttgatatcatttgtgactattgtgaagggtgttgtgtactgggtagttttgtgtcaacttgacacagctggagttatcacagagaaagagcttcagttgaggaaatgcctccatgagatccaactgtaaggcattttctcaattagtgatcaagggggaaaggccccttgtgagtggggccatctctggactggtagtcttgggttttataagagagcaggctgagcaagccaggtgaggcaagccagtaaagaacatccctccatggcctctgcatcggctcctgctttctgacctgcttgagttccagtcctgacttccttggttatgaacagcagtatggaagtgtaagccaaataaaccctttcctccccaacttgcttcttagtcatgatgtttgtgcaggaatagaaaccctaagacatgttgtttctctaatttctttctcagcctgtttatcttttgtgtagaggaaggccattgacttgtttgagtt

SEQ ID NO: 35527 - DNA, 1210 bp, Mus musculus
tgtctacatggtccatccttttatctcagctccaaactttgtctctgtatctccttccaagggtgttttgttcccacttctaaggaggggcatagtgttcacacttcagtcttcatttttcttgagtttcatgtgtttaggaaattgtatcttatatcttgggtatcttaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttccttccagcttctggctattataaaaaaggctgctatgaacatagtggagcatgtgtccttcttaccagttggggcatcttctggatatatgcccaggagaggtattgctggatcctccggtagtactatatccagttttctgaggaaccgccagactgatttccagagtggttgtacaagcctgcaatcccaccaacaatgggaagcctagggcgcgggcccgggtggagctgctgcaggtgcagatcttggtggtagtagcaaatattcaaacgagatatttctatcttcggagttcttctttggtttgtatcttcagagatttagattcttatcatagagaactttcacttctttagagtcaccacaaggtttttgatatcatttgtgactattgtgaagggtgttgtgtactgggtagttttgtgtcaacttgacacagctggagttatcacagagaaagagcttcagttgaggaaatgcctccatgagatccaactgtaaggcattttctcaattagtgatcaagggggaaaggccccttgtgagtggggccatctctggactggtagtcttgggttttataagagagcaggctgagcaagccaggtgaggcaagccagtaaagaacatccctccatggcctctgcatcggctcctgctttctgacctgcttgagttccagtcctgacttccttggttatgaacagcagtatggaagtgtaagccaaataaaccctttcctccccaacttgcttcttagtcatgatgtttgtgcaggaatagaaaccctaagacatgttgtttctctaatttctttctcagcctgt

SEQ ID NO: 35528 - DNA, 1134 bp, Mus musculus
agccatagggctacacctcagggagtgactcgacgtaatgggaaagagcaatacgtgccacccagatcaccgaagtaaaaacaaagcctacaaaaactactcagaagcttctcttcccactaaacttgagcctctgttgaactgttttggaggggaggaagtagccaggaaagaatgggaagtaagccctaaatatgacggatttttgaaattgcgagtaggaagagcccaaaattcatctctaaatgattttcaaatgctggaggattccaatcagtatatatatatatatatatatatatatatatatatatatatatatatataatttttctatttttgttttttattttaatttgcaggaattttctgcctggaatcaattttgagggttcagatttagcttgggagagaaaacaaaaaacattatacatccttcagtataggagatgagggagtgagagaaaatattttttgaagaaacatttctgtaaaaattagaaattactttttataatctatttaaagtttggcttgaagaatgctatctctgactaaatggccttgtgttgcagagtagatgagtggctagggagtccgttctgggtccgagtgtgtgcaaaagtgatttaagccaaatctgttgtcatggtagtaaatgatttcaacgctgaatgtaatacttgagtagattttctttgtagtttggaatttagttgtttttgttttttgacattactaatactgtattgtatgaacaagctataaagctctgattgtgtgtgaagctgtgactaccaatcagtttgatattcaaggaaagaatggagattattcaaaaaaaaattgaaaattctgttttagatctgaatactggataggtcaaatagattgcagaggtttaaactgccctgtgaccttttttttcctttttaattttttttctgattgtttgttagtctctgttcttagactgtcttccctccaaaagcaaaatgactaactgtttactagacagtatgtttcttactactttgaccagtttaatcaaattatataactattctaagctacataatggaatattgaaagatttttattcaattagaattttaggtcccaggatggtactga

SEQ ID NO: 35529 - DNA, 1271 bp, Mus musculus
gacacagatgcgcagcaggcttttaaatacttaagagaagaagttaaaacatttcagggcaagccaatcatggcaaggataaaagccatcaatacattttttgctaagaatggttatcgattaatggattctagtatgtatactcaacctattcagactcctacccaatatccctcaccagtcttcatgcaaccagtgtataatcctcagcagtactcagtgtatagtcttgtgcctcagtcttggtctccaagtcctgcaccttactttgaaacaccactggctccctttcccaatgatagttttgtgaatgactttagttcaccaggatcttacaaaacaaatgctgctgctatgaatatgggctgaccattcccaaaaaatcctgtgaagcctcattttaggtcatccagtggttcagaacactcaacagagggctccgtgtcattgggagatggaccactgagcagatctagttcaaggatctttctttctgaacggcataacccaacagtaacagggcagcaggaacaaacttatcttccaaaggaggctcccattttacagatggaacagaatggggactttggaagaggcagacgaactctcttcagaggccgaaggcgaagggatgatgacaggatcccaagaccccaacctgcagcaactgaagccaaggctccaactccgaagtttgacttgcttgctacaaatttccctcctttacctggaagctcatcgagagtgccagatgaacttggtttggagaatagaatgtctgatgtcgttaaaggtgtctgcagagaaaaggacagcaaggacgtgcgagttagttgcccagtgcctggagaggacggacagacagactgcacttctgcgccgctcagcataagtcctagttctccgtgtacagctgagcctcctgtgttaagcacaactcagcaagagcaggatcagatggaggactctgctgttccaaaggacactctcaacccagtagctgtgccagtgtcttctccaactgccacaaagccatccccggcaaacactgcttcaccttgcactagtaacataaacccaccgagagtggtggccctgcaggaacctcgaaagttaagctatgctgaagtgtgccagaagcctcctaaagagccatctccagttctcctacagccgctgcgggaactccggtctaatgcagtatcccccaccagaaatgaagagaacggagctcccgagaagcctgttgagaagccgcatgagaaaccaga

SEQ ID NO: 35530 - DNA, 2248 bp, Mus musculus
tcaatgagatactctttttaaactagattaagatacttctatgtagcggttaacagtttatttactatgtggctatcagcctgaattatctctagtcttaaaggtagaatttatcatttttttctgtatcttcattgttactttccttttgataaccactagtttcataatttttataggaaggtgtttgtgtgcatgcgtgtgcatgtgcctacattgcacttgccttagagcctgcgagggctttctaaacaccaagtgacaggtgcacttagtctgtccattgcaagaattttaaatataaacttgttaaatgtatgtttgtttctttttccagatgaaccgaggcatgctcaagatcacactgaaatcatcattgatgtgaacccagtatccagtggtattgtcaagttcaccggagcaccattaaggttgccaaggagaccgctcattctggttttccttctacatcttggaacactcttctgtctatcttaccaacgttttttgctctggttgttgtactattgtgtgtgaacggacttaattcagcacctatagcctttcgttgtgcttttctgatgtgtctgctttcttcattacacctttgagagcaatgactatttttccttactctgcatattctgcatccaagacactacttgaaatatggttggcatcactggaggtctttgattctattagtattttgtaatctctttgtggctaaacatttccctcccaatctggtgctagtagagtatccgctgtctaagcaccacgtgtgtagctcatgtgtattcggtgttgcagaaacatttcaggacagtttgagatgttccagaacaagaattagtattcatttatatgtcataccacacaatggctggcatggttttaatattatgtcatcatttagggtaacattttatagaattagtccttcacctaacaactttagtgtttttgtactgttgctaatttgcttaaaattttattcaaaaggtatcacttggtataaaggtaattgtaacacattacaatgaaaacctattgtgagtttttataaaaaataaattttaaattaatatacaaagaataatacatttaattttttttgcagtgctctacttctgaaatgtcaccttaacatttccttgcagaaaattctggggttgtttttgttgttgttgttgttgtttacagattcaatattctgtattatttgatgatgagcacgaaaaaaaaaaaacctgctactgaagcagttttcagagctaattgtgccatttagttgcttaagtgtcttttgcctctctcactttttcagttggctgtggttctcatccctttcctagtacagtggtctggctggctcctcagtaccacaagctctctgcatgtttatgcagaggagagtgagtgctaaattggtgtcccttagaaaggcttcagggaaagagactgctgtaaaggggaatgcaaaataaagagtttaaatgaggaagctcagtttgactctttccagaagaataactttatgccaaggacaaagacatttcagagttttgtcacagggtgtgtgatgtcaacactcttactcagctcatcctgagggttccaaagaggttctgatatggctggtggttgtgtctcgctttttcattataaaccattagatttggaaaggcctgaactccaatttagtgttaacacccttcctcatggtaccagtgaaatgtattgtgtccccatatcttacagacgttaaaataaaaccacacattctaatttgctggagtttctatttgtgacatgtactatgtggatgtgctttctaaagaaacccttatcttttagaaaactgtactgaaaatttacagagatgctactgttatttgcttcaatataatcagggtggtatacgtttgtacatagatgaaacaagactgactctgacttgataattgttgaagctgtgtgatagatgtttgagaattcattattctctatacttttgtatatgtttgaaattttccataataaaaattgtaaaactgtattccttagaagttacttggaggccaactctcccttttagaatctacgtatggatggctggtcagaataagaattcacaacacagaaatataagcctattctttttttttttctcagctgaaattttatttttgctttcagttcttatctatgtgctttagaaaatatgctctggaccaattccctc

SEQ ID NO: 35531 - DNA, 1279 bp, Mus musculus
agtagttacacctctcagagccagaaagaaatccagaggctatgtagtgttttgagatgggatacatgcaaggcaaacatgaggcactccaggataattttaaaagaaggaaatttgggggctgaagagatggctcagtgggaaagagcacttgctgagaaagcatgaagacctccattcagatcccaagctagatgaggccacacatgcctacagccactgtactgggtcagcaaagagacagaggagcctctggggcttgctgactaccaatctagccccaaaacagtgaaatccagattcagtgacagaacatgtctcaagggagcaagatggtaagatgaactgagtgatcatgaaggatatacaacatcctcctcaagtctccacttatatcttgcacacctgtttacatattcacccaccacacacacacacacacacacacacacacacacacacacacacatacacacacattaggaaaatccagccactttcagaagtttatctataaaaattaacacaaaatgctgaattgtctttaaattctaaggtagtctacggccataccaccctgaacgcacccgatctcgtctgatctcagaagttaagcagggtccggcctggttagtacttggatgggagaccgcctgggaataccgggtgctgtaggcttaaaaaaaatattctaaggtaatatgcttccttttatatggagccaggaagctaaattgtactgactcacaatctatacatttgattagttacagagatatgggacagttctgtgatcattatattatttcattttgtgcaatgactacaagtgtattttcagatttgttaatctgtataaaaatcttacctttattcttctctctctctctctctctctcacacacacacacacacacacacacacacacacacacacacacacacacacacctttttgagataggagcttatatatccaaggctggccttgtcccatctccacctccctagttctgggactataagtgtgtaccaccaagcctggtttatgtggtgctgaggactcaatctcgggcttcctgcatggcagaatattgcctcagtcagctgctggtagggcttctcagaagacagccatgccaggctcctgtctgtaaagcacatcatattccacatacataccctaacaactgagctacatctccagcctcaacatttagtttttaattgataatatttgtacttatttataagttatggaattataatttggaaatgt

SEQ ID NO: 35532 - DNA, 1106 bp, Mus musculus
ttcttcatttacatttcaaatgttatcccctttcctagtttcctctctgaaaatcccctataccctcctcctccccctgctccccagcccacccactcctgcttcctggccctggcattcccctgtactggggcatgtaaagtttgcaagaccaaggggcctctcctcctactgatggctggctacgctatcttctgctacatatgcagctagagacacaaactctgggaggtactggttagttcatattgttcctcctatagggctgcaaaccccttcagctccttgggtacttactctagctcctccattgggggccctgtgttccatccaacagctgactgtgagcatccacttctgtatttgccaggcactggcatagcctcacaagagacagctataccagggtcttgtcatctttgttctattcttaagctcctccctgggaaactctgccttttgccatctctaccctgccatctccttctgaggccatgctttacactgtaatcctctcttctctgcattgctctgtggggtccaaccactgtgagcaccagctctccaggacatcatccagatggctccaggtggaaaggaccaacttcccctagaaactgtggtgaacctcaaatccacatgttagctacaaatggagggaacacgtgataatgatgatggttggggaagttaagaaggacccctcatgtgcaacctgaggtgtgaagaggggtgacagtagtggggaatcagggtgtctgtaggctgactggtttgctgaatatgtaaattgtgttccccaggttggcaatgaggagtgaggactatagcattcattaaaatgttggggaatgttgtgagacttgtaacacaacagccattctgcgtgttactctgtgttcagagtgggtatagtaatttttgtgcttgattcaagcacttcagcactatctgagatttgaagacattaaatcagtgtgagtatgtgtgtatgcatatatgtgtgtgagtgtgtgcacgtgcgtgtgtatgtgtgtgtttgtgcacgcgcatgcatgcacgtgtttttttacctttgcttaaacaagtccaaacgtgttctattt

SEQ ID NO: 35533 - DNA, 1151 bp, Mus musculus
cctcctagaagcctcatcttcaaatgccatgagatattaattggggggctaaattcccgacatatgaattgggagagggcatttaaaccatagcatgtatagaacaaaaagtatgtatttttgctatgcaaaatgaaaataaacagcttatagcaggtcatacttctgcgttaggcttgctattattttactgcaacttggaagatgtgtaatgaaagtaattttgcagcttaatgtggtgataaatttaaatatcagctgccaccagaaaaaagaaaggaatttaccaatgaatctcaaaatagcttggtagatggaggtagggcagagataagggagaggcttgtgtccatgtatgagttccatgtgagaatttaggatgagaggacaagaaacaccctagtggcattgcttttaaattgtcccagtgttcctgtacacacagggccctaaatgtctcctaactgattttctcccaagctgcatgtgcatttggtaaatattctaggacactggtcacacgtgaaaattacatttctgagcttccttttggcgttggttggcagattgactatttggggcagttgttcagttcttctcagatgtagaattgaaatacaaaggatgcatggtctctgacctcagggaatcttagcatgcatcacctggtcaagtttttaattcatagaagacagggaagacgtcatatactgcactcattacttgaatcctaatctgaaccattaccaaccccacacactgtggcttctattaagaacagagatttgccctaactggtggtgattggcaatggttgctgggtgactctgctaaaacaggaaggaagaaccaaagatagcaaagtcccgtagttgagggttggaggcacattgtacgagactctcctccttcctgtgtgttccagactcactggttccatcacagaaatatctgtatctatttcctgaccaggggcagtctagatagctggggatccaaagtttccattaaccctctctggtctggagtacttaaggagaaaatcccaagtgcccaattgattactattactttgctttatacaatacctgtgatactattttgattatctctattagtctgtttatgagttcttataaaactaaatcttg

SEQ ID NO: 35534 - DNA, 1171 bp, Mus musculus
gctgaattgttagtatgcagcctttctcattgctaccttagtattttcatgtcctaattctgtaacgttatgaacaaggtcttttctatttctctattcctttctgtaacatcaattctgcaatgagagctggagcccagacgccttttgggcgagctgaatgatgatccatcatgtataacttctatcctgtagtgggctatactccctacctgagaggaaccataaactcttatgtattctgcatatcaattggagaggagctggaatccttgtagcacaagaagctttgtctgggactgctacatcctgttagcctcaactcagcatttctctttgattatgaggcatgctccaccttgaactgctgttttcatatctgaggacatcaggtcttgtcctgcatctgtcctcataagtttaacattctgagtttaggagtaagatctcttgtgctgtaaaacaagcaaacataaacaaacaaacaagctgatgcttatatagagagaatgtgacaaaatagaaaagaatatttctaagaagaaacaaagtggtagaatagacttaaaaaaggataataataagctttaatacagtattgtataatatattagatacaatatcatgctaacatgttaaaaggaaaataaggaaaaaatctaaaactttaagattacaggtactgatatacctataaataaggtatattatctccatatttcaacaagttaagatgcccttttctcttatttgaagagaatttttaagccttaatagaacacagttgtaagattccttgccttcaagatgctcaagactgtgaagaaggcattttggtgtagagaacaaagtcctttctctactgcaggtgaggcaagccttcatctaccccaaacaagtgtcatcagtatcagaagataatgtttatatccttgacagggaaacatttgattatactctaatcattgatcttttacttgaaaaggttaatgaaaggcagtggcttagtgcctcctcgtacatagttataaaaacaacagtctggcctttaccaattttttgtagtgtatactttatagaccctttaccccaaaggcacagctgactaaaacagttaacatcttctttatcaggtaacatgagttacaaggccccttaataatttttcttt

SEQ ID NO: 35535 - DNA, 2984 bp, Mus musculus
atacattcacctcacaccagttccagggcctctaccaaatgtggcagcaggaggcacagaaggggagacttcacataaggagagcaagcatggagtccacccgagtattcttccctctggtaatagccaggcttaaacaaattggttccatgtgtaccctccccaacacctagttgatagctttgttaccgcggctttcgccctgttttcacatgatgatagacctgcctctttgtattgtaacctgtcctgatatcactaggagtctcgtgccagggtttcactctctgattctctaacgtatctctattatagttgactttgcaatacagcttcgttactggggaagagggttcttatcatatttcaaatggtctttaatggtattgatttttatgttttctttttctttcttaactaatgaggtgagaaaaaacaagttaggcagaaggaaaatataagtctgagcccaccgtggctaaggaagcaagcgccaaagccttgaattcttcctaccatagttccgagtagctattaagtttctctccttggacttagagcctcctaaccatagctcagctatgtgcttccttgagggctggatgactataaccttaacattcctgagtagggttcagtgttttttaactgccttttgaaaccagagtctcctataactgaaagatacaggatacatgaaggaaggaaggtgggtgggtgtggaaggcgctcttctaacaactgctttcccagccagtggctagctcaaggaaccaaaaccatgagagtattttcagccagggccaggcctcggagcaaattatgattcacccaggatctagacatacactatccttccttgtcttcggggcctatgtactaaagcatcccttcgggtggatgcctgaaatcctcaatagtaccaatgcttgtaaatagcacaattgttaatctcatcactgaggggactaataagtgactaaagaaaggctgcctgtatagcatggatacactggataaatatatgattgatggtccatgtgggatggagcaagctttcatcacactgcacagaatggcacataatttaaaactgatcagccatttgactctacgatgttccatttaatattgtcaaccatggttgagcatgagaacggaaactctggaaagtcaaactgcaggtaagagggattgatgcgcaaagcactaaagctgttgctctcgccaagacctgacgttggtagccagcttctatcctggaaaagcatccaagtgagcaatagcaagaggggactcatcaccaaaccgcccttctatcttgctcagtcttctgttccctactaactgggtacattccttgatgatgtcgcctaacgatctctcaaaagcccaaaacaaccaagccctggcatcaccacctgtcacagctgagttcctcagggtccttggacattccctgtagcttcagtgttactttattcaaccaaagaattggccaaggaacttcacagctgctacaaataccggccactctcttccattctctgcacactgtgtctgacagctatgggagaatcttggctggcgaggtattctaaagggatgggagccttttctatgagccattgggtatgctttttagtactgctgcctctgcaataagcactgtttatctctcagtactgccattctcccctcaagtgggagatcacaaattatcttcaacatgactctaaaagtatactgagcgctgaagctcagttgctgctatgctatgctatggtgtaccacaaagtactgtgcagcgctatgctgcgttatgctgttctgtgcttttctgttcagaatggctgagagtttacccaaagtaaaattgagaggggtgaggaactgtttgaataaaagccacacttgccttaccttttttaaatataatgggccctaggacaatcaataaggaagttgaaatgtcttatactagaatagtgagagttgtgtgttctgtcattccaagatgtgtttggctacagtagaacaaggaacattcactttactggatatcatggccataggctgggtatttgtagccttcgttaggtttattataccttaagtatatgataccaaaaatactgttaactgtggtttgtgtgtgtttgtttgtttgttgtgttggcattgttagagatggagcccaacaccttatatatactgggcaagtgtatcactgagctatagccccagccttaattctcagtttttatcacttgccccacctcaaaatggtttatacatttggaatcagaatacacggctgagtttccaaagtatttgaaagataacttcacaactatacagagctcaatagactgaactaacactggtatgccctactcctgctatggccttcccaaagtgagaatacaaaatgccagtgctattggcatgggttcattctctttctctctctctctctctctctctctctctctctctctctctctctctcgtcttgccttctgggatcagccatctttcaaggcctctgcgaagatagcagagcggcatggaagtacgttcagaggttgacccaccccctcaaaggttgctgatcatctactctttcccttcaaataaatctcattggataatacaaaagcagggtggtggatacaagggaatcaatgcaagattgtgatcatatgcctgttcttctcccatccccagggctgtaggtaattgactcccctcaagtactactattgaaggctcagctaagacataaaagtaaatacccaagtggagtctaaaggaatgggatagctttactgaaattaaagtcctaaaaagggagaaattggatgcacaggaaaggaaagagagtaaaaatatgaaaagcctctttgaagattggcttcatacttctgtttgccatttaacctcatatgccaagaaaggtgcctaaggggtaccagactttt

SEQ ID NO: 35536 - DNA, 2401 bp, Mus musculus
tgagtgggcacagcagagctggcagttgctggcctttgcttcccgatcagccatttgttccaaggagagcagctcttggaaaaatgtgattcacagtttcaagctactccccatccatatgctggccacattctccttcctaagtaactgcatctgggcaatgttctaaagagatcaagggaagaaaaggagattttcccatggtgtcggtaggattttgccaaatcctccaagaaggatgtgatatatggaccttccttccttcttccttcctttttttcatttccctctttctcccccaccccatggggcctatcaggttaccctgtccagcccaaccttacagttaaaacttcctacctcgaagttgctaccaaagggtctttggcctgcgtgtgcacacttgtcaaatgaatgccctgactaatgtttggcttcttgaggagaacctgtgtgatggtacagataggcaaaaggacagtttgcctctgcctcttcctttgctcctcctaccatgcatattctaccttcagctctcttcccattgttctgaccatgttgtttcaatatgactgtggtgggtagggacgcaatgaccccccaagaacagagaatggaacctccccagctggtgagaggccattggcagtttgctcagtccacagtaagggccaaagccagaaatccttactgggagtgccgagggctttagctgtattatacattagttcagatgtgctgggttaagaagtagtttaggatctaatgagaaaaaaaaatgccgtttagtgaaatggagaagaaaacagaacctgtgtttttttttttgtttttgtttttgtttttaatcaaagtggtagtgttcagcgttgccgtcaagtagagggtacctcaaaatatatggtccttgtccctcgttctctttcttaccttccacttttctttcttctccattgtcctgccttttttagtactcagctttttatatataagtatttacttttttttaagctatatatttggtcctttgggactgtgtgatgattaaattgtattccattcaagataaaactatatgtttaatattgtattctctaaagttgtcttttgaagctatgctgctatccaggtacaagccagaaaggaattgggcctgacagcatcttggtcatgtcaccagagggtgactctgatgtcatgataatgactcttattgatttgaccaaggccagcctcctgtttatacctctgcccattcatttctggccatgggaaatataccagctattgggtgagccattgaagccaggaggatcagaagggccagggtccagcccatggacaccatgtgaatttctctgtaggaagctcatttggagggctggcttcagtcgcagtagccaaagaaaaatctgtctgactggacctttgaattcctaagagttggtcaaagttccgctgaagcttatgcgtagatatctgtagctgcttggcatccggaaatgagcttcaaccaaagctaatacagtcccgagtttccaccggaagcttggtgctgagctgttcagaccagtcctttattagagggttgccaatctttcagccacgcttttgtacctttattctcacctgctcatagacatagcctgatccaaaactgtggcttactgctcgctctgctctgctcactggtcatgtatagtgacatagtgtaaaaaggaaaaaaaaaaaaaagattggggagttaggtgacctggtttgtattccctatgcttctactaactagcctcaagatcttaaccgctctgtgcctcagtgttcccatctgcaaaatggggatagtgtaaattgccctacctacctcacagggttgttgtgaggataaactgagacaatgaatggaaagcacttttgacaagtaagtgctatgcaaagtgttaagaaatggaaccaatctagttcaaggcaatggaatggacattagcagaagggttaatgggatcgtccagccctttctctgtgtggcttaaacctaggttgccattgctttatacattttcacttagcacagatttgtaattatgcatgaaataaagcacagccttatccaacttgattcaagtctgtttctgaagaccttgaacattttgagtgttgatttttgaccatcaaaaacacaaggccacggtgtggggcttggggaatcgttttaaaagagacctaggggctggagagatgactcagtggtttagagcacgtgttgctcttgcagcgggcccaggttcaattcccagcagccacatgatggctcataaccatctgcagccccagtctcagagcatctgatgatctcttttggcctccacaggcaccaggcacacatgtggtgcatatacataca

SEQ ID NO: 35537 - DNA, 1097 bp, Mus musculus
catgaccacctagtgtattatgtggagatcaaagttcctgtcttgtcaaagttcctgtgggttgcaggttcggtcagtacctttctttagtggtcctgcctcacgaaggtttgcaaagcaggaaacattactgtgtcaggtatttgatggccagggaaggtttggtcctatctcagagagcagcggtggcatggagagtatcttgtttgcttttgtatctctttagttctttctttttgttgtacccagacgagccagtgttaaggtgctactccggagaataaatctaagaactcagataacactgtgcgaacggatactttctagatgctaagcaccagtaggccctccaaataatttgacaacatccctttgatacctcactccttagaaatatcattcattaatcttagtttctcaggaatccttgcagcttgtatgctagaaatagctgtagtgtatggtgtccattgtctgtctgatcttatggtttagctcaaaggttaacgcgttccgacaggagtactctccaagattgctagcctagcacctggacacacagtggctcttgtcttgaggtaaagggggctctttcctgtcattgccattccattccatcaattagatattcctaaaaacaaaacaaaacaacaaaacacaaagccaatagagggaagtctgtcagtagcctcaaatgactacatacctcaagggtaaaatactggataattgaagcttttcaagtgaattgagacaagtttattttggtactggaaaaggaaatagcctgatgtaaggaaagtgtttacagaagaatgccaataaatgcctcaagagtgtgaattttcctaagcactaaatctggaggaagtctagctgtgagggctagatttatggatcttttaacagtcttaactgctaaattttatatctttacaccttcaatggaaagagcttaatgaagctgagagagattgcatagtgagctcaattggagattaacaaacagaggactggtgatgtgaaataatcgctattagagatcatttctactttgatatttggttagaaaccgccaaattgaaacgccctccccc

SEQ ID NO: 35538 - DNA, 1082 bp, Mus musculus
tttgttacgtttaccttctcatcagaagacagtgctgctttggtctgtctgccccaagtgaagtaaaggggttgactttgggggcctgcttggcttggtcttttgaagtgcacaaagttaagttacagagctttctccttggccgaagaaaggctacttttccaaatggcaatgctaactagtagacgaggactttgttagaaatctgttagtagctaggaaccatttattccagttttcttgaaatgaagataagttctgagcaaaagtcggtggctaggaatgtcacgttgtgtgaagtcctaagccaatctcatacccagatgccacttccacagatgctcctgcttcaggcttctggaataagaacagtatctggaactgggtctaggctgaatactgggaaagtggggaaaattcagagctacattagcatcccggtgcatttctttgaaaagaccaccagtactaaaataactggacgcctgtgctccactcggtgtggagtatgcacaacaggccattgttcctgtgagcatgaagcaagcttgagatacttccacgtgtatggaaggaactggaacgggttaggcaactgcaattaccttgaggtgccatccttagaaacctaactaaaatgcagagccatccttaaacctaggtgtagggatgaggcctgatgacaccaaaggtgcttgtacccagttaaaaaaaaaaggtgcctgtctcaatttcctaccacatctgtggcagtttagaaaaatcacattatagaaacacccggtggaattcacaagccaccaccagcattccaaccactctttcattttctatcattttatccatgtgcaattactctccctccattctgtttgcctctcttctcagcacagaatcctctttaggatggagcagtcagcttagttaatcattcctaataacaacaaaaatacctactagggttagttaaattgtaagccgaggctcagcagtctcacagcacttggactagaggtgacacccacacagcctttttgtttgccatggggccccattgctactgccatgcctccgtttccctc

SEQ ID NO: 35539 - DNA, 1086 bp, Mus musculus
atttttcattaatataattttaaattggtaataatgttgactattccaaacatacaacagaagaaaaacgtatggtaaggaactaaatgttatatgagctcacatatgtaaaaatacgtgtttttgtattagaaaaaaacttgaaaattttattctgcctattgacagctaaatttttataatgagcatgtgcaattagggaaaaaagcaatgatgtacttttttggttttgtttttttgtatgattgtttgtttgtttgtttgtttgtttttaacctacaaggctgcttttcctttgttactttgagaaattgaagtcatgtctactggagagccttgctttaatgcagtctggaatctgtgccgttattgctgagatcctatcctagcctctagtggttttctgtactgtagcaggcctgcagttgtactgactcccatgctttgcttcccctgtctgtttgctttgtaggtggggtgactcggatgactgtttctcttgttgtcataatgtttgaactgactggtggcctggaatatattgtgcctctgatggctgcagctatgacaagcaagtgggtggccgatgctcttgggcgagagggcatttatgatgcccacatccgtctcaatggatacccctttcttgaagccaaagaagaatttgctcataagactctggcaatggatgtgatgaagccccggagaaatgaccccttgctgactgtccttactcaggacagtatgactgtggaggatgtcgagaccataatcagcgaaaccacgtacagtggctttccggtggtagtgtcccgagagtcgcaaagacttgtaggctttgttcttcgaagagatctcattatttcaattggtaaggattttgggaaagggataaaggcacttgatagctggacatgaaatcagggacacagagggaagagagaggtccagttaaaggacagaatggagaactagcacttcagctttctacttttcatttccttctcttcccacagaaaatgctcggaagaaacaggacggggttgtgagcacttccatcatttatttcacggagcattcgcctcc

SEQ ID NO: 35540 - DNA, 1175 bp, Mus musculus
cttttgtggaagagccctcctcctcctcctcctcttcctcctcctcctcctcctcttcctcatcctcctcctcctcctcctccttcttcttcttcctcctcctccttcttccttcttccttcttccttcttccttcttccttcttccttcctcctcctcctcctcttcctcctcctcctcctccttcttattcttcttcctcctcctccttcttccttcttccttcttccttcttccttcttccttcttccttcttccttcctcctcctcctcctcctcttcctcctcctctcctcctcctcctccttcttcttcttcttcctcctcctccttcttccttcttccttcttccttcttccttcctcctcctcctcctcctcctcttcctcctcctctcctcctcctcctccttcttctttttttttggtgacacaattttttggcacattctgtgtggggtttaaagagatgcagtgatatgttgttgtttctagttcttgaagtaaaaccccaaactaatgtacatgctactcaagcattagtctactaaggagtcactcccaaagcccttcttcttaagacagggtctcattatttaccccagactgttcttgaactcatccccaagctggatggaactgtgatctgcttcctcaccctcctcagtggtatcataagcaagaactaccatagatgttactgtctcttaagctgttattgcctctctcgtggtggtataggaaggcatattaacatatgagtcctgggctggagagatggctcagcggttaagagcactgactgttcttctgagttcaaatcccagcaaccatatggtggctcacaaccatccgtaatgagatttcacgccctgttctggtgtgtctgaagaccgctacagtgtacttagattataataataaatctttttttaaaaaaaaatagatgtgggtcctaccgtcaggaacttatcacattttttcatggtttctgagtggtattatggaaataccttttccttaaagttccatcaaccttctatggcaaccccaaacactatagactgagtatcccttatccaaagtgctggtgagattgctcagtggataaaggtgcttgccaccaagcttgtcagccccaatctgattagttccaggaccacatgatgccacatg

SEQ ID NO: 35541 - DNA, 1145 bp, Mus musculus
gtgtgtgtgtgtgtgtgtgtgtgtgtgtgtcttctagagacagggtttctctgtgtagccccagctgttctagaactcgctctatgggccaggctgggctcaaactcagagatctgcctgcctccccctggagagtagtttaatacatattaatttatcctaaggaaagaattaaagatggtgctccaaggatatatgaatgaatatattaactgtagcattttcagtgtttggaaaattggtgacatttgtattctattacagtcatacagtggaatactgtagtttctaaaagtgatagtgccctacttattggcttagaaattgatttatgatatagtgttacatgaggagaaaagcagatttcaaatgattaatagttaaaagtctggttcattgtgtgtattagtatttctcagctccaccctcgctaatatattaaatgataagatagttgctagcctaatagttcccaactcctgtgctcatcagtattgtggattaaaaaaaaaaaaccttgaaactggggctggagagatggggctggctcagcagttgagagcacaggttgatcttccagaggacctgaggttgattcccagcacccacatggtggctcacagccatctttaactctagccccgtaggaatttgacactcttttctggcttctgagggcacggtggtacaaaggtgaacatgtgggcaaaatagccatacacataaaataaaataaaataaaataaaataaaataaattcagaccaatttaatctgattctctccaggtgttgtgtcatatgcctttaatcctgagatttgagaggcagatatctatgagttcaaagccagctggtctacactagtgacttctaggccagtcaaggccacatagtgagacgatatctttttaaaaaaatgattttcttggagtgggtggaaattaattagtatttttaaagccccccataccctcatgattttaatgtacaatcaaatttgcgaatcactaagtagtggttgaaaggatgaagtagggaaagttactgtttcatatatgggctcaatgtagagtagtaactattattgttatgattttaaattattaatagtgagataccactttcatgtatgtttttatgtcca

SEQ ID NO: 35542 - DNA, 1203 bp, Mus musculus
actgccttctgcctatgggttcctgctagctggaatcgtctcgacggctggcagaaatccaggagctgcaccacagtgttcgagcagctgcagaggaggctcgccggaaggaggaggtctataagcagctggtaaggcctactttagggccctgggttgtaagggtggttgtggtatagggcttgggctcacgcctgccatgttcccacctaggtgtcagagctggagactctgccaaaagatgtgtcccggctggcctatactcagcgcatcctggagattgtgggcaacatccggaagcagaaggaagagatcactaaggtatgatgtcactgtggctctgattgatggctcatgtaggcagacaagcataggggtgatcacacagggactttatgctcactactaggcagagctgttcaggcacactccaacacataatagtcaccccaacacagcgacatgggccctgactggatgtaagtataggcacgtgagtgttatcactgatcagctaccttgcccaagatgtgcactgatagttaccctggtttctaccagatcttgtcggacacaaaggaactgcagaaggaaatcaactctctctctgggaagctcgaccggacatttgcagtgactgatgagcttgtgttcaaggtatggagcaggctggcctccgggagggtggaggcgggactgagttgttgcctgcccctctgtgagtcctttaggtgcactgttgcttggggcctagctttgctctgtggaggatgaaggcaaagtactagtaaagggtggtcttataggggcatagagtagtggaaaagggggaatggcttgctgatatctcggagatcccctttgtcttatcaggatgctaagaaggatgatgctgttcggaaagcctacaagtacctagctgccctgcatgaggtgaggggagccatgtgcctggtgggttggctggagagggccagcataggtgcaagccttgtattcttgctgtctccagaattgcagtcagctcatccagaccattgaggacacaggcactatcatgagggaagttcgagatcttgaggagcaggtgagacctgggactggtaaggggaatggagacaggccaggggatagttccttgttttgcgctgagagtctttgaaaccagacaactaacagctagaggctttgccttcgtgccca

SEQ ID NO: 35543 - DNA, 1837 bp, Mus musculus
catccttcctcaggtgggacttcttaggagtcgggacagagcgcagagtcatgctttggtccaacttaggagagagaaccaggtggtggagctccactataacgccatctgccagtacatgggccccggtgactcagatgaagactgacacatggaccactgcccgtcgctcagatgccagggagaagacagatgttctgtcctcctttgagatgcaaggatggggatgtgactagatagagcagaactgtttaccaaactttagagtgtgataaaaaccattttaaatagtggaaagatgaaatcaaaaccagtatgtaaactgtaaatttgggtggaagctgagataatcaaagtggaaacacttcatttcttagcctcatttccctgctgagggttcaggacaagttaaattccccattcagtacatagtttacccttggaacatgaaatctatgaagtctgtccccagacaaacacaatagaatctgcaatgttgcatctcagaacaacttcctgagtttggatcttgaatggtcttcaaaggctcttttttttttaagatttattgtattttgttgttgttttatgtgtgtaagagagaacgagtatgtgattgtgaatacaaatgcttccagagagagagaaaatatgtgaatgctcagagaccattaatgttgagttccccaggagttgaagttacagacaattgtaagctgccctgcatgggagccctgcatgggagcagacttggatcctttggaagtacagtaagcactcttaagcactgagccacctctccagctcctgtgcccatatggtaaaggactcttgctcgggattatgctagtagcacatacgtttgacctctaggaatgtctctgggctgataatgcactgaagagaaaggggaacttctgcccatgaacagcacgggttggctccagtttccaaaggactagtcacttctagtccccgaacatggcttaggttaaaaggtatttctgactcgtgcactttctttgcttgccatgggtgattagattctttttaaaaaaaggttattgttgagaatcctgaacctttttcctgcttgatggttggagaagaaaagtcagagccttagacacaattgtttctagataatccctaatatatatagtatttaagttaggcctgtgccacaggttaaaatacccaacttgtcagcccgccacacacactgaaaagaatcaaaacatcccagaacacaatgagactggtaaatgtggctagaactgggctgaactctctggccaaaataaacagacaaaaggacatgagtcacacagagtgtggtggcccatatctgtaatctagcacttgagaggctgaggcaggaaaatttccacgagttccaagacagtctgaggagcttcactgaaaaacctagcaggaaatgtgctaggtgaagtagcacaccctttgagcttcgcaggcaggagagagaagtaggcagatctccatgagtgcgaagccagcctggtctacaaaacaggccccaggccagccagaactcctaataagaacctatctcaaataggaaaggatactgtggttttctcccttcctattgtcccttttatgtcttctcttatctaattgctatatctaagactttgatactgtaggggacaatggacatctcattcctgatttccgaggaaatgctcagtgtgtctatttaatataatgttggctatagatttattgtatatagccattattattttgacatatttccatgtatttctacagtctcacagcttttatcactgtcaaatggattttcagcact

SEQ ID NO: 35544 - DNA, 1191 bp, Mus musculus
gccgtcgcagccaccctgctgcctgcctggctgcagtgcttgccattagcctcttcattctctgggccgtgggtggcgccttcaccttcctgctcagcatcacagcgcctgtgttttgtgagtctcgactctccctgctagagctggggaagacggtcagctcatgcttgaacatcaggcctgcctggcactggtttctgaactaagagaggactagaaaccctggaggacagacatgcttccattaagtgtgtcttccttggctttggtcctctgggagcatccctctattacctttgtgggtgttccagggttaagtgccttaaactgtccaagtcccaatttactgggatgtccttcctggccacatcccccacagcaggctttgagaactcaccactccattagcctgcctctgagtgaattccccatttcttggtatcgcctacagtgatcctgctgcatgcttcactgcgtctgagaaaccttaaaaacaagattgagaacaagatcgagagcatcggtctaaagcggacaccaatgggattgcttctagaggcactgggacaggagcaggaagctggatcctaggaccttggcatctacaccctggacgtagaggacccccaccccatacccaagaccaacccttttcctagccattaaaataggtgcctagagtcctctggcctggccaaaaagagacacctgtgattgatcactgcagccccaaactagtcatctcttagcctccagcccctgttacctagggaccaaagtcttcctcggtcctgaatttgagactcagtcacctacttccagtcttgaaactggacttttaagccagagcatctgtggccaatctcaaaactggaccccaagatactcctctgacccaaatgtgggactcactagtcttccatacgtcaaagctaggccctaaggcaggacattctcaaatcttgagctctaaagatttttcagaccccacacagcttggaatataggttataagacctggccaaatcttgagcctaatgagtccacactgagcccttaaccccagacgaccctagccctcagcagtcccaatagcctccctccaaccgttaagagggtctcttcctccctcacagtgttctcagtatcaaggaccaacatgtggggctggctagggatagccccaactgg

SEQ ID NO: 35545 - DNA, 1200 bp, Mus musculus
gctaaaaggggctaggttcaacccgaccacgccttaaagcatctacctttacctgaattcaagaccgcggtgagcttgcgtactcaccttcctgttgcctactgttcaagccctcttttatcctcatgtcaggttactgcaactctccttgataaccactaagaccattaagccctgctggcctctctgccttcaatggcatatgcattagccataatccattctcaggcccatttttttcactggggagatgctgggacttagcttaccttggctgagctgagcaaggcgtgtacccaggcagacaccctgggcattgactagtgctcctgcagacagtggcagtggctggagcaccgggaggccaagacgggcccggaagtccctgagctgctcctccagctcgtgcagccttcgaagtgcatcaacctgtacctggcgcctgcgccgcctctgttctccgttgaggtcaggggccagggccaggcggcgggcagcagctgcaatctgctgctgcaccgatacctccctctccaaggcctcaagagccagttcctgcacaacccaaaaggggtggggggtgggacagaaccaaataatagaaatgactaagcacagtaatgggcagttggcagagcccatctacacaggaagcggagcatgatctttttaggggctggcctgtttgcctaaggaaggaatgtattcatcctcaggggacaggatgaggggcttgtctggatagacttgggttcccatagtgcatggggaaatccacctattcaaatccttgccctcctctctgcttcttctcctcctggccctaaccgccattgtgccctggcttgtccccgcccctcaccagcatcagctcacctcagcaggacacaaggagtggtgtgctgggtttgggtgtggtggagggtaggcacgtgctgcagggggcctccggcggaccaactgaggtcgttcaccaggctccagtgggcactcagggggcagctgaccagttagctcctggaaggaatgtggccagagactctgagagttagagggatgacattaagtaataagggtaagaaactagccctcccaaggagcttggccctgctcaatactccacatgtattagatcgccacctctcaaggtctctagcacccggggtagggcgtatagttctccagcgggccaagtctctg

SEQ ID NO: 35546 - DNA, 2579 bp, Mus musculus
cagggatacacagagaaaccctgtctggggggggggggtagcaaagagattctccaaatagtagtctaatgtatgtcgcatatatgttgacttgtgctgtaataagagctgtatgccccttaactcatttaatttccagaaacagccatatgagagaaccttccattattgtaccattttacagaggaggactctggggctcagagactaagcataaaatttggcaagtagtgagggccagaggatgcattggaacctagtagcctggcctttcaatgaagacactcttctacctgtgacgggctttgcaccccatcttactttgtacccaccccttcgtttttacaggagctagaactgcaggcccagatccatggtctgccagtccctcccaacccaggactgctctccctaaccacgagttcggtctctgacagcctcaagccagaacagctggacattgaggaggagggcaggcctagcacaacgttccatgtatcgggaggacctgcccagaacgctcctccacaacagcctccagcaccaccttcggatgcccttctggacctacactttcccagcgaccacttgggagacctgggggaccccttccacctagggctagaggacattctgatggaggaggaggggatggtgggaggactgtcagggggtgccctgtccccactgcgggctgcttctgaccccctgctttcttcagtatccccggctgtttccaaggccagcagccgccgtagcagcttcagcatggaagaggagtcctgatcaggcctcactcctccccctggatgagaccctgccttttttccctaccctcctgtgagactgtcctgtccaggaaatctgggggaagaggagttgcaatcaggccccaaccctgtaataggcaaggaggaggaatcaggtgaggccctgccccctttccattcgtggggaagaaggcaggagagagctgggaaatcacagttcatcacttgagcatcatagccttacccctcgcccctggtcctactcctgcctcggtgatagaaggaggcagggtaagggtatgcccctggccactagagatccttagaaacaggtctctgaaggaaaggagatgccaggatgctactccattccttctctgggaattgccagtccaacttttcctggcactggaagaaaaaaaataagtgtcccacccctggagggttaatccctatctcttccttttgacccctgacttgttctggcaaggaacagaagtaagggtgtgatccagcccgtccccctgggacccatcccttctctataggaaaagctcagcgcaggtattacaggtatggaggaattactaggctctgatctcccatgtagaggccccagtcctaaccctgacccttagcaggacaccgtgcaagcattccattcggcagggaggatcagttccttagctccctgccttaacctaggaccaacctgggacctgacctgtgaggactctgtgctgaccttattcttggggaagggaacagattttgacctagatcaagtgtaacttaggtcctcacccttgggacgaccttgccttttctgccttgaggggcagttttgggagatgaaagggattagtgtggacccagtctaggcaccccagtacttcccttcaccttgtagaaaatggtaatgaaagggcatgcccaggctctttagcagcccagggaaacagagaagtctcccttaaaggcagggcctgggaggaatggtggcaaaggtataatgtatccgtgttttgtttgtgaattttttattgaacccacccactcagatgctaagtcaaccctgacctctgccccatccacaccattctccattcgagagactacccctgtttcagagccagtccccacctagtcccgtccctgccacctacacccaaggtcttcagctttaagttgctggggccaggccccgaggagggtttactgaggggtctgtaggtttgactaaaataataaatgctaggcgtgtttgatgcgcttttaactttggcattgagtctcccgttcttgtttttaatggtgcaatgatcatggccccctgtgggtcaggagaaatcacaattctagaaaaaagtagaacagatttcagaggaccaaatagagaatttttagatagaaggagagcccagagggaaactacctgtaagcaaaagcaaagagcctgccatggatcagctgaactgctgtgctttcgcctcgttgatttccctgggggtattgctctgtatgcccgtttccttgccattcgctggtgggagaggcagtaccttctgcagacaggcagcctgtaagtgcgctacgctggaatgccatgtgcagagagagatacttactcttccttacagggctgtagttggagacccagctagccctccaacactctgccatgtccccagccttgcaggctcgctgataaagtatgtgaggtattcaacaaaaggtattcaagctcccacagacacaacaaagacaaaaacaaaaccagtgcaggtgggagcaagcattgccaccatg

SEQ ID NO: 35547 - DNA, 1465 bp, Mus musculus
tagtgggagcttgaagcatgggactccataggtccctggcctccttggcccagcatgctgggactggcctgtctctcctagttggcctcttgcatgcctcttcccttgggccctcagaggcagcttaaagctttctatagtctgacatttgaggtctgtctggtctgacaagagttaagagttcctcttctctttggttgtgttgtgcaagtttgggagttcagggaagagaaccctcatctccaatttagcctcgaggggcaaggttttgcccttcaacaggcccagcatttcccggatttggaagcttggaatgcaaccctgggctggcttaatgggctgtggcctctgtagtgacctgctaccctcatgctttggctgagggggtcaggctgcttctcccaacacagagatagcacaaacactaccaccccttttccctggctagctgctggaagtgagttcccaccacctgtcttctgctgggcctccagcaaactctagcaatagcagctgctgccataccaatatgcaaagccttggaccaatttgctgcagcatatacatctgctctgatcagatgggccacatctaactactctcttctctgatgtgctttcttcttgggttggtctggagtctggacctgctgagataagagactaacatccagcaagagctggactgggtggtgagatcatgggctggtttcatattcttgggcagaagtccagaagtagtgtgggcagaggactgaactgttcctgacccctgggagagatagaagatatcgcctccttctctgctgtaactcctttgcacactgtcttctcctccctcttgggtcaccttctggatctatgctctcgactgaatctcatgtcatctcaggttccctgtctccagctctgtccctctgaagctggcagctgacaaagatgaagttttcatcagtcaataaagcctaagaggagagatgtggactgagcatctactgactctgtggattgactttgagggctgggtttggctgaggggttaagaacactatggtctcaatttctttcagtcgaagagaaattcaacagtgaagggactggtgtgggtagatgggtggctagtgctctattttcgaagatgtggattatggagaaatgaaaaagggtgctttgaagagtttgtctctgtaggcagtgaagccagccagagggtcctaagcctgctggaccttagatactaatctgttccagatccttcattgctagaaggagaagccaagatttagagcaccatggagttactttgaggagcaacttaagcccatgcttcctgatagcaaaaaacctatacatttttttctgagtttggtaataaccccctttctcatggatagtgcctctgctgttctcttctggataccagctacaccaggctagtatgtgagtgagttgtggagagccctgtg

SEQ ID NO: 35548 - DNA, 1204 bp, Mus musculus
gctgtggggtacttggcggtgccgccatgactattctccccaaaaagaagccgccacctcccgacgccgacccggccaacgaaccgccgccgcccgggccgctgcccccggcgcctcggcgcggtgcgggtgtaggcgtgggtggcggcggcacgggtgtgggcggaggagagcgcgaccgtgactccggcgtcgtgggggcccgtccccgggcttcgccgccacctcagggcccgctcccggggccgcctggtgctcttcatcgttgggcactggccgtgccgcctggcgcagtcgcgggccctcggccacagcaggcttctccacctccttgtgggggccccggtggccccggcggcggtcctggtgacgctcttggtgcgacaactgcgggggtgggcgcggcaggggtggtggtgggcgtgggtggtaccgtgggcgtgggcggctgctgctcggggcccgggcacagcaagcggcggcgtcaagctcccggcgttggcgcagttggcggggccagtccggaacgtgaagaggtcggagcgggctacaacagtgaagacgagtatgaagctgccgcagcgcgaatcgaggccatggatcccgccactgtagaacaggtaagggctggaaggtgaggggctgttgggcagaaacagcgagtgagtctaccaggctgagaaggagcgcaagaaaatgtttgagattggtccaagaaacccaggtcttgatgctgggcttgacattctttcctggtggtggaggcatggcttcccccgaggacttgataggggctctaagttaagtaagttaaagtactcttttgcagtcctgagatcttctctaagtgactggcattgggaattccccaggagtcgcagatacgatggagcccttccttagaggaagctctcaggcctctctaagggactttggttcagtaactttttcctttaggacaagtgtgagattccctcccgcaaagaactcgaattaaggtggtgtcctcagagaaatagtctaagcatacccaagaaacttaaacccttgatgtaggaaggacctctctcttttgctgagtctgctcaccagccatgtggcctcctcaggagtcctaagcctgtatttggggacctagacttgcttgtagaattgaaggtttagagtatacccacacaccttttagatagtgatttccaaagta

SEQ ID NO: 35549 - DNA, 1150 bp, Mus musculus
gccatagaggagcaggtggctcgagaatcttaccttcagtggctgagggatcaagagaaacaggcccgccaggtccggggacccagccaggtgggtcatggactctgtcattggcctgaccaagacctgttacttcttatcttttgacccctaattgacagggataaaataagagattttgacatctgggagaaagggaagctcccagccccatctctaactcatctcatctttagtcttggcatcgtaccttggaactctcaacacttgattttaagaagtgaaggagagccagctcttaagaaacgaagagagcagctaccactgctggtagcacaaaggaacaatggatagctacaaagagagcagctttttttggaatccctttgcatgctgcattctgtcctgaggatatagtctttccttcactatcttcagtgatcctgtctgtctgttgaggcagatacggcattggtcaggcctgtgactctggttgtacaagaccaggagaggtggaggatccagtcggttgtatttctaggatagcaagcagggaggcaggcgcctggggaatcacagagggctttagaatgactaaatggttccagaagctgaataatctgatcagcgagtatttactatacgcctgtgacaggaagcaggaggtcctattcctagtgtagcgggctacattgtgaacctagcaggccaaagtacctatccttaggctactcacagttttactaagtgaaataaaatgctcataatgaataaattagttggaggtatggtggatgaaaaatggacacttggtacaggggacaattgagactgagtggagatggtctgagttcacggtattaaacagtcgtcggggtaggcctcagcagatgaggtgggggcagcctataaaaaggggatttggtagctgggggtgagggcagtggagttggtataactcagagtctgtagctgaacagaacgagggtgagatcagggtagtggggctaggttggatggtgacttgtgaattctggagaggactttgattttgctctcaatgagacagaaaccatggggggtgggctgtaaacacaaaaaggattcgagttaggacttgacaggatcaccctgaccgattatagagcaa

SEQ ID NO: 35550 - DNA, 3132 bp, Mus musculus
tgagggaaaatttcaggccccaaagattttctccacagtgggtctagtggggcttcacagagttgagggagtcaatgagtgattgggacctgaacggacttttccagagccagggatcagacagaaatcagggaaagtgacctgaggccccccatcatcgttgtcctcttctctctcctgcccagcaggtctgaatgattgggacgatgatgagatcctagcatcggtgctggcagtgtcccaacaggaatacctagacagtatgaagaaaaacaaagtgcacagagagccacccccagacaagagttgatggacacccagggactggacatcattcccgatcccccactcctgccctttgatgccacccaaacttctttggctttcttccctcttggcttccttcttttgtttcctcttttccttttttttttccacttccctctggccggcccacccatgcgctccatccatctcatccctgccaccaccattggtctctgccagctgaagtgccctattgcccccgcacagcaccatctcagcattccacaggggactctggaaagggtgcggaaggtaggcaagaggcccacagagacagaccatctggcagccaggcagccccagaagagagacattcagacaaaggaagtcttctgctcacccttccttaaagatcagataaacttgtcatcccttcccagcaatgatgacaggaaaatggaagtggcaagttttccttctagtatccgaagaatctgagccttcaatgttaaaatttttcttaattaaaatgtgctttatttcacaaaatcaacaaatcaaaaagaatattcatggcaacgttggtcctttgagggtggcatctctggtttggagctaggcaggctggccatgggacagaaagggcagaaaaaagatggatttctgctgtcttttggcccctagttccttggaagggcaaaggctatgaggtagagggaggtgacaggcattgcaggtggcagactgactttggacagtgagaccctgaccttgctgcattgctttgccttcaccaccgctagtctgtttggaaggcttgaggtggggtgtcttgggaaattagggccactacccaagatttgaatttagggagtgggagcagcctcagcagatggggcacccgtgcactgcaggtgttgacaagatccaccatctgtaatgtccttggcacaataaaaccaaatgtcagtttccctgagcaactctattctgtgtgggacacgggtggatgggcctctgggaagcacaggatttgctttgaccagaggtctgcttgttctccagtaggtgctctctgtaagctggggttcatatttgatcttctgtttattaaattaacttcttgtcttgagactgatggcagagaatctctagagcccaggtgggttaagactaacctaacccacataaccaagattgtttcttaaaagaacaaaaccaacaacaactctacaactggtcgtggtcatgcctttgatcccagcactgaggagggcagaggcagaggtggatcttttgagttgcaggccagctgggctatacagcaagacgcttttattaaaaatcataaacttcagaaccaaatcgactgaaactgaagtccctactcccacctaccatatttgcattagggagcctagggctaatttaaaggactgtatgagccagaggccaagactggtgtctgaatttctactctcaaccttaatgctcattcattcttgtgataatctgatgaaataagcaatcactaatgagttcagtgaccagaggtggcccttgcccaactgggttttaaacgttggaggatgaaatggctaaatcctttttttgttgtttgttcctcaggtctgttgacacctctgtccatacccctgctagggtttgtaaagcccagctagagaaggctggctggccctcaggtttcctcagagcagtcttctcccactccccaatgcctcagtgaggtcctttcagaagaaggctgtgtagggtggccctacggtgagggtatggcttgcccagtgggtggctacaggatatctgaaatacgtggtcaagcatgagcacgccaagagggttgattcatttcaaatctacctgccttgtctcactgtgtggctttgggctctctttgactttaaagtgtcccatctgcaactacaggggtcattaatgtctgctacctcatgctctctgatttgtgagtattgacagagaatgtgtatggtcaataatgtactactgggaacagtacctggtacactcttagagcacaaatgttggggttcttaccagactttaggggtgggggtattaccgtattttgtaagtttgtaccatttggcctcagcctgactcttgctactcttggcttttacttgcaatttgccctaaccctatcttcagcaagacaaagggatcacctgaaaaaaccctgtgtgatcccattggcactctcccttctgtctacgactattccgaagaactgtactataaataaacttctgggctggggctgtgatgcttacttatcttgtttgtgtgtgtcttaagatctcccctccactaaagcctgtcaggatcatagggagacacctagggatgctggctgagtaagggacattatgtgttaccttttctgctttgcgtgtattgtctgtgcctgtgactacattgagtcttgagtcaaccagtttctctgaattccagtgtctctggttgagtgtggatgtgtctgtttccgatgaggcttgtttccaggtgtatcagatggtgactgagtgtgggactctgcctatgacagtttgtgtctggtatccgagagaaagaaatgcatgtttgcgtgggtctctcagtgacagtacatctgtagtttgtctggatactttcagtgataagctgcgtgtctgatagtgtgtgattgggtccggcttttgttgatttgcttatctatgtggtgatttagagcccaaggatgactacgtacctgctttggagcagtgcgtgtatgtgtggaacaactgtatattcttgtgacagactctgggtctctcatttctggggcagcacaaatatttctgt

SEQ ID NO: 35551 - DNA, 1878 bp, Mus musculus
ctggggtgtagtactaaaccaagcctttggtgggcttctggtggctgttgttgtcaagtatgctgacaacatcctcaagggctttgccacctccctgtctattgtgctgtccactgttgcctccattcgcctctttggcttccacctggacccattatttgccctgggcgctgggctcgtcattggtgctgtctacctctacagccttccccgaggtgcagtcaaagccatagcctcggcctcggcctctgggccctgcattcaccagcagcctcctgggcagccaccaccaccgcagctgtcttctcgaggagacctcaccacggagccctttctgccaaagtcagtgctggtcaagtgagagctggtggtggttgggggaacagggcagggggttgggttggagggggttgggcttctgcaggtccaaaaagttgttgccagggcctggcttttgtgggttggaggtttattttctcccataattctagagggatatggaactagggctgaatgtcacatgaacgcttcctgatagatggactctcctctcctggaggagctttttagagctgcttcctctgccttgggctaacctctttgggaacagggttggggtactgctattccaggcctttcccccatgaccctgtgctggagatgtcctgtctcgcatgcctgggacagtccctcccagccatcctgcagactggataaaagccctgcagctctccaataacgactaatgactcctcgtggggttcatttcctattgtatgaggtcttctctcctgcaccatcaccctggatcatgacaacagcgtggtctctgctgtggctttggggcagtttccccggtacagagacccttgaagagcaatcagcctgttgtaagtgcccggaacgaggagagaggcacaagctgaggatttcgcatcagctcatcttggggagggtgcaataagtgccatttgctttccaatagtttgggatggagatttgtttgtgctatcattagatcaatgatccagcgtgttgggaaaatggggaggggaggtccttgaagtggctgaatctcatgtaattgacgagacagaggcgaaggattctcttcagaaacatccagacaaaaactaaagctgccgatccgcctgcagctccattggcgtttaaaacatcctttcaggatgggtgtcagaattgatgaaacatggaacctgcgcccctgcactccccaaagcttattaactccttaactgtatcccagatgtgtgtgtgtgtgtgtgttcgcgcgcgcgtggggatgtgtgtggatgtgtgcacgcacacttaagtgcatgcatggaaggtgcctgggctgtctttgctatatgtaaatagggccactggatctttatttttgattaatttgttctgattttttttttggtttgttttttaaggaactgtaatgaacaaatgtcaggatacccaatgccaaataaagatgatgtatttatttagtccatgtgtagctttctgacccaggggcctgctctttccacataagcaccattactaactccaagattagtagcttactaccagcctcgcttgcttaggaaacccacccaccggcccaccccagctttctgtgtttctctttccttcccattttcaccacaggttgctcaccaaggtgaaggggtcgtagctgctggacttgaagatgctggcctgtcttcgttctcccttcttgccctggcccaactgggactaaactcttatcagtattaggggtagggtgaggtagacacgggaactccctgtccttaccaacccctgccccacatagggctgacatgactaacctctgttaatgggcccacctctactcct

SEQ ID NO: 35552 - DNA, 1202 bp, Mus musculus
actcagagaaccctgtcttgaaaaacaaaagcaaaccaaaaagaaaaaaaaaaagaagaaagagcaaaagctgggcagtgctggtgcacgcctttaatcccagcacttgggaggcagaggcaggcagatttctgagttcgaggccagcctggtctacaaagtgagttccaggacagccagggctacacagagaaaccctgtctcgaaaacaaaagtccatgtggccgtattacagctctggggtggaggcccaggcgtcaaaagaagactccgtccctgtcactttctcctttgctgatgtctagatctttttacatttgctgttttttgttactgtcactaattacattttaaattatttttatttcatattttcatatatattttgatagtatctttcccttctctacctccactcagatcttctcttcatccctatccacttcattttatcttctgctgtttctttcttgagacaggctctcactttttagccctgcctgtcctggaattcactctgtaggccagggtggcctcgaactcagaggtctgcctgccttctctgttatccagatggactgctcccaggttctgacatgtgtaaacccttaagtggatgggataactcttgtctcttggggtccagttgcatatagaggcatagaaatttccactgtgactgttgcggtgcgaatgggctgtggataagtgctgggattaaaggggtatgcttccacaccttgcttgctgtttgtctttcaagacagggtctcacttgtatcaagtagcccaggctggcctccaacttgctatataacagtggcttgtcctgtgaactgatcttcctgccttagattcctaactgctatggggaaccagtggttttctttttatttgtttgtttgtttttaaaaataaggtctcgggctggagagatggctcagcgggtaagaacactgactgctcttccaaaggtcctgagttcaaatcccagcgaccacatggtggctcacaaccacccataatgagatctgacgcactcctctggtgtgtctaaagacagctacagtgtacttacatataataataaatctttaaaacaaaaaaaaaaaaacaaaaacaaaataaaaataaggtctcagtattattgtctagactgacttcaaaatcctcatccttttgtctcccaagtgccagaattg

SEQ ID NO: 35553 - DNA, 1633 bp, Mus musculus
tgccccgaggagaggcggcgggtgcggtgcaggagctggcgcgggcgctggcgcacctgctggaggccgagagacaggaacgcgcgcgtgctgaggcgcaggaggctgaggatcagcaggcgcgtgtcctggcgcagctgctgcgcgcctggggctctccgcgtgcctcggacccgcccttggcccccgacgatgacccggacgctccagctgcacagctcgcccgtgctctgctccgagctcgcctagacccggccgccctggcagcccaacttgtccccgcccctgccgctgcgccgcgaccccggcccccagtgtatgatgatggccccactggcccagacgtcgaggatgccggcgacgagactcctgacgtggaccctgagctgctgaggtgcggggaccaagggggagggagggcaagggcagagggcttcatgcactgggggtaaaatcactactaaagtgctgcgctggagcctgagaagtgaggtcgcgggtcctgagtacaaggggacggaagcccagggacccctgactggtgggacaatgcaggagtaagggctccccggagtggtggtggatcggtttctgcaggaagtggtcctggtggtgggcagtttctggaatggaaggccgggacctctgacttcctcggaaagtagtggtgagttccgcaggctcgagtgagggttacaagccatacggaattagaaaattgccttgtccgggttctgaaccacagcgatggcaaatacatcctgaccgcattccgcaatccttgcaggtacttgctagggcggatcctcaccggaagttcggagccagaggctgctcctgccccgcgccgcctccgccgatctgtggaccaggatttgggtcccgaggtgccccctgagaacgtactgggggctctgctacgcgtcaaacgcctggagaacccctcgccccaggcgccggcacgccgcctcctgcctccctgagcgctgctgcatcctgcacgccctggaacccaggagcgccccagcaaccctgactccctgccagcacgtccaaggctgcttaccccagcaacctcccatcccctgagccctcaataaatgccatctgtagcagctgtttgtctgagcgccctgtactagggggccggtgggctgggtgacaatgataatggaatagtggctgtcctactgaggacagcacagtactgtttgggacctgtactggtaaggaatacatgcctgcttcctctggactttgcgggtctcaccgggtgcctgggctacccttctaggcttcactgaggcgggttccctgggaggctctgaggttactttcagcgtctgccaggggtccacagcacttagccaaggggctatggattcactcgtggtctgccaggaccaggcttgttgtgagggccccaggtggatcacagacatccagcactgtatcagcaactgccaagcactgcttacacggggctctgaatattcactccaaccattgcctttgccctggccacttgttctattctcagtatgtgcaagtttttgcacttcatagtcctttcttacccttcctgtcactgtcttgtgttggacaaggaaggaggttgttttgtttgttttga

SEQ ID NO: 35554 - DNA, 1141 bp, Mus musculus
cagtggtggtgggtgcaagtggtgttggtaaaagtgctctcaccatccagatgactcaccaatgcttcgtgaaagaccatgaccccactatccaagattcctactggaaggaagtggccagggacaacggaggctacattctaaatgttctggatacatctgggcaggatattcaccgggctctgcgtgaccagtgcttggcatctggtgatggtgtgctgggcgtctttgctcttgacgacccctcgtctctggaccagttgcagcagatatggtccacctggacccctcaccacaagcagcctctggtactagtgggcaacaagtgtgacctggtgaccactgctggagatgctcatgctgccgcagccctccttgctcacaagttgggggcccccttggtgaagacctcagccaagacgcggcaaggtgtggaggaagcctttgccctgcttgtccatgagattcagagggcccaggaggctgtggccgaatcaagcaagaagacccgacaccagaaagccgtgtgtagctgtggctgctctgtagcctgaagatctttgtctagcaaattgacccttgtctcatgtcaaggtgacaattctcttgtaataagatttccctctccgaccaagttaccacagacatctttttattgtcatttggtgagaagttacgtggtaacatgggacatccctcattgactgtgttttatgaaactctatgcaaaattaaataaatgttctcaggattcaaagcttcctttatactaaatctttgtttttcttttcttcttgccttttctggagacaggttcttactatgtagccccgctggaagttcaagagatcttccaggatagccagagctacaatagtgagactgcttccaaaaggaagacaaagttgaaaactcagcagttaggatttttttttttaaatagagtttctccatgtaactctcctggaactcactttgtagattagtctggcctttaaggcacagagatttacctgccactgcctccagtgtgctgggattaaaaagacatataccaccgggcccaacagcagttaagaatatttttaaaaagaaggagccaagtgtggcagtcacctttaatcccagctctcagggaagc

SEQ ID NO: 35555 - DNA, 2315 bp, Mus musculus
tgctctagttctaggcttgtcatcaagaagttgcccccaacagccagtcctgtatcagctaaggaaatgaccacaccgaaaggaaaggttcctgaagaaagcgtgaggaagaccatagcagcactacctgggaaagagtctactctaggccaggctaaatcaaagatggctaaggctgtgcttgctcagggccagtcctcagaacaagctgctaagggaactacactggatctggctacctcaaaggagactgtgggaggagccacgacggacctgtgggcctcagcagctgctcctgaaaacttccctaaccagaccacctctgtggaggctttgggagaaactgagccaacgcctccagcctcgcatacaaacaagcagaccacaggggcttcacctctgcagggagtcacggctcagcagtccctacagcttggggttctcagcactttggagctaagcagagaagcagaggtaaagtccaccacatctgggaaggaggtagaagggctaaggactgggctttctcagatacatcttttccttctgtgtctccaggaagcccatgattctgaggagggcctgctaggggaagccgctggaggtcaggacatgaacagcttgatgctgacacaaggatttggggactttaatacccaggtgaactcagggagctagggctatgactattgcttcttggccattcctgccttcagggaggagcagatgatgtataacgggaagacgaaatcctttccttaccccatttttctgccccctctaggatgtattttatgctgtgaccccactatcctggtgtccccatttgatggcagtatgccccattcctgcagcaggcctagatgtgtcccaaccttgtaagacctgtggaacagtccaggagaactgggtgtgtctgacttgctatcaggtatggaacagaagaggggtattgggtagagattgggcccagcagcaaacttcagctggtgccaagcgacctgtgacaatcactttccaacctcaggtgtactgcagtcgctatgtcaatgcccatatggtctgccaccatgaagcctctgaacacccgctggtcctcagctgtgttgacctgtctacctggtgttatgtctgtcaggcttatgtccaccacgaggtgagcctggcaagttgcttaacccgtgcacactgagccctgtcccccgtcccctgtatcccttctaccatttggtaaggggagaacactattttgcatggctgccccatagatatttgcaggagggtatagggtagtctaggagaagcagtagttgaaagctgctgctaccatggtgacagcctctctctggctgaaatagagccaccctcactttgacctaccttgtccttcctttgtcctcaggatctccaagatgtgaagaacgctgcccaccagaacaagtttggggaggacatgccccactcacactaaatcccagaccacactgcctgtttcccttctgaggccacaggcagggcagcttagttcaccgcagtccgtaccttggataaggggcctcacttgaacccatcttgaataccctttgccaggtgcttatttaagtacaaatccttttcaaaggactctagtgttcagttgttgatgtgcccctgcccactgcctgctcgaggaatacctctgttctacccagaaggagggagggacagcttagtagccctaggaaggagctgagatcacaaggatgacattgaaggagacaacggggcagtggcagcaggtcagcatatttaataaagttggagttgctacaaaacctgaagaaagtgctttttttttttattttgaaaaacccgtcattcctagccagcacaactgagggaagaaagggaggagagaagaaaggagaggtcttcatcaattcaactctatccattgccccccccaaaaaaaacaatttaactaaaattgaagtaggcagccagattggctctgctggagagtaaatagaattcgtgagcaaatgagtgcccagcatagaactaggaggctcaccagacatgatggtgcgtgtgccctttatccccaaacttggaagacaaaggcagttggagttcaaggccagcctggtcagttctaggctagtcagaagtacttagtaaaaagacatgagaactgtcaggatgtagcctcctgggcctgtttccccatcgacctcactgactgtttggggagggtgaggaaaggaagggttcaaatttaacttcaaggtctagtggctatgggtggcagccggagcaaaactgcagtgcctcta

SEQ ID NO: 35556 - DNA, 1233 bp, Mus musculus
cctgaacaggttatcccaacagaacccatgcctgggctcctagcattagaagagtccctagccttaattacttgttcaggtccatagttcaggaagccaaggttggaccttcattcttagaataatagcagtgctttctcattaactccatggtcctgttgcccagcaacaagtgcttccaaagaccctagaaatctagcagtggcccactcctaggccttactgtcccaaggtgctaaaaagggctatctccctccccaggatcctaatcgtggattgggatgttcatcatggtaatggaactcagcacatatttgaggatgaccctaggtgagtgatgggactgtgggtaagagtatggtgtgagaggatgctgaagcatcctgcagggatgttcatagcctctaacctgctgtggcccctttctcatcccaccctctccctggcagtgtattatacgtgtccctgcaccggtatgaccgtggcactttcttccccatgggggatgagggtgccagtagccaagtaggccgagatgcaggtataggcttcactgtcaatgtgccctggaatgggccccgcatgggtgatgctgattacctggctgcatggcatcgtctggtacttcccatcgcctatgaggtaaggctcaggttattatataacattgctgtatctggcagcacacatctgcctccttgacgtgtgttttgactaccaggtgactaatcctatgatggctattgggacagggtggtggggatggccttatgtatctgtctgcctatgcatatatgggtgcctgtgagtggcctatctctgtgacattttacacgtaaacaactgtcttggctctgtgtatatatgcatgtgtgtgccttctgattctgtctgctcttctgagtgcatggctgtaagggtatccctaagagatactgttgtggaattgtgtagaatagaagcataagattaaatacattatggatatgtctatgtaatgttatatagtggctgtcatctcctttctgtgtgtgataagtgtgatagtgtatgtcattaaatgctgctgtcttgtgatagcctaagaaagactctgaatatggaaggccgtagtgacattgtcacccacacccgtctaactgggtccacgtgtctatatatgaatctcgctggctgctttgactcaggggtgacctagctgtgtgtgagctaaggacagggccaatggcgtgt

SEQ ID NO: 35557 - DNA, 1099 bp, Mus musculus
gagatcaggtaggtggcggggcgtgggggggggtgatcagcactagacctggaatgagctattagaggctattttcttccagctctcctcttgttttcccgggatgcctcggtgggaagggctgtgtggattttaggttttatgtccaggccatgttttgtctcaagagtgtaatgggatccagattcaggaaataaggtgatctgagtacccccttttcagttgagacccaggaggaagatgaagtggaagaagccgtgctagaagaggaggaggaggaaggtggctgggaggccactgcactgcccatggatacatggccactgctccagaaccgcactgggctggtctatgatgagaagatgatgagtcactgcaacctctgggacaagtgtgtgctcagagggctggggtgggtggtgtttgggtcactctcctcagtcactaaacccttggctctgcttctccacactgttagtcatcaccctgagacacctcagcgcatcttacgcatcatgtgtcacctggaggaggtgggccttgcggctcgctgtctcatcctacctgctcggcctgccctggactctgagctccttacctgccacaggtcagaccccgtgctggggggaggccggctgtaggattctagggatgttccaggagtagggcctagggctctccaagatgggtggagccacctagacaggttcaagttcttatgtgaggacaagctggcgactcttgttcctctgcatcaccagtgctgagtacgtggagcatctccgcaccacagaaaagatgaaaacccgggatctgcaccgtgaaggtgccaactttgactccatctacatctgccccagcacctttgcctgcgcaaagcttgccacaggcgctgcctgccgcctggtggaagctgtgctctcgggagaggtgcgtcttctctgtgtgctagtgaagtttagctgaagaaatgaggtcctgggaacatagagagggactacctgctcccactcaggaggccagaggcaataggagagtctgctgggaggggaaccacggagtggatggccgagtggatggcggacaggagaaagggaag

SEQ ID NO: 35558 - DNA, 1194 bp, Mus musculus
gaatttgggatacttactgagcagataagccagcctgggtcacatacagagtgagacccccactcagaaaaatcgagaaaaacaaatcaactagagggaagcttgaactgcacggcaggtatgagacctgagctgcatgagagcaaaggagagagtgagagcagggagataaggaaaggctgggagagggagggacagagggagaggaagaaagggagggagggggagagagaggaagagagaaggacggaaggagagggagtttacaagagtgagcaagaggtcttgttccataggatctcagggctagcctgtgcttccggcaccagtcagggcagctgtttctatgagggtgtgaacctgggttcttttttcaaggtaaggccaggaacctgtgtaagagcaattctgagtagacttgctattcaggtaaggggtgtctgcaaggtgtgggagctgagggctgagctgctttggggacttttatagggccatggccattctggacagtctctgaaaggaatataaactattgtgattaatttttatttttgagatcctctctctctctctctctctctctctctctctctctctctctccactatatgtatatcatttgctttgtagccctcaatggccttgatttcaggacaatcctacacttcagttcttgctcagtgtttcaaaaatgtccagtttatgtgtcgtcacactgtgtcaacgatagcccagtcatgcacaagcacacctttacagccttccatgtctcctcacctgttattgcacgcacagctccacatgctgttttacctgcaacttgatgacaccctgccatctcccgccacctcatccacaagtaatcagtcatccagcatcttacgatgacatatggggccacctggatgccgtccacaaggcttcagatacacagttccgttggtgcatcatgagtttcagttgtgacatattatacctgcaacctcatccagtagtcatgtgtgtcattcggatattgtcatcaaagaaccatagacaccgctccatgctccacttgacactgacatttatttaaccaaataccagcgcatgtctccaggtggttttattttacaaaatctttaagggtgcagggcaaggagatggttgggctgtaaaggccagtggctctaagaggagggagaaacgggcacg

SEQ ID NO: 35559 - DNA, 1144 bp, Mus musculus
ggcggtggtggcgcacgcctttaatcccagcacttgggaagcacagaggcaggcgaatttctgagttggaggccagcctggtctacagagcgagttctaggacagccagggctacacagaaaaaccctgtctcgaaaaaaaaaaacaaaaaaacaaaaaaacaaaacaaacaaacaaacaaaaaaagaagcaaacagtattgaagagaagccattatgattcttgctattattcctttgagacaagatctcagtggagtccaaggtggcctcaaacacagcattttcctgccactgcctcccaagtgctgggaacacaggtgtgcaaccaccatgcccagctctgactgtaactgtcctggcaggggctgagatattctgagggccacttgttcctgttcttctactatcaggctattgagaaaattgagtcaaagaaactggaattttcccaggattctaaccccaggagaaggaaaaaggtaagactgacgccaagtgaaagcttctctcctggcaagagtttcacatagttggaaagcatatcagactaccacggaaatcagagcccagagccgatatagatatgtgtcaaagatgggcaggcagcccctcacctttgaccagaactgcttagttaagggtaatcttgaattctctataaactcaaaccttttggcaggaccctgaaaacagacttgagccatttcttcagtcccagatctttactttcagtgtgtatttttgtatcatgggcctgttctattctctaccattttattatttatttattgttggtctttcaagataggggttctctgtgtatcccttgctgtcctggaactcactctgtagaccaggctgaacctcagactaacagagatctacctgcatttactacctcccctgaattaaaggtgtgtaccaccaccacccgggttacctcttatttcagttttgttttgttttgttttcctaaattgccaagtgaagtacagaacatactacaatagtgattgacactcaacaatcacaactgtgtcttaatctcaaaatggtaagagtgctagtgtcagccgggcatggtggcgcacgcctttaatcccagcacttgggaggcagaggcaggtggatttctgagttcg

SEQ ID NO: 35560 - DNA, 1136 bp, Mus musculus
gaagtttccagatttactggagtcatttcctccagggacattacgctctttccccttagccagcattggctgcttcgtactcgactcagtgaagcaggcaaatgagtttggactttgtcttagattctgcacaaatctgacctttggtaagtctctcaccgaccagcttttgcctgcctttttgcctttgggatctttggagcaatttggagttcttttgattcattccctgctgccatttggtgaatgattttgttttggatactcttgtgtcgaagactattgggttacggttattgtaacgtagagaatggtggcaaagcagagagctctcaaaagtattggggacctgagcagaattcaaagtcaaggaccacaaagatagggtcctgtgattggaagcttcagggaggcacgttctgtttcctgtcagctggaggagagaaggtggcttgggtttctaaatttacaagtgtcttaaagagacaggcccataaagttgattagggcatgtgtcatataacaggacaggtttgagtgctcttgagtcacttgtggttcggtggaaccatttggaataggtaggtctcaataccatggtttatataaccaggaaagtattctctgtactagtttggtagcctattgagactcaaagctgattgatcttttataaataattccgaagacagcaatggggtgggagacaacaatccctgtccttggagcttgtgaagaaaaccctggccacttcggttttgctttatgctctaaactcgctgtgccctgctaagcgtgattggcatgctctgttcatgtgagtgtgctttggttcattttgtcctacacagaagcaattgattctgtatctattccttaaagctaaaatccaaggatttagaaaacacggcggggctggagagatggctcagtggttaagagcactggcttgctctgccagaggtcctgggttcgattcccagcacccacatggcagctcacaactgtctgtaactccagctctaagggatctggcactcagacatacatggaggcaaaacaccaatgcacataaataatttttttttaagaaaaggaaaatgttccgggcagtggtggcacacacctttaatccc

SEQ ID NO: 35561 - DNA, 1210 bp, Mus musculus
ctggccccagaatgaagatcacttgaggactactttcagtcactgcacaccagaactctgtctggctcgcctcgatcctgttccgagcaagctcgtgtctatgtggatggtgtgaccattgaggacctagcaggctacatggagtattactgatatatccctaagaaaatgtcccacatggcagagatgatgtacacctgataacaaaaggctaattcatgagctttaaaccaatgaaagcctgtcagaggtttagttaacagcagacctggtggccactctgtgagaagatatctctttctgctcactgtgcttgtaataaaaactattcttggcatctcagttaatcttcattctgtcattttactgggttcttctgtacctgttaaggcaagcaggtcaaagaaaatctctcctaaaaatgttctgagggctgaagaaactataatgagtgggaactggcagcggcggggacatggtgacatcctatacgacagcttatgatatggcagcaagaaactcaaatgtgcgtctgtaactggactgaacacttgtcatgctgtagatgccagcccattaataatacagcttctaagactcgtttaaactgtctttggtttaacacggatttgtgtcatcaaaggtttcttacattactgttgaatcagttatctaaggtttagatgcagtttgaataaaccaggtgacctggtttttgttgttgttgttgttgttttggtttttcaagacagggtttctctgtgtagccctggctctcctggaactcactctgtagaccaggctggtctcgaactcaaaatccacttgcttcccaagtgctgggattaaaggcgtgtgccaccacttcctggctctggtaacacttctttttctttcctgccttttaattctgtaattggcagataaatcaaagtcatttgtatacttatatggtattaatgtgaaaagtcatttcagggtatataacaggggaatagtctggaaaatgtcttcaaacattagctcttcggggccagagcaatggctcttcttgtttttccagagggcccaggttcagttcccagcacccacatggaggctcacaagcctctgtcaccccaacacactcttctggtctccatgcatatacatacagatcccgaggctgtgtgggtggatatggaaggactaggaagagggattggggtgc

SEQ ID NO: 35562 - DNA, 1176 bp, Mus musculus
acgtgatgaaggattcttcgctaaggacatgcatgtattggtccaccttactttgtggagttgagctccattagtcagggctccatagagagaaatgcaccaaaaacacttctggtggtgtgctttggaaaacacttctggtggtgtgctttggcttctagctgcttcctcgaactcgggttcattggcagagtgatgtcagctgagacagagatggactcaggtgctgaggcaagacccttggaggacacgtgttgtttggaggcagtataaaaaggactccacagcccgtgaaagaggctgagctaggtttgcttatagagctagctgcgcaccacttgttgatctctttcttgtctttgctgctcttcacttctctgagagaggtacagctaagaactcccagcgttcctccagatccctcttgctgacttgtgccgaggctgaggcctggctggctctgctagctagtgccacccgctgctgattcctgtttgctgtaccgactctaccgtactggactgctggtgtatctgtgaagtgtttgcgagtggatcacgctgctgctgctgctgctaacctgggaactgaactactgattttccgacaacacagatggaagttgctccaaagagccatttctaaacaggtccactttccccatatcctttctttcccattacctctggttggtggtggactacaagggaggttaaagtgtctgagaaccatcattaaaaataagggttgagggctggagagatggctcagcagttaagaacactgacttgagttcaattcccagcaatcacatggtggctcacgaccatttatagtgagatctattaccctcttctagtgtgcaagcatacatgcatacagaacattgtatatataataaataaatatgtctttaaaaaaataagggttgaagttacagatttgagaaaatgcctctagaagatcagagtgtaagtaaattgatagggcattttcttttttcttttctttctttctttctttttttttttttttttggttttttgagacagggtttctctgtgtagccctggctgtcctggaactcactttgtagaccaggctggccttgaactcagaaatccgcctgcctctgcctcccaagtgctgggatcaaaggcgtgcgccaccaccacc

SEQ ID NO: 35563 - DNA, 1264 bp, Mus musculus
caaatcccccccttccctggctgtgacttcacagtggaccccgtggacatggagagtacccgaatggactccaactttggcctggctgggctccccggctcccccaagaaacgagtccgtattgaatgcaaatgtgggacaacggcttgccgaaaatacctcttctagccctgagaagtctgaggccagactaactgaaggggcctgaagccaccttcctctcctacagctaccctcttgtcaaggatgaccatcaatcagagccttgtctgcctccacttgtcctcacctaccctaacctgctctagggtcagggctgttgtgaggactaactccgggtacccttttcctgttcctttccccctgttccaggcccatcaggcattgcacttaaaactcccagccccattttcagaaacatatttttcacatcatgattccctagagttggaattcatgtcatataatggaggtccagattgaggaactcggctgtaaaacagattctttgttttggacagcatctctgcagctctatgtagtaagtctggtgtttggaccgttaatcttcctgtctcagccttcctcatgatgagattgtaggtgtaaacccagctaagatttttgttctaattgcatctgcttctgcttggagcttgtgtgtgacctgttgcaggcctcttcattactctaatggtatgaggaagcaaccccctggcagacagacatcagagctgagataccagcctaacatcaagctggatcagcaaccccagagcctttgtactcaggaaagaaaaggcaatcttcagagctgggagataaggctggttccgctctttgtgcttttgatgctggctggtattaaccttaagacctatagggtctcaacagttgcaagtctgaaaagtagttgcccaaatgccatcagaatggggatggagtaaatacctctttgaaagccccacagaaaggttagaactaagttttaccatcaggaagtacagtgctggacttgctggaaacccagccttggcatttgatggccactagaactactagaagctggaaccaagatctaggtattctttagatagcacttaagacagtaatgtgcatcgactagaaggcgatgtgatgccaggcacttggtagagcacctggtccatacagattgtctcagggaagccttgaaaaccacaaaggtggagcccagaaaaaagcccatgtgacagaaggcaatgtctaggccaaaaatacttgt

SEQ ID NO: 35564 - DNA, 2088 bp, Mus musculus
cagaggcaagcatacaggagacagacgttctgagctgttctgggaagtagggatacagctgtggcttcaactgacagaaattcctacccctgtgggctggcatcccaatagaggcaagcacatgggagacgaaagtacagccattccttggtgtagaatttgctttataatttttcaactttataaatttttgaccttccagtggtagcgaaccacacgcatatacccagttctggttttctcctttcagtatggtgttcagtaaattatgtgagctagtcactttgttataaaatagactttgcattaggtaagtttgcctaactgtagaataatgtcagcgttgtgggcacatttaaggtaggtgacactaagctagggtgttcggtaggttaggtatatttatgcattttcaacataagacagttcaagacagatttgttggggtctaaccccgtgtgatgaagtcacatctgtatataatagagttaaagatgagtgctaggaagaaaagcaaagggccagatgagcttgcacaaaagggaggggcaaagtcatcaggaagagtgttcccaaccagatgacagttttaaagatctgagtgaaatagagcctggaataatgtgattgggcggagtgtatgagatgatgggagacaggtctttgggacatcttgggccatagcaaggaaggaagctttccttattccctgagtgaggaaggtgaggaaggctcagacagcagtagggaaattaggtgcagaatgttaagttcaaccacggggctttcaccaggttaggttgtcaaactccccaacattggcagctactgtttgggtggaccccacacttgcctgtgcgttgagttgtgtcccacaagcagtgagcagaagtgtcgagttcttggagctagattagcatgcatacagccatgaactctggggctgagccacagttcctgctgtggggtggaagaaacagaaaatctctaagctcacccctgtctcctgccatgtctatctggggcccttatttcagtcctggacctgctcagagaccaaatactaatgttcattattgagtattggcaaggagataaattactaaatgactcttggtaattaggtcatgacgaaatgtgaaggtttgaagaatcaccaggagttcttgcagctcccatatgctactacatttgtagcaattggaactttggctaacatcctggaaccgctgagtcttgccaacctggtgatctatagaactaacagcagctctttgaggaaaaaagatgatttcctatttgtttcgtttcttgtttaagagtatggtcacttccagccaaaacatttctgactccatcagtcagattttaggcaaatggttattagattggaatgttagtgagctggactggtcattgtagtcaagatcatatatgtgtgccaacatccctaatccagcttcagggtcagtgatttttctatgaggactgtaacttactatagcaaagggtgccagacagcaattaagtgctaatctctttaaagaccctcccaaggttagcagttcagacctgtgcactggctcttctgtaccaaatggatgcacttattcagccaaggtctgggggtagcaacagaatttgggtacataacagttttctctaactttctccttttcttcactctctccattttctttaatgagtctggtttcaggatgattggtgatgaatattgtttgcatgattttgggggggttccttgtgcaatttttgaggtggcagagttgacattaaattatctactttaaattatcttggtgacacttttgtctcacaacctgaaggaaaataaacactgagcaaacaagaaagaataaaaaataatgttgctggttagacttgggcctctcttcatttgtccgccatcactgtacccctggcttgacatcagcattctcccgtcattccatcgtccaggctcctttacttccctctcaaatccagccttggtccatgtcctttatctgattttgaccttggatgtttgctaactgctacactactaagagcaacacggggactgag

SEQ ID NO: 35565 - DNA, 1177 bp, Mus musculus
acatggaggctcggcatggagtcacccaactagcagggacagaccccgaggctcctcctttctcccacccaaatggtcatgaatttgctttggcaggtggatgaagactcaggaacttcccagaatactgcctcaaccaatgagccaggcccaggttatggggcactggggctaagcctaccaggtgggtacttggtcagaggaaggaagcattctatgctgggcctttggggaactggcagaaccacatgctgccctaaaggtaggtcaggggtggggaggaaggaaagccagtgtcacttgaggtggtagttcatcatcaaccacaaaatgacaagagttggatggttttctagctgtgtgtgtatatgtatgtgtatagcagcaacaaagaacaaaaatagtagcctcatatttctgtaacaattgttctactttccagatagataactggaggtatattgtaataattagctttgccttggtgctaattattgccagggaaagggcccaggaggtccactgcaaagctttatggtcatgcagacattagtaaaactcaaatttgaggtccaaagctccccaaacacccagtgagagattaaaggtagagccacaacagcggacaccataggcagatcaccttagtgctacaattaaaggattgcgatgtccttgggcttgctgcatgctaggttagcagttttctatcaagatatactccagcctccaaaactcaggttttaggccctgtttccaggctttctcagttttagcatttaaaatgagaactgctttttcagtggattttagggttttaaacagaaaaatgtttaaaatggattaagtccctaaataatgcagcgacacacttaggccacattttgcattgaaaggcatacaggatatgtgctatcaaccaatctttccaaagcaagctctatagttaattagggcatgtgaaaaccagtatcctgatattgcaaacttcctaccaccttctcagctacagtcctcaccccttcaccctttgaggctattctacatgggccataaaagctctaaaaaaattcccacttctaggattgattgaaggcaagaaaaatattggtgagacctgatgagagttttataatcactacctgtttaattagcatgattacagtaaggctcttaa

SEQ ID NO: 35566 - DNA, 1209 bp, Mus musculus
gacatcaaaattctacctcttactattctcagatacacaaggaataacacttctgatccaggatcgtccttgcaaattgctgtatttataaagatttttggagctgcgctgaaacgtctgttttagtacatcaagttctatttttgaattgagctcccaaggtagtttgttaaagaacttttagaaagctccatgtgttctttaaacattttttcccttttaaaaacaaattttaagacatttgttacagtcccaatatttttccttttatcagaatttttgtttaggcactcaggattattgtttctggccaaaagaaaaaagtggccaggctaaatcagtttttaaagttgatgtgtatttagggacattttaaaaccttgtaaacaatgtttatcatggccagaaagtgatttctgaatgtacctatgaacaatccgagtcaagatcatgattgcttagagatgttttttattaaagatcaccatcctgattatatagaagagcttctttaaaatgtttgtgaatgtcattttttaatactggaagaaaagtattctgttgtgtctgatgtgtttaggatgtcctttatggagctaattaaaagatgaaacctgaacacaaatcaatactgataatgctttttccttattcaaacccagtttacaatttagagcgagaggcaagtcaggaagatgaagcttggaaaacatactgggatggatgggcaggaactgtcagaagggttgaggcttgaatttgaagttagtttgggtatatggtgagacatgaaatgtgatggatacagatgaaagtcagtccccttctgactagaattgggttttctgaaattgtttcttggttcttttcacaactattactttaagtttgcttttctgggtacaaggtagatggatatcctccttgcaagattgttctgagaagataagtgccttaatctcataacatgggcagtaaacttatacacagagtagtgcacttttcttttttaaagatttatttattattatatataagtacaatatgctacagattcaggcatcagatctcattatgggtggttgtgagccaccatgtggttgctgggatttgaactcatgaccttcggaagagcaagttggtgctcttactcactgagccatctcgccagccccatagtgcacttttcttaatggggactggagtggt

SEQ ID NO: 35567 - DNA, 1221 bp, Mus musculus
tcttaaacatgaatttgttcttgtgaatcttaaaataatttcatgcagtttcagggggaaaacattagaattctggggttttttttttttttgtttttgtttttttgtttttgtttttgttttttgttttttttttttggtttttcgagacagggtttctctgcgtagccctggctatcctggaactcactctgtagaccaggctggcctcgaactcagaaatccacctgcctctgcctcccgagtgctgggattaaaggcgtgggctaccacacccggcctttctgatttctatattagtttaaggtttggcaagtttgacaactttatgatgaaaatgtagtatgtatcatatatattatataataccacagatagggtctgggccagaagcccatattgaaatgcttggatgtgtctgcaggaaatgtgtgcacactcacccaaagtgggttatgtaaagactatttatagcctctgttagcccatgccaggttttctcactcgacaggtttgtgtttgcagaaatcctgtgcctgtttttaaacacactttcaatttccctactgtttatcagtatttcataaatggtttctctttccccgttgactccttttagcctttgaaagtatatttgttctctcactccctacctcctttcctcgtaccacccccgtttttctttgtttcctctcttctccctgcttcctctcttggtctcatacaatccttccttctctgccccccaagtaccagcattataggttttaggtatgggctactagtagagttggctggctgacactgtttgtggtcatactgttgctggagctttctatttatgtgtgccaggtttatcttaaagtttcttttcttttcaactccaccccacccctgcttttgttgttgttttgttttgttttgtttttgtttttgtttttttgagacagggtttctctgtgtagccctggctgtcctggaactcactctgtagaccaggctgacctcaaactcagacatccggctgcctctgcctccagagtgctgggattaaaggcgtgcgccaccatgcccggctcactcctgctttttgaggcaggttctcacaatatatcctatatcagctttggacttactgtgtagcccatgctgactgtcaacttgtgcctatctggctcacaaatatgagccactttttaaatatatatttatgattttata

SEQ ID NO: 35568 - DNA, 1297 bp, Mus musculus
tttctctctctctgacacacacacacacacacacacggtggggtgggtaggaggtaggggtagagggagggaaggagggttggggagaagaaggcaagaaaggaaaaaaagatccccagactcttgatttctgaaatttgtacctcgttatgtccgatttccaactttggtttcagaatgtgggttgaattctttgaagaattgccttggggaataccatggagtagagcctggcttgttttccttatcctcacgaggacttttccttctcttgcctcccacaggccagatatacggggatgtgctgtacttcctgacagagctacacgaaggactccagcatggggagataggccaccccgtttatttctggttctattttgttttcctgaatgctgtatggttggtgataccaagcatccttgtgcttgatgccataaagcatctcactagtgcccagagcgtgctggacagcaaagtcatgaaaattaagagcaagcataactaaagagccggagagtgggctgagtccctgctgatgaggcgctctcctcacttcccagaagactcaaatcttcttcctcctcgcacaggttgggggggtcagaactatcggacttgtcccactcaaacatgatgagtgagcacacaaagggccagagtcagaaaaggaagggaacaagttgagctactgctaggaacctgagggaaaagatggatgagaaggtggcaagtccgtgacggtggcaacttcccaaaccaggaaataaaatgtcttttactataacactgagagatatttaattactaatctcagaaatgtcatataacacatctctcccattacttcgtcatccataaacctccatcatcacatacatataccatgtctgcccttacaaacccttaacactgactgactccacacacagtcataatttaccctgtagaacctagaactcactctacagacctcccttcaagatcaccctattacttaccccataaatccttccagtaacctcatagtcctctcatatagcttggctgccgtaacaaaatgatatggattgagcgttttaagcaacagacatgaatgtcctcaggactggagccagtcagtcaaggtgtcagaaggtttgactttaatattttttttgaagtctctttccttagtactgcattctgtgttctcagatgttctcatatctccctgtgtcccctgcttctgctgtttgtattcgaacaactttcctcttaggacaccatttagattggattagggtctatcaagata

SEQ ID NO: 35569 - DNA, 1174 bp, Mus musculus
atccaacatatttttaaaataactctttttggtgtgctggaaatcaaaacctggggcctccccatgtagaccctcccatcaagctgtatactcagccccttaaaatgatctttaaagaagaagaaaccaaactgtatctggtcacccttgataagcacctagacccttcttttactcaggaatatgaaataccaaagatccctgggcaagagatgggttttccggagactcactgtccttgttgaatttcaaaatcatgacttgtttctctcccacagggctacggcatggcatacactgtccacaagtggtcagagctcagctgggccagtcactgggtcacttttggatgctggatcttctaccgtctcataggctgaggcatatgaccatcataatccccttcaatacccctccttagggtgccaactctgatgggggatgagaaaagaccctttctctactccttttcccttatccattcttgacccccaacacccctccacacaacataggaacacacacaactttctatgcctgtcaatcctcaccccgccaccaggcaggaagggggtggtccttattgggccaaggaacgatggatacttgggaaagcagacaggagcagatccagggcctctgcgcctgccgtctcccttttttatatgcagtttgttattgtcgaataaaagtagaacttacacaacaggctcggttttttggttttttgtttttttttttttttttcactgatcagaggggaaaaagggaaagcaaagaaattccaccacacataaaggtttggaaactgaaaatcgtggagagggaaaataaaattgtgatctattcgcgatgaattcaacatggtctgtgattggctaatgagtctatgatggcggggtcctggtcctgcttgcgtagagcagggacagattttgtgggggaggcttagtaatacttcatggaaaactgggggatccctgtactgattggttcgtcagattcgaacggggcggggtagggcaagacagaagaagggttgatgcctactggtccgtaggtaataattaaaatgacagtttgagatgatcaatattctgactaaatgctgacgaggtctgtttgccaacttgtttaccgtcatgccttctgtttggcttttaagaactggcac

SEQ ID NO: 35570 - DNA, 1174 bp, Mus musculus; identical to SEQ ID NO: 35569

SEQ ID NO: 35571 - DNA, 1232 bp, Mus musculus
ggcacttgcacacgtatacaaaataaataactgtaaaagaaaatttttagacaaattagttcttttaaaattgaggggttttcccctttttatattatttatttattttatgtacatgagtacactgtagctctcttcagacacatcagaagaatcagaccccattacaggtggttgtgagccaccatgtcgttgctgagaattgaactcaggacctctggaagagcagtcagtgctcttaaccgctgagccacctctccagcccaacaaattagttcctgaatgcctatggccctcctgttcagtccttgcctggtcacagtgaggagctacacagcaatgagaatgaagtactacttgtagttaacctttgacacgtgtgggtttttttaaatatatatatacatttccctttatgttagagtttgcaggaaaaatcaaactaatacagcccaaaagctgctgcctgccaagacaactagaagctggcttgatgagtttgtttgcagatgtcatctatggggactgaacagaccgacctagagtgagaatctataacacctccatcatgacaaagaaatggtgaagaagtcctcagaactgcaggaaggatttgttgagactgtgagcacattcctcttctccaaacctctcctggaatgtcctagaaggcccaggaattcccccaaagcactggttcttcctatggtcaaacgtcagcaacctccaccaaacatgatggaggaaagcgtgaatgttgtcactatgacggaagttcagctttagtcccagttaacaaatattggcaataaatcaaaacaggaaaaaccctacatatgcacgttgcttacttttttatatgacagttcacagacatctgaaatactgctcatatttctcaccactttgaatgatagttgattttataaattaatcctataattagacatctcatctattaccgcatcccaattgggtgattggctgggcaggtatttgtaagacatcctcccatataggctacaccgcccttaaaactcaaaatcctcctgtgtcagttccctgagtgctgagattacaggcctgtgccaccaaacctagctactgtcttccagttttattcaaatgtaaggtgataactgtatttcagcatagtctgctttcctcatcattcagacgtgtttgtgtgcatatgcaggtgtgccttcaaagacgtcctgtgatgggctgag

SEQ ID NO: 35572 - DNA, 1220 bp, Mus musculus
cttcctgccccttccctcaaaaccacccttgccccggccacactttcaaagcggtgttgtaatggtgccctctggtgtccctgtcacaaactgccacttaatgccaggaagatgaacttctctagggagcctagaaagacgggctcagatgaaaattcatccggagctgcatcctattgaaacaatggctctatctgagggaagctaaccctgaggcaaagtgtgagaaagtatttccacttggtagttatttttaattttgttgttgttgttgtttctggagtctctgtagacctggctgtcctggaacatgtctgaaacacagagactcgcctgcctctatcacctgtgggctgggatttaagggtgtgtaccaccgaggcccgatgagaaggtattttcttattaacctctgaaaacctaagctaccatggagtgtggctgcttaaaaagacgaacacagagtcaaacaccgcccacacaggaattatgatggtaaccctcgtgacccgtaaagacatccccccgtgggtgaaagttcctgaagacctgaaagatccagaagtattccaggtccagtcactggtgctgaaatatctgtttggcccacagggatctcgaatgtctcacatcgagcaggtgagccaggccatgtttgagctgaagaacctggaatctcccgaagaacttaccgaagtcttcatttacggctcccaaaacaacaaggttcgggctaaatggatgatgcttcagtccatggctgagaggtaccacccgcgcaagcaaaaaggagtgctgaagctggaggaagccatgaagaccctggagctaggccagtgtactgagtgaagccagtttccagtcattgtgtctcccacctgggcacaggttaagctgtggccagtgtttggttctggcgggatttttagctttgttacatcctagcaagatattcctggatccctgccgtgcattctgatgtgaatacataccaaggttaccattctaaataaaaaataaaattgaaatgaaaaaaaaatacgaacacaaacccataaaatggcttgaaggataggcgcttgccgtcagtcaagtttgatggcgcgagttcagttccagcggtccacaccatagaaggcaaacagtgactcctgctgcttgactctgatatgaacacctatgtgcccgaaaacccagagacaacaaatgcagcccagaca

SEQ ID NO: 35573 - DNA, 1189 bp, Mus musculus
atgcactaacctctccacattttagaaactggtggcattcaggtcaatgtttggagccaccggcttcgagagaggaagtatcgagtgatatatgaagagataagtgatcctgaagaggaagaagacgatgattactgaactggtaagtggtcctctgacacatctcacaacaccagaacacacaggtttcccatatggtattagaccctacccaatcatccacttctagtcctttggggcgcaagtctgaaccggaagcagtatgtcatgcttcctttactgcagcgctgggtagtttggagaccttccctagccaggaatgtatgggcttctaaatcccaggttatcactcaaattgtaggccatgacttcctctcgtgaggcaggcccatgctctagaagagggtgtgcttgtggggcagagctttgaagctggggggaaggagagcatgcaggctgtaaaggacaggctgaaacagggcattgagtaggtggtggcaactcactagcatttctcttccttctctttcttgtctcaaccacagacagtcgaaataaggccacattggaaggatggagtgtcgattcgacatcacagctacagctttgaaagactaaatatcagcactatagatataaacatttatttatatatttatttattatatacattgatacctatatttatttatttatgaagtctactaaaattctgaactaagcatgtgtcacatgtttgttctcttagcaattttgtaggatgtgccaaacactgttaggagtctttttccgtcgtgccaaacatttcctattatgattgtcactgtgttgagccccactagaactgctctttctgtgccaggcactctttaaacaaagatctttgtgtatggcaagcatctggtcagcactgtgggtagtacatgctaagaactctgttagtattgacttactgggtgacagccactctggcagaataccaatgtttcaagcaggctaaatggctcagtgttaaaggatcctgctgtcagacttgagttcaatcttaaggacctacatggtggacacagagaactgactccctcacagtgtcctttgctactcacaagtgaacgcatttgtgcgtgcacacacatacacacatatccatgcatacaagcacaaaataactcaaaaaacaattggaaat

SEQ ID NO: 35574 - DNA, 2076 bp, Mus musculus
aatgctttactactactgaatatagctttatacaagagtcaccatgatagctgggataggttcctagggattttacaactttgttccaattatagcttataggagagctatttaagtttgttttattggtatgttccattttcacctcactaagactttttgtacataaccaactgtagccactctggcatgcaatgtgcattttgtttcaagggcctacatttgggactttaggatccattggtacagttacttaggaaagccgtgtttcattccacatgttgaagaaagtagggatcaggatcgattgagacaactgttaaaacatcaaaaacgatggaagctcatacaaatatctaaatgtttaaaatatgaattgctcagaaggtaggcttcattctcctcataattcaggcttgtcctataattctgagaaatttctagtagaattttctaagattaatattttaagaaggaagaaaataaaactaatagtctccacctctatctttcccttccttgcgtgccaggcaagttttaaacaagccttttaacctcagttcatttgctgttgtttctagaaagctctgtagaaatctgtttcctgatgcaagtatacaggacattttatttttcacaatcttaagaaaaagaagtgttttcctcactaccatccttagttagaaatgttgatcttagaaactttttaagttatagaaagtaatgaaatgatcaagtttttgttcctcatgaaatccattttgacttaatagcagttcattttcatgagatactcagttttgtcctccacaccatttcatctaatggataatttctctctcatctggaagtatttattttaatttaaaagggttggatagaatattgtcagtactctgacaaaggtgccagcaagcaatgctatgatctctaccactaaatgtggatgatgaaatgtctacaaacaagtgaccatgaaattcacaccaacttaacttgaaaattgtaacaaaatgtaatgcatttccaaaggcacccctatttgtgattctatgggatagaatagatattcaattttctgatcacctaaatacataaaacacatttatctggccatcatactcctcataattgctttttaaaaactcttttggtatcaaattgatgagaaatttcataaacaaatgaacattcagtttggtaagtattttactatactagaggcttcgtaaaatagtaagtattctttgatgtgtcattcacgctgttaatctttgtaccattttgtatgcacacatttcagtaaggttctgaaccacagagcgtccgttttctttcctgaaatatttttcctcatttgtacttcttctgttttaccaggatttgtggtttacctgtatgagaatgcataggcagcccatcatttttgatcacttttaacatataaaagtcaaattgatgtttgtctgtttgctgttgacccctgtaccacttttcctgtttgtaatacatctagatctagttagtgtacatcatcaaagtgatactttatatgacagataaatctttgtacttttcttgctcagaggtacaaaactgttgaacatacatagcaagtacagggaaagtacagggaaaacaagcttaaaatgctaaagcactcctgtttgggttattaagaaatccaaaatgattgaaagggtaggaagaacatccctaggtcaacccaaaatgctcttctctgtcaaatcatttccttatgtttacaggcaccaggtgttttcagtctttaatgtgaagaaaatcctttccttgaagctttccagtgactgaggggagagatggtacccatttccaatttcaggtcatgccttgagagtgagattagcgccactctgacacttcctaggcaggttcggaattagacaagggtaaggatacttgtatttttccagccttggtttagaagcatgacccagaaatacttttaaactcttaattttcaaatatattgtaagcccttttaccttagtcagttggtaagcatcttgaatgacctcaaaccaaactaactag

SEQ ID NO: 35575 - DNA, 1198 bp, Mus musculus
ttagtgagtgcacaggtctttgggctccactgcagttgccctgtcttaccatcagttaattacagaaattagcactcagggcatgtgcgatggctcagccagggaaggttcgtgccaccaaacccaacaacccaacttccatccttggggcctacatggtggaaggaaagaaagagttcccacggctgtctgatttctaaaagcaaactatggtgtgtgtatgcatgtacacagactcacacaacacacacacacacacacacacacacacacacacacacacacacttaaaaaacaaaaacattttaaaaatcccctaagagcttagactttgtgagaaaaaaagacccagtgggtctcagaatatgcttctgatagcaaataagtttattgtcttcatattatcctttataaagaatgtaacagcttcttttgatagttatacattacaacttaaatggctgatttgaagcattaattaaatgtgaatgtaatctgtacagttttgtaaacggaaaaataagcttagtattgattgtcttgaaaatgcagcatttccttgggatctgttttacagcattggcatggttgcatgtgccagtgcgtctcagccagtggattgtgggtatgcacttttgtggactgcttctcagcgtcattgactcaaatgttgtttatgtttcttcatacaataaattaattttttcaattttctcttgcattttatttcttgtataatcctcaaatgacttctttttaaaaaaatttaaggcccatttgaaagacaaatttgaaaatggtttgttgtgattatgaacttttataatgtaaactggaaatccctgaaataggatgagaagttcaagaatgcaaagattcaggctttcaatacaacagctgcccatgaaaacactgctgccttgtaagaattggctctatagattggagccaggctgctgaatactaccactgagactctgattagttatctcacgtgttgtgtatgacacaaagacagatgtgactatataataataataatggttattactactatatatattctacataacaaatataaaatacaaggatgacagactttggttgagtgtgaacataaacatactacaaaatgaattccttctgagactagaaaaatatcactcattgaaaggggccagtggggactgtgggctag

SEQ ID NO: 35576 - DNA, 1875 bp, Mus musculus
tgctaatgagggccggacagtcaaagacgggcacccagatctcggaagcataccaatctaagacagaggtacatgccaaaaggacatggctgttgataacacaccacagagacatgttttgtgtgaaatataacacaaataagctgcacatagcctccaagacagaattggatggttcaggaagatctaagatttcctaagacaggtgcagctgccatccaccataactcccaggcaggaagagcataaataaattttatgcctcagtccagcttttttttttaaatattaataacagggggtaaattgtaacctcccccagcctaaagcaggctaagccagaccttgaccttgctgccactaaggagattacctagggtggagccttcctccctagatcactctattgttcagtcactgccgctgttccccttcaagatactgttacctgctgggaggccactgagctactctggagaatacaccctatcctgcaagtcgtcacttctgcagctggatgaattggcgggaatgggcctccccacccccactcccactttacaagcgcatttgccattaaacatttgagctttgatcaggaaacttgatttagctccatttttctctcgaccgcctagttctctctctttcagctccagtctgcctcccaggtgtatcctgtttcttgtgagctgcaggtcagcttccaacaatgcataagacatccttgtcgggtctagaagatgctatatagcatcagtcatcccagtcttattccttacaatctttgtgccccatcttctttcatgttcctcaagctttaggtgtaggggttgcgtggtaggtatacaaggttaggacatgtcacttttgataattgggttttgtcaatttgatagaaactagagtcatctgagaaaaaggaaccccacttgagggactgccactaacagcctggcctgtggaaatggctctgtgacagtttttgattaatggttgatgaatgagggcccagatcactctgggtgatgacacttggtgggtggtcctgagtaaacagtggaggaacaagccagtaagtagcactcctcaatggcctctgtttcagttcctgtctccaggttcctgccttaaacttcagcactaacttcctccagtgatagatatgatctgtgagttgtgaaatgaaataaatctatgttgcttttggtcatagtgtttatcacagcaacagaaagcaaacaagaacagcacatggtcacttgttctctgagctttgactagttgtggatctctggagtagctgctgtagcaaaaatgaagcttctttggaaagggaagagagctacacttatctgggtataaggataagtgattggaatagagttagaaatgtattgggttgtcctctagagcccgtgattgccccagtcacaattggttggttaagttcatggtaccagacacaaattccttcctaataaaggtttctttagtgtaattagacagatttcagttacccagagataaaagtgccacagttgtaccattcagaatattttgcctggccagtcattgctgtggtctgtaacctttacatctgggtaggacttctgatcacattttaacctcagtagtttcatagcatcttctgattctgtaagacctaggcattagagaggaggcttccaagtcagctctagctcaattcctccacaacatggtataattctagttctgatttttagcacatgataggagagacagactgtggccacaccaggcatacatcactgacaaagaggaagagaaaatgattttatttttgttcctccgaagtaaaaagtctaccacaggatgcaaaaacactgattg

SEQ ID NO: 35577 - DNA, 1115 bp, Mus musculus
gcatcatacactgcagcacaaatggactaggcttacagtccttagactgacgtgcggcaaacagtgaggctaggatggagtgggccttacagtccttagactgacctgcagcacacaagcagctagaatgtactgagccttcaatacttagacttacctgcagcacactctgcagcaaatatggactgggccttacagtcattagactgacctccagcacactctgcagctaggaaagactgtgccttactgtccttagactgtcctgcagcacacactggagctgggatgactgagacttacagtccttagcatgacctacaccacacactgcagctcagatggactgggcctgatagtacttagtcttacctgctggacacactgcttctaagatagtctaggcttacagtacttagactgacatgcagtgcacactgcagctcagattgatttggcttagagccattaaacttaatactagcatgctctgcagctaggatgcactgggccttacattccttagtctgatctgcagcaaactctgcagctagggttgtcggggtcatagagtacatatgctgacctgcagaacacactgcagctcagctgaactgctacttacagtcctgagacttacctagagagcactctgcagctcagatggactgggacttataaaccttagactgacctgcatcacatactgcagcgcagatgaactggacttacagtccttagacttactgcagcaaatactgcagctcagaaggattgtgcctaatagtacttagactgtcctccaggacacactgcagctcagatggactgggcattacagtccttagagtgtcctgctgcacactcttcagatagagtggacggtgctttccagaccttagactgaccagcagcacacactgcagctcagaaggactggtcttacagtccttagactgacatgcagcaaacactgaggctaggacggagttggccttacaaaccttagactgtcctattagagctgcacacatggcagctctaatactgggaattacagtacttataattacctatagaacactctgcatctcagatggacagggctttaaagt

SEQ ID NO: 35578 - DNA, 2370 bp, Mus musculus
caatgagttgtagaaaatactactaaaagctgcaagtgtatgtgcatgtgtatgtgtgtgtgtgtgtgtgtgtgtgtgtgtgtgtgtgttgcttagtgtttggtaattgtgaggttttgctagtatatcaaagtcctcttcttgtatgccttcaggaacctgtaccatcagatgggagaaccgtaccatgaactgcatcgtgaatgtttttgcagttgcgattgtcctgtagcctgtaatgcactaaaaaatgtgttgggttaaggccattaacttaagtttgtgagtgtatcctttctaaaaagagttacaactacttattaatgtgctagatgacaagtgtgcaatatgcttcaaagctatcaacagagaactgaatattgtaagcagaagtctaataggaagttggcagaattatctcgtattctatacagcatcatttaaggatataaaatgttagttaacaattaatgcagaaatatggctgacctaaacttagaatcttctacttatacaagcctttcactggcattatgttcccccagagatggggaaatctatttagatactaacattatcattaactagaaaacacaacagggagaaatatatgaacaaaaactacaaggagaaatgcagagaaaatgacatgaagtacctaatacctttctggtttaagttttattcctttgttgaattgcatatagtagttcatagagagtaatttgacacacatacacccgccccatctaactagttttcttttcctgagaactggcaaatccattgattttttttttgtttgttttaatgccagtttcttacatttacacttgaggtggaattaaatatgatcgaccagatttcctgggtgaacaaaattagtaaagtatatgatcaacagtatatgactcagacaactgccttacaatccattgcttccatgagagatgggcaggtacctatcggatgtgtgctctgcatgtttctctccaggcagacagctcttaacgtggtgttcacgtggcattcacatggcgttcacctggcaggttggttttggcagttattcagttggaaaaaccagtgtttatgtttgagggagaataaaagaaagaaaggaaaagagtctggtcctccgtggaaaattaaccagaaggagagcgctaattggtgacagaattatagatacagtttttaagggttgcttcccagaaagtaatacatcaaatatgcaactcttactgaaaggccttattagtagtcttagctatacaatgataaattttattgaattagtttcaactgtgtgtgactaatttaaaaatacttatgtagagttaggacaaatggggtagaatatacattaaaagtgaacaatcattagcaggttatctaatatctcagggcttatgaaatatagttcaatttatttaaaaaaatcaaaaataaatattcggatacacagctggccaccaaatgcaaagtcagtctgccatttaaccttcaaaatgaactcgatttcacatcttaccattgccacgcaatccatgtaaacactggaatcacgtgccattgaagttttaggggaaggaaacgtttagtagtaatggcaacaacattaagacaggatcctcatatgaggaccatgtgcatggttgacattttgcagaataactctaatgacaagaatgcaaagatggggtttaatgaggtgacctgtagctttggcacgtccagagttctttgtcattacctttatgttactttatgctgctggctcttgtaccttgggagattgtaacagtgaccaaattatctgtgcatttaaggcttactctttgattgttgttgttgaaggctcattttcaaagtatcaaatcatacctcgtgagcttgctatctgctgtttctagttaaaaatataataaagactatcttattgtgctgaacatctggctctggttgatccttcagtggtcaagaaatcaggatctgctttacttgaataaattccaagcaggataattggaggaggaaaataaatgggatcacataaatatattacaaaaattaatatatcaagagtgtgagaccagactcagttgcccaacaaaactgtgtctcaaaaatattattacccaaatgtattcttcaccatgacagaatcattaatagcttctcttttatatattttatttatggtcttgaacacaacatttttctttaaagtaagcataaaatatatttggtaactgctttttaactcgtaataattatttttagcaaattgtcttgtttgtcaaattgcaaaggagttgttgcttatttcaaaaaattagggaccgcaagtaaatacgagtattcatg

SEQ ID NO: 35579 - DNA, 1160 bp, Mus musculus
gtacaggggaacgccagggccaaaaagggggagtgggtgggtaggggattgggggtgggtgggtatgggggacttttggtatagcattggaaatgtaaatgagctaaatacctaataaaaaatggaaaaaaaaagatatctgtctttatttgccttccttattttatttaacattatgtcttccagatttattcatgttgccataagtaacagaattttctggttttatggctgaatattactattccgtgtgtgtgtgtgtgtgtgtgtgtgtgtgtgatagttggtttttaaatctacttttctattaatcgacacttagctttttcctatgtcttagccattacaaattaacgctgcaatgaatatatgatttaagctggaaatttttatctaatttacaaatgaaattttaggactattggtgctttcctatattttacaaattatctgttattttatagttagatataataataagcaaaataattttaaaaccgtatattaagaatggggaatggtagctcacacctataatgcagcaactgggagtctgaagcagtaggattgccatgagtttgaggcaagtctgggcatatagtgagttattgtcatcagcctgagctacagtgtgagagtctgactaaatccaagaccagtaagaacaacaaaactgtaactgaaatttaaaaaagaaagactaaagcatttaagctatccaaagcttatatatgtggtatagctactcagatctccccctctctcattcactcactctgtgtgtgtgtgtgtgtgtgtgtgtgtgtgtgtgtgtgtgtgtgtgtgatccctcacaggtgtatcctagtgcaattccccatgtcataaggaaaaccatcatcaggctgtggatagacatagaaagctggcgttgactgcatttcagcaccccatttggcaaggaataatgaatttgggaatgtatgtggctagtctctgttccttgccattcagaaattgctgactcatagaggccagtacaagtagtttttgttgttgttttgttttgtttgtttgtttgtttttcgagacagggtttctctgtatagccctggctgtcctggaactcactttgtagacaggctggcctcaaactcagaaatctgcctgcctctgcctcc

SEQ ID NO: 35580 - DNA, 1293 bp, Mus musculus
agtacatactatccctgccctgctcccacccccagctccctgcagcccctccccctacgtgcaactgacactcctacccagtcaaagctctgcctttcagcccacgtcatacgtagtgtccatcttgtgaagccctgttgtgccccacagtgtagccaggccccctgcagctagtcatagtgaagcccaccctaaggccctgtgagcgccagctccctcacatgtacttggtccaactgtaggtgactggttatcacatcttcactggcccctgtggccctgcatgtagtaggggaggcttcagtcagcccctcactgtggtccaagaatgccacacacctttccgtagatatgccgatggtaattatcttttcttttggcttaatccgatttggtttggtttttccctttccctggattctttcctaccttcttcaggctgtcaagcacgggagaggagacacagtgggagggattcataaggagaaaacagcgtctggcaggcatggcagaaagtgctgttaagcattagctggcttccttgttcattgttccaagagatgggtgtggagagacggcttagtgtaggatcctctcgaatgaagcctgtgtaatcctgttacaggttgtgttgttacttccctgatttgccccaactacttactattatttcgctttcgttttcctgtatttttttcttgcattgacattattgacgttgaggacctcatcagatcaatttaaaagtgagtgtggaagggaaacgaaagtcaacatatttttaaaagatcttaaaaataatgcctctgtctagcatgccaacaagaatgcattgatattgtgaacatttgtgatacatgtattaataaatagagcaattaaaaatggctatgttgtggttttcttctttgattgcgatgacaatctctgaattagaacgttcccattctatcctgctccccagggcttggcagacagccccatcttctatatggacacagttgtctccatgtattcccacctaagtgaaacgctgggcaattgttttctttttttaattatttggttatttcagaaacttgaatcacttatcatgaacaagatagaccgttgactgcagagttagagccttggtagtattctgtacctctgaaattcatgaaagaaatacaaaggtatcagcagagttttttaagtcctgatttaattttaaaacgagatgagtatcttatttctttcatcatttctatggctatatagtcttccctctttccttttttctttggttcaggt

SEQ ID NO: 35581 - DNA, 1191 bp, Mus musculus
acatacatacatacatacatacatacatacatacatacatacataagaaagcattggaagcatgggttatgatctagaaccagtaaaccagagggagatggagatttgccagtctgggttctagagttaccaatgacttttctgtctgttatcagctcttgttcccttcaaaattgaaaagagacatgattttcggtagacagtaccagtccttcaagaaaaaacaaacaaacaaacaaacccacatgcataagtgtctctccttgtttggggcgcttttttgtcttgcaggggaatgccatactaaaacttccccccgaagactttagtgggaagaaatttaaaattagaagcctgagtcatcttatctggaggaatggaagagctgactggaggttgagggatgtggcaaaggaaatgagatgggaaatgagtatgggctcagggctgggaacctgaaagaggagtttcaagtgtaaaacttgaaaggtagatccagggctatggtacacagcttaggcttattaagtaacccttgcttaagaactatcttttgaaaggagcacttgacacacactccagaaagttattgggtatactcccattttttttctttaaatgataagatatacccaacaccagtcctaacttctgccaccttctcctagtctttttgatagccaaaagggccacaaggcccaagttcacactccattgccatgctcttatctcttggtgggggacacaaaactatagatcagatgaccagggtgctcttcatacctggcagcagtagtaggaaagaccccgccaggagggaagcaaatgcctcagtgttcccatccccctgcagctgaccacgacctgggccgtggagggagcaccccatgtccacgtgcatccggcatgtcctgctaactcttcttacataagattcccaagtatggagtcagggcagctgtgaatccctcttacccgacgtctaataataaatcgaggctaaatttccggactgcagtcactctaggttcaggattgaggggctcttttgcaacccggacacacaagcattccggtcatcccacccggagagtgcgcgccaagcccgcccagcccgcgcgcgccagtccgccctctggtttggacggcggctccttgggctcagtgcctcgccctccctcccccaaacag

SEQ ID NO: 35582 - DNA, 1312 bp, Mus musculus
tggtggaattcaccaatgagctccagacactgctgggctcctctgtggagtggctccaccctagtgacacgggccatgaaaactactggtgagccacctgccccgcccacccactgtgtacagtgtgttatagtgttaatccttgtgcatatgtgtcataatacaacaatttctgtaaagaaaggacactattacatatgaaaatatctcttctttatataagagaagttactccggtcagaagaacccagaagcccgtgttttctttctaaaattttaagtcagtttttatgaagctgttgaaatgtctttatttttcagtgtacacatgctttgaaatgtatgttcgtttttacttggaacatttttcttttctgttcttttctaaggagaaaaaaataaatgaataaatgaataaatgaaaaggagctctgtgcttggcgtaatttcatacaaagctctggtggcgggccatgggtgtattgtgtggtgaggactatgtgtttggtttgctggagtgaattgggtgaaggcacttggtggtggtatacttttatgttttgtttacagagtacctgctcacaccaggtaaatgctattggacgtgatccagtggtatgtaatataaattcaaaccatatccacacacaacaactaattgtaagaaacttttgtatcctaatttaaaagctgtgaaattacttttcacacatcaaaccggattgtttatatgtttaaacattttatgctcttatttaaagaagactttgagctatttttttctgtactctgtaaaatattgaaaactaacataatatgttgaggttgcttgaaaatgtacataaaactaaaattttctgaattgtgtgtttatgtttgaaatctgtgttttaactttgtaagtaaattctctgcctttgtatttatattttacaaaaatttttcttaaaaggcaataaacctgttgaggaaaggagcaaattgaagtactttgcatcctttgtattccggaagtagttagccattgtcacgggctttcctgtacatgaggatgatggagtccctgtgggcaacttgtaaacaagttcgtctccacaaatcaaagtagactaaggcctttagggaagctattctgagaatatgattcatcatctcattctgggagtgtgattcttagatctctctctctctctctctctctctctcatccctttttgaggttttggggatcaaaaccagaccctcacacatgctaaacaactatactaccattgaacccatccctacgtttattttagaaagtgttctcact

SEQ ID NO: 35583 - DNA, 1221 bp, Mus musculus
gtccactgctcagacaaaagcctcccatggaagatgggcgtcaaccctgggaacccagtagattcccacagttacccccacatccaaaacagtaaacagccccgggtgacctctgccaaggcagtcaatagtggcctgccaggggacacagctctcctgttgcctccttcacctcggccctcagcccgggtccaccttccaactcagcccgctgcagagacctactccgagttccacaagcactatcccaggatctccacctctccctcagtcaccctgacgaagccatacatgacagccaatagcgagttctctacatccaggctgtccaatggcaagtaccccaaggctctagatgggggcgactgtgctcaatccatgcctgggcacacccggaagacaacggttcaagacagaaaagatgggggctcaccacctctgttggaaaagcagaccgttaccaaagatgtcacagacaaaccacttgacctgtcttctaaagtggtggatgcggacgcttccaaaggtgaccacatgaaaaagatggctcccacagtcctggttcacagtcgggctgcaagtggcttagtgctctctggaagtgagattccgaaagaaacactatctcctccaggaaatggatgttctatctatagatcagagatcatcagcactgctccctcatcctgggtggtgccagggccaagtcctaatgaagagaacaatggcaaaagtctgtcactgaaaaacaaggctttggactgggcaataccgcaacagcggagttcctcgtgtccccgcatgggtggcacagatgccgtggtcactaatgtttcagggtccgtgtccagctcaggacgcccagcctctgcatcaccagcccccaacgccaacgccaatgcagatggcaccaagaccagcaggagctcggtggataccacgccatcagtcatccagcatgtgggccagccctcatccacgcctgccaagcacggtggcagcaccagcagcaagggagccaaagccaacccagaaccgagcttcaaagcgagtgagaatggcctcccgccaacctcaatatttctatctccaaatgaagcattcaggtccccagcaattccctaccctaggagttacctcccttacgcagcaccagaaggcatcgctctaagtcccctctctttacatggcaaaggacctgtgtatcctcacccagttttg

SEQ ID NO: 35584 - DNA, 1181 bp, Mus musculus
ccttcaagtatctaggtgaaagtcacgaaggggctgaggctgtagctccgtgtgttcagtgctctgcaagtaagaaagcccacgttctaatcctcagaagccacagaaacaggagtatctgactgtgatccctgtgcccctgtggcaagatgaaggacagagataggagaatccacagactcaagggccacacctggcagacagagtggcaaaagatgagaccctgtttccaaacaaggtggaagggtagactgacatctgaggttgtcctctgacctttacacacacatcatggcaatgtgtgtggccacacacacacacacacacacacacagggctggctaatcttatgtcatcttgacacaaactagagtcaattaaaagggggggggggggaacctcccttgaggaaatgcctccatgagatccagctgtaaggcattttctcaattagtgataatgaggaagggcccagggatgtaccatccctgggctggtggtcctggcttctagaagaaagcaagcgggtagtggtggcgcacgccggtaggatttgctgaaggaggcagaggcaggaggatcacgagtttgaggccagcctgggctgcacatttaagctgggcacggtggtgcactcctttaatcccagcactccggaggcagaggcaggcagatttctgagttcgaggccagcctggtctacaaagtgagttccaggacagccagggatacacagagaaacactgtctccaaaaaaaacaaaaacaaaaacaaaaaaaaaaacaaaaagaaagcaagctgagcaagccatggggaacaagctatacagcaatacagcagcacccttccatggcctccatcagctcctgcctcaaggttcttacctgggttgagttcctgtccgcccttcctttgtgatggaccacagagtggaagtgtaagccatataaacccttttctacccaacttgcctttggatcacagcagtagaagcaataagacacatgtacactattactttaaaaaacaaaacaaacaaaaaaaaaaaacgaagatctgaactgagttcacagctctgggaaagggggaggggcaagaggatgaaggccagagagacactgagatatgaacttgaccagactagatgactagtttacagtagagggaaggacatggggaca

SEQ ID NO: 35585 - DNA, 1156 bp, Mus musculus
gagcaaaacctgagctagcccagcgctttccatctgtcagtcgcagcgggcgggaggtgcaagaccgggaaagaccgaagcctgggttgaaaatcgtcaccggaggttggacaaagagtccacacccgggagtaagcctcactgtgggctttcgagaacctgcaaccagtggggccacctgctctaaccgcgggccctacccttcatctcgtgaccggtcgttgtgggccggcgggacagaaccgccctgttcttaaaactcttgactcctattggcagagcatgccattcatcacgttcgcctccgccccaattgctgacgtcgaccaggctacgtctcgctcgtgtagcggcgtagttggcgattggctgagaccttgtcttggagcggctaaaggggaggggcttggggatcggaaccgtcgggagcgcgtcactcggtcgagctgcagtgctcgcttgagtcccggcgtcccttttcgtgtggctcatctccgcttcagcaaccgtggcaccatggctgtgctggtcgttctcctgttctttctggtggcgggtgagtagctgggaagcactgcgggaagctagggggcgcggggaccctgggagggagcggctgctggcgggggccgcagtgggggcggtctgggcttggcggccctcttcggggttctggaccttgatctggctcgggcggagcggccttgtggtctctggagacgagcagggccacctggggggactccggagctgacatcagcctttgggggtaaaggcgcgtagccgcttaggacccagtcctcccatttgtctgatcactccttccctgttcaaggccctttggaggatgggtttgcatttcttaatacaccgttgaaccacaacccactaccaaggaaaggttagctaacaatttagctgccgctttttagctgctgtcttttttccaccttcatttctaatggttgttattgacaacgggtgaacccttacctccctcatatatacatatcaggatgtgaagttgagtcatcgttttttaaataatgattatttcttaagatgatcgcaatttcttagtattgatttcagttcccaatttgaaggatttggagagcagggtatgagtcatgcttttaggatcacatgtcaaata

SEQ ID NO: 35586 - DNA, 1634 bp, Mus musculus
ttaatcagaacgatgttttaatcttaaagttctttcctatttatatttttttcctttcctcatttgtagaacacccaaagtccctataaccttgcatataagtataatttggagtattcagtggttttcaacttggtactgtggattatgatcggcttggccttggctgtgataatcacctcttacaacatttggaatatggatcctggatatgatagcatcatctataggatgacaaatcagaagattcgaatagattgaattttccttatgctagacttagacaacaggtttggtaattggctgttttgttaaagtatatcttttagtgttgtttaaagtagacggtataccttaagtttattaaaaagaaaacatagatttcattatctattttgtgtgtgcctattgtttctttagagtgatttatagtgttgacaagttgaattgtgatatagattcaatgtgctcaaatattgttgacatagccatttaataatgtaatttcattccatttaatacatgtggaaatacgcactgagagaactgtaaaccacttagtcatgttactcgcgctggagaacgcactgggtttcttagagaaccttaaaatgcttgacttcttgcacaggctacgtagtgcagctgttagtcactatgaactatttgtaaatgtcttgatctgctgtaaatatctctgagacaggaggaaatatgttaactaagagcagcccaaaaatactggatatgcttatccaatcgcttagttctggacgtgtatatgactagcaagctagctgtttttaatctcttctgcaagtttggtgatccgtgtggtttagtagagatattaaaattattaaaaatactatgttgatttcagaagagactagctttgtggaatatagatgcttgtaattaggtacataaaaacaaatctgtgggggatatcttgaagcatgaatataaaatatttttatttctgtactttccccctgtgaagttactcttggtttgtgtgtggtatggcttcaatctgtagactattatatggaagtggatgattgctactgttcatgtgcaaatggaccaatatctatatagaatgacaaataaagataatgattcaaaatctgtgtcactgcaattctgaatttatattataaaaacctaattaaacagggtgttatttcaccaggactggctggtttattatacaaagggtgaattcacattgttttctacatttgcttattctcattgcctcctaagactttgtaccaatgtaaggaaagtattttaattgctattcctgttactgaacttgtgcataataaatttacacttgactgtgtaggaaaggtttaaattttcctgtagccttttaaaagatgaacaaacacttggttagaaaataaagggctttctaaggtgaggaattatggttacagttttatttcttaaaacacatgtatttgaaattttaatttcctgcctgtattacgtggcaccccacccccaccagaactggcccttagttggcttgtagctgagtccacctctttagaaatgctcatttctagacaacattgagcatggcagctttgaaagggagtggtagtttgtttttgaca

SEQ ID NO: 35587 - DNA, 1365 bp, Mus musculus
aactgtgcctgggtatgtccgaatggatgttcacaagttgaggacctactaaataagttgtagaacatctgtactatgccacctgtcttagtaagggttctattcctgcacaaacatcgtgaccaagaagcaagttggggaggaaagggtttattcagcttacacttccatactgctgttcatcaccaaaggaagtcaggactgaactcacacaggtcaggaagcaggagctgatgcagaggccattgagagatcttccttactggcttgctttccactggcttgctcagcctgctctcttatagaacccaagactaccagcccagagatggcaccacccacaatggaccctccacccttgaccactaattgagaaaatgccttacagctggatctcgtggaggcatttccccaactgaagctcccttctcagtgataactgcagctgtgtcaactgacacacaaatccagccagtccaccacataactattctaaagaatgaccccataatgaagtgcagtcatgggaattacctgtaaggcatctaaaggaaagaaacggtttgaagggtggactggagctccgtggtggggcgcttgcctacccagcatgtgtaataccttgactagatggctgttccactgccaaaagcaaatcaatagaaaaacaaagtattgaataatgatgagcatgctatagtgctgtttgtgtgctatagtaactgagctctggaaagggatggtctgctttctaagcctttcttctatattatgtctctaagaggaattggggctgtgggagcagtcagaggaatttagcttttctgctttgtatattcttttttataataaacatgcatctgtgtattttgaaaaattcttacagtttttaatttcaaaacaaggcgcatgaataacacaccaaattgtaagccatgcgagtcagattatatggagtttgctgtggcctcttattttgtagctccacccccaggggtgcttttgaatcctagcaccagggaaagaaacccaggaaagacaagccttctaccaaggctgccctcatcgcctgtagggtgccttgtctccatccagtacgctttacactcagcctctccccgggacactggtgcttgatagtttgaaagaatttgtagaaaaaaaatggctaaatcatagttgcaaagatcaggaaattatcagagattgcctcctttccctttactaggttaattagaaatttacctgctctgcaaagcattcactcaacagtggcctgtattaaaacacattcaaattataaaatacactttgcaagacaggcctaaatagtaatttcaactcatgtgattctcagtggagtga

SEQ ID NO: 35588 - DNA, 1101 bp, Mus musculus
atcccagggtgctgcgcgtgcttaccgccggccccgccttcaggagtaagacatggtggtgtcggagctggcagcccgcctcaattgcgccgagtacaaaaactgggtgaaagcaggacactgcctgctgctgctgcgcagctgcctgcaaggtttcatagaccgtgaagtgctctcctttcaccgtggactgctggctgcagtccctggccttggaccccatgctacctgccgcggcggttcccggtgcagcccgcgcgctcgccaggtgagctgctgaccccgaactcgggcgcgtctccacagcttgtccccctattccgtatgcttgcagtctttttccttcccggggcgggactgcttcctacttccggggtgttcctgttttgctgccccgcccaccccagtccctcctcacctctgccctctgtagtttcagcctcagtgtcaggtatgcgcagagtggaaacacgagatcttgaggcatcacatcaacagaaatggagacgtgcactggggaaattgcaagccaggcctctggcccaaagacccttgggaggtagccaaggtaagtacttgtagcctggaggaaagcatatgaagttgctcctggtgccccagggtggagggtgggttttgagtgcaagctgggacttcagaaagtacagaaatactagaagataggttggttctctggggtctagtggcgtagtggtgaggggatactagagtggacccatctaagctcagtaaaataaacgcctctgtttcttcgcttcctgcaggcacttgagttttattgtaagacgctgtcttaaaataaggggaaaaacaatacaggctgagagacatggaagaacagttaaggtttactttacagcagactttaaaaaaaggcttacttttgctgtggcgtgcgtgccaagaggatgcttagctaaggtatacatttttagaaggtagaaatattagttatgaggtaggggttgttaggcctgtgtttagattttgtcactgtgacttaatgcctagtctgattgggaatttgcttggatttcttgatgttgcctggaagctgtgtagtgagtggagggaggtgtc

SEQ ID NO: 35589 - DNA, 1648 bp, Mus musculus
ttttcttatgttttgggtgtaatggtcctttttgatttttatttttattttttaaggcaggtctgtcagttttgaatactgtaaaactgtgacaaactttatattgaagctgtattttaatatgcccgctttgaatccttactccgaaatggttttgggagctgttaaacacatcccaaagaagcaatatttaataaaactaggatctaaaagagacacttgtgtatgtataagctctctagagttcttagggcctcccttcatctttaatctggtggggccagtcagttttttaattatgtatgtctgaaatttgaccaaaaacattcttgttttaaggttagtttcttcagacattcctaacctgactggtgatagtctttagcacctcagttgtttttcagtataggattttgctaaaatgaaagagctttgtctttaaaaaagagatcaaggatcccaaagaatacgattctcatatgtgagaaaatgggaacctttttgctaggaaaatgtcatttttaaggtatacttaaaaatgtatacagcattaactaggaacaaaaacgtgactgctctaatttgcatgacgtttttcttttatcttatttaactttttaccttccccagcccatttggggttgttctaaacaatctcaatttaatctgtcgtcagcaagacaataggacgttttgctggtcacaacctagtccagtcatttaaaaagtccacagtgcagtgcctgtccagtgttcagtggagtttctggcactggtacatctcaataggatttctttttaagagtactgtactgtctcttgaagccagtcagggactttttaaactttaatgaatatggtgtgattcaaatgtcttctgataacttgatgttatttggaggagtttttgttttgttttgttttgtgtgtttttttaaatgataatatcatgctgagttatctagacaatgtattatccttgatgaaattttagatgtttgtctgattacattttaagatgattgagcttctacaagtataaccatgaaattctagttttttaagtatcttactgcaactgtatcatgtgttctcctcaacttggcttgagtctcccttgcagtcagagttgaggccttctttgtcttctttgtctcttttctgctttcatctcctgcttttcacccaactctgccactgttccagagtaggtgactaaactttgattcttcctttagcttaacctttttctccttctgtttccagttctcttcacagtactaatcacatgggttcggcaatctaagatgtcttgatcaggagtcaatccttttctatttggagctgaatcctagctttcatgtagaaatctacatgtatatacaagaaatgtatttttatctgcaggatgatattgtttcaaataattttattaatagaattaacttttcaggtattttctcttttaagtgtggttttaaaatgttaaatgaatttttatacatgatgcattcaatggctacttttttcctaattataacacctttgaatgcattgtgtaaatcaagtaagataggattcaatgaacagaatttgattttgatgcttattaagagtaaaccaatgaatttgaattttgatatcatgc

SEQ ID NO: 35590 - DNA, 1134 bp, Mus musculus
agctggcacaagtgagtgttgtcagcactgtttttccaaagcaaacgccaatgtctgactccgccttcacatttcaaagtcacagtgtatttctctaaggagaatttccaaaccttaaccttttttcctttacaaatcagtctgcgatattaattagcaatgtcatgaaaaatgtattaagaaaccaagtctctgcacctctgtcaatgtctgctaacttatgtcttcaatattgaaccataaaagataccttaagttaaccaccaaaggcatagaagttaatataaggccataatactgatgaaagactggacagttgattgtaaataggattttctagactcggtaggtggaaagaattatttttctttgaaggaaataactttttatcatggtaattttgaaggatgattcctatgacatgttcatgggggaatgtggcttttacaaatcttgtattggttataattgttcatatcttcttttctgtgttgacttcattattcccatggtattggccttttaaactatgtgcctctgagtctttgaatttataaatttgttatcttaataaatattgtaaaaatgtaaaaaaaaaaaagattttaaaagtgtatgcattccataactttcagtgcttaaagcaacaaatgctatgttagctcacaatgtttgctctgataactctcctgagctagttgacttgtccatagcctcagctggcatggattctcttgtttacccagtggatagagcacatgacagaggacatgggagtcttgtaagtattccagcatcccttgcaaaagcaggtcacaggaccaagcagagtttaggttgagaagcagaacccagttccttgaaggagtccctacaggatcatattgaacctgaatacaatcagaagattcactgtagctgattctgctatctgagaactgacatatgatccttcataacaaggactagttacaagagttacaattacctggcaactgtctgatgaaggcaaagcaggcagcaatggcatggtgtgtatgcattcataattgaagttacctgttttccttcccaaaaggttcccagacaatgccaaccaacatgcctccacctcgaaaactacctcagcgctcc

SEQ ID NO: 35591 - DNA, 1224 bp, Mus musculus
gatcctcatgaaagatgtttggagagtcaaatagttctaaaggctgcttctgaaaacttgctcccttaccctactcctggtgtgttcctgctcctcagagaaaactgttgtcacttgtcagcacttgtcaggtagctgctactctttgtgtttatatagctgtatctctgagtaccaaggtacgctgtcacttgttgagtaattctcaccctcaaaagggagtgcttacaactttgaaaacttggtttcacttactctttcttccttcaggctgctcctagtatataagtaaatacattggcctttctcctggttttacaataaggttatgtagcaattgtgatttcgtaggggtttgtttgtttgtttgtctgtttgtttagtattcttgttgttctgaagatacttgtccttttgggcctccacatggaactgcactcatgcaaaaatgtgttctcacaggtctacatgcaaacaaacaaaaaaccctagtcaaaactcggttgggattagtgtggctcctgggaacacatgagagcaggagcttgaggtgtgttgctctgttgtgctcacagtcaggaagcagagcaggttgcttcctcctttatttagttcagtctcccaggctccgtaaaatctgttactcacattcaggatgtgtgatcttaattctctggaaccaccctcagaagcccattcagaagtttgtcttctgtgtgactctacattcctcatgctaacagtcaggttaaccattacacatcccatttctttctcttacattgctgatttttgtagtatgcctgctatagtagctgcctggaagaaggtacataggagattggttgaagtccatggaggttattggagaccttgtatgtttgacagtgtttttagtttaccttcatttaactgagagtgcctaggtatagaattctagactacgatcattttttgtagaatgtttgaagctctgctgctttgttttctacattggattgtgactggcctgaaccaagtgcctgtaagccttaataatctccttgggaggttgttttgtcttttttcctcacagtactaggtttcaaatgtaccttgatactccttacatcagtgctggggttcaagcaccttatcccctgagccatctgcccagcccagaagcatgttctcatatggatagatcactttctcttccctttcatctttcaatcttaactccat

SEQ ID NO: 35592 - DNA, 1237 bp, Mus musculus
aactttgacagtgcatttggaactgcaaataaatgcgtagtagagtagggatttaatgtttacaaagcctggaagtgcttttaaaaactcagtcatctttctccttcattccatgaattcttaatttggctttttgttatgctgatctatttattttctttgctgtctgatagaatttctttacccttgtcttccatccctggtattgttttctgcttggtttagtctattgttttatttacttatgtaggaatgtttcttgttcatgtttatcatgtgtgtgcctgatacttgaggtgtcagatgaaggcatttgatcctgtagaactggagttaaagactgttgtacgccacgtgtggggttagcaagagctcttaaccactggatcatctccagccttttgattttagtgtattggttggtgaaactttccattctggttttctgtctccccttgcccactctcaaagtctctttttttgctgaactttttatcagtcttgttaatttcatgtctgtatttcaggcctttgaaatctggatctataattgactttcttacttacttcatctgttttgttttctaaaaatatttttactggcagaaatcctttttccagtattggaactaccttaatatctggatttgttgattgaggaattagcttttgtatatgctatgctgatttgttttttcatggttcttgatgcacctgtctgtatgggatatctcttccagttttagtggaggattttttttttttaaactgagaaactttttcttgagggatcaacctccactatcgttcagagaggagaaaactgaggtgctataatcaaacctgatatgggaatacagttaaaatcaatgctaacttgtataattcctatgaccacagaacagaaaataactaaaagagagcagaatacattatcaccttaaattttttttaaagatttatttattatatgttaagtacagtgtagctgtcttcagacacaccagaagagggcgtcagatctcgttacggatggttgtgagccaccatgtggttgctgggatttgaactcccgacctttggaagagccgtcaggtacttttactctctgagccatctcaccagcccatcaccttaaattttattaaggataaaagtaaaagtagtaaatgaacaaaataaaggtcaaaagaaagcagaaccaaaactaagagaaaaagaaagatgaatgttagga

SEQ ID NO: 35593 - DNA, 1207 bp, Mus musculus
caggtatgaagaagagctttcagaaattggttctctccttccaccatgtgtgtcccaggctggtgctacaccttgggtcctcaggcttagcagcaagcacctttactcactgaggcatctcctccaccctgctagctttttttttttttttgagacagggtttttctgtgtagccctggctgtcctggaactcactctgtagaccaggctggcctcaaactcagaaatttgcctgcctctgcctcccaagtgctgggattaaaggcatgcaccaccactgcctggcactagctttcttttatagtaggatttatctgtacaataaaactagatgctgttttatccctctgcagtacaaatatagaagactggagtagtggcacatacattggaatcccagcagttgggaagcagagacaagtagatctctgagttgaagatcagctcaagatcagcctggccagtcagggttacacagtgaaaccctgtctcaaatttaaaaagactaagagaagctggggtgaagctcaatgatataatacctgattaacaagtacagggtggggtggggttcacatgtagcagagcaattccctcgctgcgacctattgaaagtcagccctcgacacaagggtttcaaaaaaattaaaaaacaaacaaaaaacaagtacagagccctagaggccatctccagcaacacacacacacacacacacacacacacacacacacacacacacacagagacacacacgtctgtgttagtggtaaagatgtcagtgggtaaaggcgctttctatacaagcctgacaaccagagctcaacctccagggtgcacataaaggtcaaaggagcgagctgactccacgaagttgttctctgagctccatccatgtactgtatgcactgtggcatacatcctccactaccccacaacaatactagatagaatatttcaaaaaacaacaacaacaacacacacacacacacacagagagagagagagagagagagagagagagagagagagagagaacaaaactaaatacaagctaacagggacaagcattgagagctatgcattaagatactcagggcagccatggcgcattttgtgacatgtccaatttgtgacagcagcaaatgcatactgacagaaagcatggaaagccaaataagagcaggagccaagattgtagggttctaa

SEQ ID NO: 35594 - DNA, 1198 bp, Mus musculus
tcctgtccacatccctgccattcccgacagtcagtccctttgcccaggccgcatgccggatctctcccttccccccactccaccctcctctttggagtggtccgagtccttcgtcagctctcggttcggtcccctacggtttgtaagggtctctggctccctcgcatgaccccctgcagtggccgtccggaagcgatggtacgatctttccctagcattgtcttcccctcccccacccagctcgcagtgttccaggcgacggggccttgtctgggccccctagtggcccacagcgctcttcctttctttccctcaacagcctgaggtggacagggagagggggcagctggcccagaggggggctgggcaaggggaggggccgggccgggcgctgagggcggggcttggagggggagggccctgatgggggcggagaagcgctgagccttgggcggtgctgagactagtgggagtctgcgctgccgctgctgttgctgccgccgtcgccgccgcctccgacactgccaccgccaccgccaccaccaccggccgtgcgggttttctttctttttctttctgtcttttcttttctttcttgatttgttgggttcgccatattgacgaggctgtggtacccaaggctgcggaagctagagtccgccggtggcggagccgcaagctctcggtaaacggcccattggggccctcctccctgtcccagcgaaccccctccctgcctgcaccggctcccaggcctcgcgggagtcggccgccgccgcctcgccctccagggaggcggccgcctttaccgccccagggcttggggtgggtgacgggagtgaggacaggagcggtagctaagcgagcaggcctggagtggggggacagaggcggcgactaggggaaggtgaaactgccgctgcaggaggaggagcaggaggaggtgacgcaggagaaacgcaccgcccggagcttgtctgagctcagcgcccgagcctgaggggagaagggggaagagggctgcggccggccgagagggaggcggcggccgtggtcaccgctgccctagggcggccagggtgagggccagacccctggtcggtacgcgtcgcgcgtcgcgagcccgcccgccatccgcagcctctcatatttttgtccctcgccagcccccggcttgggatgctcccaggttaggccc

SEQ ID NO: 35595 - DNA, 1124 bp, Mus musculus
tattcgtttatttttttctatttaatggatggatttttaaagtttttatatttctagaattttattattggaaccagtctttgtttaaagcaggtgagaggaaattacttgaactatatagtgatgtctggggctggaaaaccggctcagtagttacgattagagttcctgcagagaatacaagttggagttctagcatccacatcaggcagcccacagactgtaactccagttccgggggatctgacacccctctgacatgcgcacacacacacacacacactaatttaaaattaacccacatgggctggagaaccaatggctcagtggttaagagcacagactgctcttccagagttcaagtcctagcaaccacatgttggctcacaaacctctgtaataggatctgatgccctcttctggtgtatcagaagacattgacattgtagtcatatacataaaataaataagtaaataattaaaaaataacacatgtatatatatggattagtctttggtcccctatgaagtgaaatattttgtggttgttgaactacttgaattttattttaaaaacacaatacttttattattttgcatattatgtttcttttcttgctgataagttttctgaatcttgaaattgagaaacaagtctagtttccctttcattgttttaggatctgcatctttgagaaccatgttatttgttgctgtcttgtgcttttacaagtgtttgggaaggatttgcttcattcatactctggatgttagactcacttgcaagtggttttgtttatctgatatgggactgaatagaagctatattttaagagtactgtgaatgattctgatactgtatcagttaaaactgtggggctgttgcatattgttatagatcttttatagataaatacggaaatggagctttttctaactgctttccattttcaggataattagcacttatttagtattagttacactgctaatcatttaaacattctcatttattacattatataggtattattgttattataccagtggagggcctgccatctgtcatacttagctagtgggacttaagtttaacttaagtgccatattagagaaatgatact

SEQ ID NO: 35596 - DNA, 1102 bp, Mus musculus
atacctttgccatcattcatcagttaatggatagttaaggtcagggattttgtcctttactttttattatttgcagtacacttacaacattattgatctccttgaatggcaaaattggggtcctatttgatttgcttgcagtaccagggattgaaaccaggccttggacatgctttagcaagtgttctctttgccactaacctgtatgtatctccaatgccattctttcatcttttatttactttttattttgaaacagagtctcacagacttgctgaggctggttttcattaaattcattttcttttatttttttatattatttttatttatacaaatacactgtagctgtcttcagacacagcagtagagggcatcggatcccattacggatggttgtgagccaccatgtggttgctgggaattgaactcgggacctctggaagagcagtcagtgctcttaactgctgagccatctccccaaccggaagttcattttcttttgactgactaattgtaaagataaatgtcacagggctgatattctgaaagagtttttaaaaagttgcatgtttattggcagggttagctaacccttgaacaaaacaaaaggaaaacttcagctgggcatgcaagcctttaattccagcacttgggaggcagaagcagagaccagtgttctcttgagtttgagccttgctactattctacatagctacatagcaagactttgtctcaaaaaaacaaaacaaaacaaaaaaacaaaaaggccaaaactttttgctcttaagtttttaaaaattagtgtatcttttttttttttacaaagtatttttacaaagtagcaagcctcaaactcaagagaacactggtctctgttttttcttggagacagtgtttctctgtgtagccttggctgtcctggaactcactttgtagaccaggctggcctcaaactcagaaatctgcctgcctctgcctcccgagtgctgggattaaaggtgtgtgccaccacgcccagcagtgtatcatcttgtacaaaatgaatttcattatttctaaatgttattgtgtactttgatcattatacctccttattacc

SEQ ID NO: 35597 - DNA, 1214 bp, Mus musculus
acttctgtagataacttttttgttcaaaacttaacataaagttgattttagtatgattttacaactttatttcccactttaaaaaatgtcctattcactttttaacttttatttcccatactctttttttttttaaagacagtttctacttttttgtagtagtagtttgtttttctgagacatagttttatgtataccaggctatgctgtaactcactgtgtaggtgaatgtgaccttaaacctcctacctcctgaatgccgggattataggagtgtattgccatgcacggtttatgcagtgctgagtattaaaccagggctgtactaacaccagacaggtactacaccaactgagctatattcctagcccatagcttctatttgacagttgaacgtaatcaggaattttataaattcctccattctgagaatggagaaacactgttatttagctttgagagatttgaattctttgaaagaggacaaggaagtacacttgaggatggagtagtattttttttaatttgttttctttttgttgttgacttcgagacaggctttcatgtttctggtctcaaactcatgatcttcctgcctcaccttcccaagagctggtagagaatacaggcctgtaccaccatgcctgtctcgttttttccctccttaaagccagtaacttaagtgtaatctcttctggcctccagctccctgtgatctttgatcttcttgcttcagcctcaatcaagagtgctaggattatagtcaggaaccaccaggtctgactggggaaagtggttgtagtgtatagctgaatgaagactaaagaatcttcccatgaatttattttttgtgagagcttccccttcctattatgcattgaagttaattagtcatataaatgtaagctcggggttgttttaatgccctttcttcctgctttccccaaatacttctcaaaatgcttgcaccagatactgtgccagttccataagaaacaaaagtcattttgacagtctgcttttgcaaggttctttctcattctcagacctaattggtcagtagttggtgtagtaagtactccagcccttcataatccctgtctctgcaccccttcctctgtgtattaggtattgtaacaggttaataaggaatgtcttcctttccacctaccataccctcaacaatcccaaagacttagattatagttgtaact

SEQ ID NO: 35598 - DNA, 1169 bp, Mus musculus
atggaatctgaaattcaaggtctaggtgttgataggtttgcttggtttttttttctttttaggaatgtgtgtgtcagtctgtgttgtgtgtgtacctgtgtgtgttggagaacgtgtgctgtctttgttagatgagtagtgtgtcttaaacattacaagtcagttatgcttaatgtcctcagtatagatgctttggaatatacttaaggcattagccagttaaggtcagtttgccccattctaggatttaaccaagtagcagctaacttcttgataacacttgccttgaagttagttccagaagaaaattgaaattacttgatacagctaaactggtatactggctacagtacattctttaagttgaatatagcaatgaagcttcagcttttccctttttacctgtcatttacatagtcatgctttcttgacttgattcactggtgatgatactaaacttgaatagtttatgcttgctatatctaaaataaaatattctcttttctcttttacttacaggttatgcaatggtctctgcaagatgttttattcttgaattggaaccttttacgactgacaaatgctggtactttatctcctataagtggactataatttcttttcttaagacaactacataagcagacaaaattgcaaagatctgccctgtgtcgagtatgacagccacgactcgtggctctccagttggagggaatgacaaccagggccaagcccctgatggacagtctcagccccccctccaacagaatcaggtaagaaattaaagatacaagttaaagccacattgctatgtctccttaactcttaagtgctaagtaaggaaatgtgatagaattgccaagtaaccataaagtgaatattttaagaaaagtagtaaatgcaggttttcagtagcaaaatacttaggtgctgaaatcaacattgttttctgattttttttcagatgtcttacattcttacattatcagtcttcaataaaaggaatgaattaagcttggtatcaatcctgggagaaaccattgtataatttagtgtagcatatgggaccaagaaaattataattctattttgtatgccaaatacataaaatcattaattgtcaatctaaaatatgagtatgtactgaagtattattactggtgtttaaa

SEQ ID NO: 35599 - DNA, 1806 bp, Mus musculus
cccaggtctcagtttctcataagctttacatatatttacttaaagggaagttagaaataataactcaatcgagtcagttctctgcactgtgtgtgtgttctgggtgtttaattcaaggcaataggctcagcagcaagtgccttccttactcagccatcttgctgaggcccataaagggaatttcttaataaaaattttaactttaaaatctgtacctgtagaagcaactcttaagttataagacataaaaaccagtaacaagtgggatgaatattcctcagatgcggtatctgagaaggctctggattataatttggcaatgtgtgccaatagctttaaaagaaattttctatactggtattgttatatttctagtattcttaaaatttgttttctacaagaagatttatacttgacaatgctttatttaactttaatttatgtaatgctgaagaatttgaatacttaagatactgaatgatggctcagcggttaagagcgctgactgctcttccagaggtcctgagttcaattctcagcaaccacatggtggctcagtaccataatgggatctgatgccctcttgtgtgtctgaagacagcgacagtgtactcatatacataaaataaatctttaaatagatattgaatggataattgacagatatagttccagttttatcgaaaatttatgcatgcatggccagtttttatttagctcataaaaaagtaacaaggggtcattacaatgtcattactggttttttatttgttggtgtggtgttatatatgcttacagttgtttttgtctgtgttttttgtaagaatatgaatacacaaggcaaagtgttttgttgtttaaaataaaacaggcttctaaagttacatactgcagatagcttttttgtatggggtttctagcacttgaattctttgcttggcaacttagctgtttgttaagtgtagtagtctccattttaagtataaaagctcaccattaggttgttagtctgtcttggaaattcagcataaattttggaaggagaacatatcattgaaatcataagctttcaatgatgtctttgtagaattttatgttactaacatttttaaaaataatgctaatatgttagtgtttatgtatgtgtgttaatagaaacttacatctataatgttattttgttaatcaagacttcatcgcctgattcgtccaatgaaaattcccctgcaactcctcctgatgagcaaggtcaaggtgatgctcctccacagattgaagatgaggaacctgcatttccacacactgacttggcaaagttagatgatatgatcaacaggtcagttggtttcatttctaaaaccaaggcttgtttgtttttattatagcattatgtgtggtgggtaacataatggcagtgaagaggaactgttgccttaattttcccattatagtcactgccaagtactttacaacccatggttcatgatgggtctaataaaaaggagcaagaacatgctcttatggccttagctgtttgttccaaagtagaactagttatttagttttcctttttaaaagttggtgaaatttctttacaattgacatgttcttgactgactttaataactttagggggggcatgaaacaaaccagatcataaggagtttcttagaatgtccttcatgatgttctgcagggtaagaaaaggttgtaaagaaatgagaagaacatatcaaaaaccccatctgagcattgtccttaccgggcagtgtgagttcaacaagggccgctcaaaaaaactgggca

SEQ ID NO: 35600 - DNA, 1269 bp, Mus musculus
aagagacaaaaacaatcagtaatcgttatttgtaggatgaaattagagtttacttcaacagtgaaaagaagttgtttttggactaatatgctattatgatacaaacctgtttctatgtatgcaaatagccataaacaggtgacgttttgtggtctgaatgggtttttcaattacaactatggggtaaaagtcccacaatctggtttaacataatttcttagatttagagcttggcaatgtagtcttctatcagggtaagtgatacattatttcaattttagaaaaaatgggaatttgtatcttatctgaagataacagcagaatttggcaactcataggacctacttcatttttaagcaagtagctttttgaaagcaaattaattctgtcagtactagtgaatcaactattatctatcagtataaaaaacaaggagctcatttaatattaacagtaattagggttatatctgtttgaaattgcaatgttttcatattattaatcacctttctctcatatataatagagatgcattattaacaatactcatcgcctggtggagctatgtgtggctaagttagcccaagactggtttccacttctagaacttcttgccatggccttaaatcctcattgcaaattccatatctacaatggtacacgtccctgcgagtcagtgtcctcaagtgttcagttgcctgaagatgaactctttgctcgttctccagaccctcgatcaccaaaagtatgttaattattttcaaatttaaatattaagatagttctaccacagaactgtaatattagtctcctagtaacatggcttaacactggtttaattatactcaaaaagacgttctgcattatagtttgaattctttattttgtaccacagctatattttattgtttgtactactatttagtttttctgtgtagtaataattgacatctgacaaccaagtattttttgagtattatatataatatagcactaggagcctttttgcatagtcatagcattttagttcagtgcttatggcttcttaatttttttctccatgttaattaactatacttaattcctgttatcttttagtcaatctgaagatagtcatagttggattaatataacatttcaatagtagtaataacaataatagagaaggacattatgactcattaaaaacctcaggtgtgaatcaataaggccatgatgattttatatattctaaggttgttaaggttgtttgtttgtttgtttgtttgt

SEQ ID NO: 35601 - DNA, 1155 bp, Mus musculus
gaagtttatcaaacctatgcctttgctcatggtagtagatgtttaattcctgcaacatacgggttagttttcagtagacaattcacttttaggcttcaagattatttatatggaaaatttaaatacttataaactacaataagaaattgtctcagaagttgttacactagattttctttgatctattattacttaaggtctttttaactttttaaattgtttttcatataagtgtttttaggtattttggaaagccatatactctaaaagtcggatagctgagacagaaacatagtctaacaagtaatactgatatgagcagtgtgtttgttcctttaatctaattcatgcttactatttattgcttctgcttcacagatcaattactatgatcgttttgaagccttttcaagaatgacttaacattaattggctttaatatatcagtcaaaatagtactttgtttatcctaaatgccaagaaagtaaacttgttaattgtattgtagggttggctagtggatctcctcaacaagtttggcactttaaatggattccagatactgcacgatcgttttattaatggatcagcattaaacgttcagataattgcagcccttattaagtaagtaacattttaaagccacatgttaaatatgttattgctgtttttattttggctcaattcagaaatggagtagttggagctggagagatgattgctcagtgcttaagtggctgttctttcagatagtaaacgtgaggtttattccctgtacctatggcaggtagctcaaaactgtctttaacaccagctctaggagaatccagcgtctctggcttctgagggcatctatctgcctatatacctaatccaaatgtgaatacatacacatagaatgtcttaaaaataatacatgtcactcgggaggcagaggcaggtgaatttctgagttcgaggccagcctggtctacaaagtgaattccaggacagccaaggctacacagagaaaccctgtcttgaaaaaaaaatacatgtactatgagaatttactaagttgaggttaagaagtcaagtatttacgggggttttcttttcttatttcagaccatttggacagtgctatgagtttcttactcttcacacagtgaaaaa

SEQ ID NO: 35602 - DNA, 1170 bp, Mus musculus
ctggcctcgaactcagaaatccgcctgcctctgcctcccgagtgaaatcaaagtgttttaaaaagtatcttttaacctaataagaaaaccattgtggggcagaattagtttaaggaaccaaacaccaaaaatggccctctgcccattcttcttaaaccttaagtgattgttgcatttaaataatatttttatgagttaaatgctggaatgtacaatatctttttgatgatttcagtgtttgtaatttatggagatatttattccccaataaattgctttgtcagatatgatagttcccagctttaattccagcacttgggatggatatggaggcattttgaagatcacaaacttaagactagcctatgctacatagcaaaatgccatttcaggagaaaagagcttactataaatttttttaagcaatttttatgaatacaatgcattcttgcatattatcttgtacatatgcttttggctttctatgtattctttaaattatattttagtactttaaaaaggtcttcgtgttttattttgttttgaaacctggtttttaaattacctttaggaatggatacagcagaacaatattttatccatagttttacgagatagccttcatcaaccacagtatgtagagaaactagaaaagattcttcgctttgtcataaaagaaaaagctctgaccttgcaagatcttgataatatctgggcagcacaggtaaggctcttgaaacctcttaaatgcttctggaagaaattcttctagaaacttcctgaaattgtcaataatgcttgaatacttaacagttcatatttggcaaaagttaaagaggcaaaaaataagggaaactaggtgtggttgtgtatatctgcaatctcagcagatgaaagtgtacaagtaggagaatcatgtatcggaaggtaacttaggcttcaaagcgagcgcaagcttctgaccgagaaatcaaggatacaaacagctcagtggtacactgtatttgccttagtaccacaaaataaagtaatatttgttgggaaaataaatatacatctatcattgacctcttaatagacttagcaactcctcagtatagttcactcactcaattccaaaacacttaaaacttttcagaaggattagcaacctttctgaaaaggttttaa

SEQ ID NO: 35603 - DNA, 2090 bp, Mus musculus
gaatgttttctgcatttttaaatacatcatacacatttcacacatgcaaagataaacttttccccataaagacagctgtagtaagcagttattgtgaatgcccttaagttaatagtcattcatccttcatgttgaggtgactcctgaaatagtggtgaagtatgaccagtgacagacttgaaaaaggaaaaagtataaaacagtcattacatcatttgggtcttctttctcccaggataatctcttgatacttccttaataattagttccttaatgattaattgattccccctttggattatcaagagcttgctaaatagcaagcacttttttatagttggggagcatctcactgtatatccttggctgcttggaactcactgtgtataccaggtcgccctcaaactcgagagatctaccacactaccttaaaaatgaagaggagaaaatgaaataagggttttcatttcatttaaatatctttctaggccagttggacaaatgcaagtaaaaagcaacgtgaaaagctccttgagctgattcgtcgtcttgcagaagatgataaagatggtgtgatggcacataaagtattgaaccttctgtggaatctagctcacagtgatgatgtgcctgtagatatcatggatttggctctcagtgctcacatcaaaatactagattatagttgctcccaggtaaggaggtggtgtttggcttggttgtattacttttgtgcccctacagtactaggtagtatggctaaagtacaggataattttaggttattttagcattatctttttaatgattttaagaattgatgtttatttaagcctgcctttcttaggtctctacaataatgttttaagatccatctgagtctctggaagaggaggtacaaacaataggccatttagtgataatgttgtcaaatgtatggtaaaggaatcaaatagatcataaaatattaaggctgagttagaaactttggaaataaatattttctttgctcataaaagataaagaataattagaattttctaggtagtagattctaatgtcagggtgttgcattagcatgttaatgcatgattttattatgagatagaatctttttaagttaaaacaaatctcaaacctagtaaattataatcaaactttactgaatgtatgtgataaattttaggattttactttttagagtttggtagtaaatatgaagttaagatatacctagagcactttaaaaaaattaaactcttagagttacagtatattttatatttatcatgttaatcttataagaaaaaccgactttataattccatggattattggaatttagcttaatttccttatacatttatctttaaatactgtgacttagaattttcccgagtattgatctatataataaaacactgaaattgtttaaggaccgggacacccaaaagatccagtggattgatcgcttcatagaagaacttcgcacaaatgacaaatgggtcattcctgcactgaaacaaattagagaaatttgtagtttgtttggtgaagcacctcaaaatttgaggtaagacttttaaaactagacagtttaaatatttttatttatggtttgttaatttcaatttgtaaaagaaaattttaaagaaagttaatgaagtgccaggaaactaagaagaaaagggctccttttggaacaaaagaatcttttgtcattcctacatcctttgtttcattgatatggaaagtaagccatgattaagtgatcagtactaaaatctaagtgatcttgctgtttgatgctgtgtcacatggtagttttcacaccaaaaaaaaaagattgtttttttaatttttaaagttagtttagaagattaaattgcatggagatttaaatgatagtagatggaatgatagaacactggattttttaattttttaagatttattttatttattatatgtaagagaagaggacatcagatttcattacagatggttgtgagccaccatgtggttgctgggatttgaactcgggactttcagaagagcagtcagtgctcttaactgctgagccatctctc

SEQ ID NO: 35604 - DNA, 1246 bp, Mus musculus
atttaattacttaactgggaataatagaagcccaaccagagacaaaagaaccttatttttggtacctcttttattttagcctgtgctaacacactttctattttacctcctatttgattaacaagaaagagtcagatattttacagtaaccagtacaaatgacttgcttgcttcttccttccttccttccttccttccttccttccttccttccttcctttctttctttcgttcttttgttcttttctttgttttagtttgtctttgatttttctagacaggctttccctgtgtagccctggctatcttggaactcagataaaaactgagaaacaagttcaatatatatgattgtggtatcggtattatttcatacataaacgggtaggttgtatttcaggatatatgtcaaataaattttttttatgtttttctaaggtttttattgaaggatggccagctgtggctgtgtgctccacaggcaaaacaaatatggaagtgcttagcagagaatgcggtttatctttgtgatcgtgaagcctgttttaagtggtattccaaattaatgggagacgaacctgacttagatcctgatatcaataaggacttctttgaaagtaatgtgcttcagcttgatccttccctgttaactgaaaatgggatgaagtgttttgagagattcttcaaagctgtgaattgtcgagaaggaaaactagtagcaaaaagaagagcctacatgatggatgatttggaattgataggattagactatctttggagagtaagtcaaaaataggagctctgtcaacattgtacttgatattgtatctgatgcttgtctcaggagtctgggttttatccttatctcaagtttgtgtgttccttactagcattgtttaacattcttttaaatctaaagtataaggttgatctattgcaggctaaagtgtcttttatgatattttatacttctatctttaaaacttaggttggttaaaactgcttctgtttttaacttattttagatgtctgcaaattatatacatacacctaggtgttccatgtggtatttgagtacctaaacttttcaaataagtaaagcttgaagttttggggtgtttgtttgtttgtctgttttataagcagtggaggggcttgaaaggcagtgcatacttaaacgtacattaagccccaggttcagtcttcagcacatattttaatgttacaaacccttctcttaatccaa

SEQ ID NO: 35605 - DNA, 1963 bp, Mus musculus
tgtattgctttactaagcagaatgagttgtttttcctaagagctatctccttccaggagtttaaagattatttttaaatatgccaaagtctgttttaagctcttcatagcctctcttctctttctgtttctgttttccctctctgtttctttttgtctgtctctgtctgtttctgtctgtctcttttgcactctctaagacagggtcttactatgtaggttttgctggcctagaatgcacagagatccacttgcctctatctcagtggattaaaggtttgcaccacagtgtgacaggctccttttttctgcattctctcaatgtttgagaatatatatatattcagttttttgagtactgtgatgtctttcagtgaaataaactaggtaatctgaacgtcataaagcagaaaataacttggaggtaaaaactgttgctgttacttacatttcctttggaagtgggttttttgctttgttttgttgttttctttaaatcagtctccaacagctggaaactgttgactggaggctcctggatgagagatggtctcatgtttaggctggctgattaaaaggcactggttggcattttggttctcatttgtttacttttaaatcaacccaagttcggtcatgtattacagaagctcaactgaatgtttaactgaattgtttgctgttttgtgctcttgaaaatgctagaagtgatatagatgtgaattgtgttttatttcagactatgcctctttctcttacagatagtacgacaatagaaaagttaagagctatttgtttggaccatgccaaacttggagaaagcagccttagtccatctcttgactcacttttctttggtccttcagcctcacaagtgctatacctaacagaggttagttttttgtttttggttttcatttttggatttagttcttgtttaaatttgatccttgatgtgctgctatgaagaatgtggataagattattataaggtggttttgaagtggtcattgtcttagcattcttgatggtgaaatggaggttatgttttaaatcccttttaatacaatccttctcttctccctctcccccttttatttgcaggtagtctatgccttgttaatgcccgctggtgcacccttgactgatgattcctcggattttcagtttcacttcttgaaaagtggtggtctgccccttgtcctgagtatgctaaccagaaataacttcctaccaaatgcagatatggaaactcgaaggggtgcctacctcaatgctcttaaaatagccaaactgttactaactgccattggctatggccatgttcgtgctgtggcagaagcttgtcaaccaggtgtagaaggcgtgaatcctatgacatcggtaatacagactttgttttggtttctaaaatatctagtagtagatagtcatttttaaggttaaatttctcaatgattctaaagtctagagtttaattttgactcagtattaaaattttctttccagtatatgtcttgttgatagaaatgttcacttatttctctatatttgtattaaaaatacacacactcgaaaaaccaaaaaaaaaaaaaaatacacacactctaccctggctttcctactactaatttaagagaccatttccttcagtttctttctgaccacttgagttttactacactctaacttactgtgaaaaaaaaagccacataaatgaatttctaacttgtgccaagcagataccagtggtgttaagattttgtaattgatttagccttttgccagtttctgtcccatcttccttggcttaaactttaattatgaaggccttatcattctgtcttcgcctggatctttgatccattttcctgatctcaacatatgctatagtttaatgactagttaaaggcccaactatgcaaatagttgctaaattactgatagaagacaaaagtctttag

SEQ ID NO: 35606 - DNA, 1196 bp, Mus musculus
ctttgagaacatggccatttgctagctgtagatactaaggtattgtaattgtgaagtatttgttggcaattgaaagcaaaataaaaatttagtaatagggatatcttaaacatttacagtatagagaaaagttacaactcaaaatcagaagtattcagctactttatctgtttctcattgattaaaacacttagtatacaattacataaaagtactgctatcttttgtatgttttatttttttataattgtaatttttctaattttcaaagtagaacttgataactggagattatgagcagggtctgcctaaggatacacatttaaaaagatatgatttactgcattttgagatgagtttggacttgatctgttcatagaaacatgggttagatgaatctagaataggggattgtagagaaatctgtgccacttgcataccatgttggcagggtggaatactttgcatgtgaatgtggaaagaaaacatcttgggaatgttgatgaacgccataggaatgattgggtcaagttgtatacagaatactcaaataaaatggttaactgtttttcaggtcaaccaagtaactcatgatcaagcagtggtgctacaaagtgcccttcagagcattcctaacccatcatctgaatgcatgcttagaaacgtgtctgttcgccttgctcagcagatttctgatgaggttagtattgtaagagttatatagggggagtgtgtgtgtgtgtgtgtgtgtgtatttatttacaatgttttacctgtcataattgttactatacaattttttaaaagtttttattctgtgtgttttgcctgcatgtaagatgtctgtgcgcagcttgcatgcctggtgcccttggagatcaaagaggacttttggatgctctagaactggaactacagactgttctgagcttccatgtgggtgctgggaattgaacccatatggaagagcagccagttctaaccactgagctgtctctctaacccaaaacaacctttttaaaaattcaatctagatcattgtttaatgccaacttagtattattagtactttattttcaaattttgcataatagcattctttcagagtgtatatacaatatttagtattcacacaaacagtacacaataattgttctgtactttttttttttttttttttttgcagtcaatacttc

SEQ ID NO: 35607 - DNA, 1148 bp, Mus musculus
tattggataatggtgccacagttagacatctgtgtacattataaaaaatagtatgaatcattctagttccatttaatcatcttcaaggaaaattgtataaaacacagtagttctctgtcatgcttttcaaatcaatactacagtataaagaagagttgtagcagtatcctttctatgatagcataattcccactggaccctcttctaaggtacacctggatcaaaattctgtggaagggggactggtaggtgttttaaggtttgatatggggcattttatatctattagagcctgttcagaaaaaggttagaaggtattcctcaaactcttcagtgacagtatgaggtcatagccttgaacatgcattagtaaactcatttacatgttatttttccatgactatttaagtggatgttagttcatgttcctaatgtatcacccccttccccaagagaaaacaatatattaaacataaatcatttccatttcagaactgttcgtcaagtggcacaggaacaattcttcttaatgtgcaccagatgttgcatggggcacaggcctctacttttcttcattacgctgctctttactgttttgggggtaagagatttaaaaatatgtttaccagtgtaattccttcaacaaggaatgatattctggaatttgtggatttagcttgaactagttagggcaatctatacttaataaaacaatagttaactcagggtttttgaaaagggaattcaaagtataaacatattgattcactatactgtattttatcattttcagagcacagccagagagagggctaaacactcaggcgactactttactcttttaagacatcttcttaattacgcctacaacagtaacattaatgtgcccaatgctgaagttcttctaaataatgaaattgattggcttaaaagaattagggtaagttgtagttaatactttgtttatattgttaagaaatagtgcttcatttataaatggttcataatttagaacattttaagcttaaaggggaccaaagaacatacattacattgttgggttttactttatagaatagaatgcattactacttacagaaaacatgtgcttaagatttaatacaagctaagcatggtaccacatgtgt

SEQ ID NO: 35608 - DNA, 2101 bp, Mus musculus
aaaacctcaggtgacagcagatgttggatgtggagaaagaggaacattcctccattgttggtgggattgcaaactggtacagccactctggaaatcaatctggagattcctcagaaaattggaaatagataaaacctgccttttaagaatttttaccaaggttttacaatgtttgtttagataatataaagcactagttagtgtctttcagtaaccattgcatgtttgtaggtgttatatgtatgtaaaatgtaagtgtaaagtgttacttagtttatgtctttatacctttaaaaaaaaccaagaaactacatgtttggtaaataggtaaaagtagaatatttttattagaaaatccacaaaaaatttctgtgatataagacttaaagacagaaattctaagacaaatatttctctttccagattatgtcactgctaatatttaatcctttctttcaactgtttaggaattaatcgacgacttcatctttcccgcatccaatgtttacctgcagtatatgagaaatggagaactccctgctgagcaggccattcctgtgtgtggttcaccagccacaattaatgctggttttgagttacttgtggcattagctgttggctgtgtgaggaacctcaaacagatagtagattctttgactgaaatgtattacattggtacagcaataactagtaagtacttttaaacatatggttatccttgacatacacagagccagtgactttgatgccctgtattccataaactaggcatggtattaatataatcccagcactggggagggggttataaaaaacatataaaaacaggaggatcttaagttgaatatcatcctcagttacattgatagttccagtccagcttggctatatgagatactgtcttataaacatacaaataggatcatagattggtaggtgagggagcctgcaatgatgtgggttgctgtcttttttttttcttttttaaagattttactttatgtatatgagtacactgtagctaatcttcagacacaccagaagagggcatcagatcccattacagatggttgtgagccaccatgtggttgctgggaactgaactcaggacctctggaagagcactcagtgctcttaaccactgggccacctctccagcccatggattgctgtcttaaatgcatttattaatggagaaatgccatgtgagagccctgcctcctgtgactgctcaggtagtagtgtctgtgttttgtcagcttaagagaacttaaacatcataaaatcacttctgtctttgtttttcagcttgtgaagcacttactgagtgggaatacctgccacccgttggaccccgtccaccaaaaggatttgtggggctgaaaaatgctggtgctacttgttacatgaactctgtgatccagcaactctatatgatcccctctatcaggaatggtattcttgccatagaaggcacaggtagtgatgtagatgatgatatgtctggggatgagaagcaggacaacgaggtaaatttcttttatcacttctgttctctgtgaaactcttgattaacaacattctttcattagataccaagggaataagtacagtcaccagtttccacaggattcccctccaaaagccctcaacccaagatggcaaaatttgccaatatacaagtagtctaaatggaacctacacaaatctattttcatactttaggtcatctgtagattacatcaaatctctcatacagtgtcttatataaaagtctgggcatacttcgtgaacccacagataaatgttagtggatatgaagatttgattgtgttgtgatttccttccttagactgtccaaagtatgtttgaaggttggcacagcctctgccacttgggctacctcttagtggagtgtgtctccattacagcagttacaaagaatccatctctttgaaagtagtgtttgatagaagttgaaatttaactagtttaaatcgacaatggccaaccttttggcttttctgagccatattttggaccaaaatttgtcttgtgccacacttcctttcccttcccttcccccttttttgtttctgtg

SEQ ID NO: 35609 - DNA, 1149 bp, Mus musculus
gccagctttttgtattttaaattttgaattgtgggtttaaggagtcctctgtctattcaggattctacctcctcatcagataagtgattttccctttttcctcccactctgaattcattgcctctcttggcagtatttttatataaaagtttttcattttcttgagatccaacttgtttgtaccttcaacatcatagtaagaaattgttatcagctacaatgtcttaatgattttgccttccaagtttggttttattcttttaactctaacttttaggactttggtacaaattgttttttctatgtaattttaaggagagctcagcttcattttttttataactattaatgtctatattctcacatgaaatggcaggaacaaacactaactgtaaattaaatgtatacaccttttgaaaattaagtgcttggaaacaaagtaaaagtgtatgttcactaactggaatttatctcaacatattttactaaacttctgattagctcattaataatacctttttggtttctagagcaatgttgatcccagggatgatgtgtttggatatcctcaacaatttgaagacaaaccaccactgagtaaaacagaagataggaaagagtacaatattggtgttctaagacaccttcaggttatctttggccatttagctgcttctcgactacagtactatgtgcctagaggattttggaaacagttcaggtaaagtagatggacagtgataaaccacatatcttaataaatagctcatattcctaaaatatgtatcttaagatatctttatgttctagccttgattatgaaaatataagatgcatatacagtagaattatcgtaacatatattccttcctactactttctaaattattttgagacacagatcacagataatagtttcacctataaatacttcattgtgtgtctttgttttaaaacataatgaatctattactgtgctttttaaagatcccttgatattgaatatattcagcatttcaactttcccattatctcatataatttttcccaaatctgaaaccatgtgaaaaccatatagcttaaatagtattttctctcttttttttcctgcatgttctttaaggtgcccagtgagatccagaggcttga

SEQ ID NO: 35610 - DNA, 1178 bp, Mus musculus
agccagcctgagcttaagagaattagaaatgtagctaaaggatgactgcttgcttaacatgtgtgacaccctgggttaactttcagatttggggatggtagtgtttgcttggattttggtttactttttgcaatggattgtatctattaattttctctattgattttaggttgatactgtaaagcgcttgctaattaaaaaattgcctcctgttcttgctatccaactaaaacgattcgattatgactgggaaagagaatgtgcaatcaagttcaatgattactttgaatttcctcgagagttagacatggaaccttacacagtggcaggtgttgctaaactggagggagataatgtcaacccagaaagtcagctgatacaacagaatgagcagtctgaaagcgagaaagcaggaagcacaaaatacagacttgtgggtgtgcttgtgcacagtggtcaagcaagtggcggacattactattcttacatcattcagaggaatggaggggatggtgaaaaaaatcgttggtataaatttgatgatggagatgtaacggaatgtaaaatggatgacgatgaagaaatgaaaaaccagtgttttgggggagagtacatgggagaagtatttgatcacatgatgaagcgcatgtcgtacaggcgtcagaaaagatggtggaatgcatatatacttttttatgaacgaatggacacaataggtcatgatgatgaggtgataagatacatatcagagattgctatcaccacaaggccccatcagattgtcatgccatccgccattgaaagaagtgttcggaagcagaatgttcagttcatgcacaaccgaatgcagtacagtctggaatattttcagtttatgaaaaagctactgacatgtaatggtgtttacttaaaccctcctccaggtaagtgtcaagagttcgcttcttatagcaaagagtaattcttatctttaagatttattagtaggctgtgtgtgcgtgagtgcgtgtgctgtttttttaagatagggtttctctgtatagctctgaatatcctggaaatcatgctgtcggccagggtggcctcaaactcagagatcacttacctttgcctcccaaatgctggaatcaaaggtgtgcaccaccatcgccctgctatctttattcatatctataaat

SEQ ID NO: 35611 - DNA, 1425 bp, Mus musculus
caattaaatatcagtatgctgaattaggcaaattatactcagtagtgtcacagctcatccgctgttgcaatgtctcttcaagaatgcagtcttcgatcaatggtaatctattcttggcaatagttttgagtactctgggtcatatctagaacttgatcaaatttggttctgaaaatacttaaatacaaagtgagggtgtgaaggaaggtccactcttgaaacattttacaatgtttgcagtactgttcctttttcacatgattattggacccttttctgcttgctactggattaaattagtaaaatttttatgttgggataccgagtcattgaaacacactactattcttagtgcttagaaaaattgacatacagctctttttttttttttcctaaaacacatttataggctatgttctgataagtttacattgttattgtggagacacttactggttgttaattgacaaatctgtattgtaggtaatccttctcttccaaatccttttggtgatcctaacttatcacaacctataatgccaattcaacaaaatgtggtagacattttatttgtgagaacaagttatgtgaagaaaattattgaagactgcagtaactctgatgagaccgtcaaattgcttcgcttttgctgctgggagaatcctcagttctcatctactgtcctcagtgaacttctttggcaggttaagaaatcataaccattgttaaatctctatgatttgatttattacccatatgtactttattcactgtgtcttaacctatttctaggttgcatattcttatacttatgaactccggccctatttggatctgcttttacaaatcttactgattgaagactcttggcagactcacaggtggatactttattttttttttatcaggctaattagacttagtcccggctgttacatataatagaaattgaccatccccacatttaacaaaatatataacaaaagcaccctagggttctagtgaatgttcagtgttacaagaaaaaactcaagacaggaatgactaccaagttctcccagattttgtcagtttgtttttgttttttgttttttgtttttttttttttacaatgaggacattgcccaggtttcatacttaatatattaacatcatgtgccaccacgcccggctctgaattttttttttaattaaagaaaactagcaatagactttatacatatgaatttattaataaatccaaggattgttttaggtttagattacattacttttggaactaacctcattacataaatctgtagttatttagtgatagttctggagagcagagcataaagacacatgcttttaattccagtacttgggagataggcagtcagatctctgtgagttcaaggccaatcagggctacaccaagacctt

SEQ ID NO: 35612 - DNA, 1243 bp, Mus musculus
ctcagtaatacaggtagatgtcattttgtttattggcagctaatgtctaataaaataaacaggccctgggtatggtggcataagcatgtgatctcggcagtttggaggctgaggcagtcatattgagaggtcaagatgattctggtttacataatgaaaccctgtctcaaaagcaaaagacaaaaatgacttaaagcaagttattgtcaactacagtgtcagtgttaacttttaaagtttgttactcttgagttcagaatttgcttctagtgatgtatttaaacaatgcaatttgaacaagtaaagttagtaaggatacagacttgagtcaggctagttggcaactgtatgaccctaggcaagctgtttctatctcctcatctgctcaaaggtttaatagtggtacttactgtctattaggaaacaactgaacccacagacatttacggggtagcatgtaataaacactcaatagataatagcttcttttaatttttagaagttttatcttccatctgaaatgtttttcagaattcataatgcccttaaaggaattccagatgaccgagatgggctgtttgacacaattcagcgttctaagaatcactatcaaaaaagagcataccagtgtataaaatgtatggtagccctctttagcagttgtcctgttgcttaccaaatcctgcaggtaagggtgttttcttatttcatagaaatttaaattggagttaaaagatcctgttttaaaaggctgtagctctgatatactgcttacccagaatgtacaattccccaatatgacaaagaataagaaaggaatgaaaaatagcattaagatactattttaatccaggtattggggcggggtgaggtacacatctgtaatttggacattagaggccaagtcaggggaacaaccacaggtttgacaacaacctgagctatgtaacaattaccagacagccagagttgccatggcaagactatttcaagaataaaaaatatcctcagtttgtgggattatcattttaagttatctatgatacactcccaatcctcttaaatgtacatgattttatttacttttgaagggcaatggagatcttaaaaggaaatggacctgggcagtggagtggcttggagatgaacttgaaagaagaccatacactggcaatcctcagtacacttacaacaattggtctcctccagtgcaaagcaatgaaacatcaaatggttatttctt

SEQ ID NO: 35613 - DNA, 2139 bp, Mus musculus
tggctcagctgttaagagcactgactactcttccagaggtcctgagttcaattcccagcaaccacatggtggctcacaaccatccgtaatgggatctgatgccctcttctggtgtgtctgaagacagcatactcatataaataaataaatgaatcgtaagcataattttaaaagtgtgcctgtgagttcaggtgtccatggagatgaaagaggcagttgtgagccacctgtcatccctatgggaacctaacttgggtccacgagcagcgcccattcgtaacctgtgaagccacttctcccgccctcacataacttgcattgtcacttacattttagctttattaatctttaagctttgttataaatgatatcccttgaagagagcaaacagttcagtaaactccacactcacatacagagccactataaagacacctggctctctatctgcggcgtgtggcggcgagatgtctcacaggaaattctcagctcccaggcatgggtccttgggcttcctgcctcgaaagcgcagcagccggcatcgtgggaaagtgaagagcttccctaaggatgacgcttccaagcccgttcacctcacagcctttctgggttacaaggctggcatgacccacatcgtccgggaagttgacaggccaggatctaaggtgaacaagaaagaagtcgtggaggctgtgaccattgtggaaactcccccaatggtggttgtgggcattgtgggatatgttgagaccccacgaggcctccggaccttcaagactgtatttgctgagcacatcagcgatgagtgtaaaaggcgcttctataagaactggcacaagtctaagaagaaggctttcaccaagtactgtaagaaatggcaggatgacacaggcaagaagcagctggagaaggacttcaacagcatgaagaagtactgccaggtcatccgcatcattgcccacactcagatgcgtctgcttcctctacgccagaagaaggcacacttgatggagatccaggtgaatggaggcactgtggctgagaagctcgactgggcccgagagcggctggagcagcaggttcctgtgaaccaggtgtttgggcaggatgagatgattgatgtcattggcgtgacaaaaggcaaagggtacaaaggggtaaccagtcgttggcatacaaagaaactgccccgaaagacccatcgaggtttgcgcaaagttgcctgtattggagcctggcaccctgcccgtgtcgccttctctgtggctcgagctgggcagaaaggctaccatcaccgaacagagattaacaagaagatttacaagattggtcaaggctacctcatcaaggatggcaaactgatcaagaacaatgcatctactgactatgacttgtctgacaagagcatcaacccactgggtggctttgtgcattatggtgaggtgaccaatgacttcatcatgctcaaaggctgtgtggtggggaccaagaagcgagtacttactcttcgtaagtccttgctggttcagaccaaacgtcgggccctggagaagattgacctgaagttcattgacaccacctccaaatttggccatggtcgcttccagaccatggaggagaagaaagcatttatgggaccactcaagaaagatcgcattgccaaggaggaaggagcttgattccaggaccactttgtgcagatggtggggtctcaccaataaaatatttctactaaaaaaaaaaaaaaaaaaaaaaaaaaaaaaagacacttgaacacaactcttgagacacccacatctacccgcggggtggggacagtcagcggtgttctgttgtccttttcccatatgtcttcttccaaataactaacaaagtcactagctctagtctgtggctcatcctgaaagttgttcttgtgacatcaatgatctggcttgaggttgggggatggcaatccaatcaacttctagggcgactgatggtagccaggctgcagttgttgacaaagcagcgtgattgatttctaatcagacaaagtcctgtgagcacctgtgatgtggggagagtcacctgccccctcccctagtcaaaggtagtcacaaaggaaacttggtaagcagacgggcagtccctacccgg

SEQ ID NO: 35614 - DNA, 1199 bp, Mus musculus
attttaaaacatctgaaaaagacaaaacagaggaaaaatagattattgtaagctatggtcactgctgcagaacaccagaactgactgctttctcgctgtgttttggtgactgtgatgtagcttagaagcacaaatgtgaccttgatctcacagagatccacctctctatacgctgtaatgaagggcatgtgccacaactagccctacctccaaattattttttgatattgttaactgcatttagttgtttagttatgtgtgtgcccaagggttctcaaagcactgttcacgtgtggaactcagaggacaagctgtgagaattgtatggtccctggatcaagctcagatcaacaggcttggtggcaggggcctttacctgctaaaccatgttccagttctccaccctcaagttatcacacacacacacacacacacacacacacacacacacacgcacacacacacacacacaccccatcatcatattggcctatatggcctatatagagtttgaggttaaccccatccaaaaaataagattaaatcatcgtagtctcagtctgtcactgtgtatctctgtctcttccgtgtgtgtgtgtgtgtgtgtgtgtgtgtgtgtgtgtgtgtgtgtgtttattactagaaatggtacttagggcctacacatggtatacaagaacatccctagcccaaatgttattcttattttagattgatttttttttttttttttttttttttttttttttttttggttttttgagacagggtttctctgtatagccctggctgtcctggcactcactctgtagaccaggctggcctcgaactcagaaatccacctgcctctgcctcccaagtgctgggtgggattaaagacgtgtgccaccactacccggctgatttattttatatgtatgtattttgcctccatgtatatatgtccaccatatgcatgtttgatgcccacagaagccagaagagtatattagatctcctgggactagagttaaacatggttgataactaccatataaactccaccatctgaacccagatgctctggaagtggtcttaactgctgagccatctctcttagccccctgtgatggttgatatatgcttggcctagggagtgtgacaattagaaggtgtggccttgttagagtagagtaggtgtgtcactgtgggtgcaggct

SEQ ID NO: 35615 - DNA, 1218 bp, Mus musculus
tcaaatatgcagcaggttcctattttcaattagccctgcttcgtatacttaattcaaatgactagggtgttttgttaataagttattgttgaaataccaaacgtacaggaaattcagtgttggaaaaatggcttagtggttaaaagccatgcactgttctttcaaaggacccaagttacatttccagcacccacctcaggctgtttacaacctcctgtaactggcgccaggggatctgataccgttttggcctccataggcacctgtagacataaacatacgtacacacataaataaattttaaaaaatcttttttaaatgtacaaaaaaatggaaaaacaaaaaagattcgtcttccaacgtattcactctgaaaaggaatagtgtgcaggcttagagcagctaaacctccccccccccccaatgactggtctattaaggagcaatttacatcttttactgtaagtagctttcttagtgttctattgctgtgaagaaacactatgaccacggcaacttttataaaagaatgcatttaattggggctggcttaaagtttcagaggcttaatccattatcatcatggtaggcagcatggcggcgcagaggcaggcatggtgctggagaagctgagagctctgcgttatgatgttatgatctgaaggcagcagggaaagaactggggttgactttttttattatttctttatttattatatttaaatacactgtagctgtcttcagacacttcagaagagggagtcagatcttgttatggaagattgtgagctaccatgtggttgctgggatttgaactcaggacctttggaagaatagtcactgctcttaaccactgagccatctctccagccctgggcttgacttttgaaacctcaaatggacacagagttacacacttccttcaacaaggccacacctccttatccttctaatcctatcaaagacttctactccctgatggctaagcattcaaatatatgcttatatttgaatataatgaaatatatggggtcattcaaataagagtaataggctaaaaatggtcagaaattactgaaaccagacttttttcctactcacgttcctaccttcacaggcattttaagttaacagcctgtattaaagcaaatatactatctgcatcaaggcccagaaacctggacctaaaggtgtcctgagatggatgaggagaaagcc

SEQ ID NO: 35616 - DNA, 3389 bp, Mus musculus
atgagaacgtatttctcagtattgtttaaggtaactatcagtgcttataccaacatgacttttccaccccttgcagcagtcgatttagtggagggtttggtgccagagactaccgacagagtagcggtgccagcagttccagcttcagcagcagccgtgcaagcagcagtcgaagtggtggaggtggccatggcggcagtcgaggatttggtggaggtagtttgttttaaacataagaccatttgtggaagttcaatacataacttttgaaagaaaaagcagcaatcttgatgacttaataatttgtttttttaatctttccctaggtggctacggaggcttttacaacagtgatggatatggagggaattataactcccagggggttgactggtggggtaactgagcctgctctgtagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagtaaagatgaaaggaacaatcagcagccctgtctgaaggtggtttgaagacttcattgctgtagtttggattaacgcccctcccgcctacccctatcccaaactgcatttataattttgtgactgaggatcatttgtttgttaatgtactgtgcctttaactttagacaactttttattttgatgtcctgttggctcagtaatgctcaagattccaattgtttttgacaaaataaatttactgaacttgggctaaaatcaaaccttggcacacaggtgtgatacaacttaacaggaatcatcgattcatccataaataatataaggaaaaactcaagtggtagcctgtcttaaggcttttgatacttgcagattggggaaaaacaaacaacaaacgtcttgaagcatattaatggaattagtttctaatgtggcaaactgtattaagttaaaagttctgatttgctcactctatcctggataggtatttagaacctgataatagtctttaaacaagccattccagtcatgatgaggtgatgtatggatacatgcatacattcaaagcactgttctcaaagttaatgcaagtaaatacagcaattcctctttcaatgtttaggcagatcgttaactatgagctagccaaatgtgggcatgttattacagggaaagtttaaaggtctgataacttgaaataggtttaggagaattcatctacttagactttttaaatgcctgccataaaaaattgaaatggtagaatggctgaccacagcaatgaccagccctcacctagggctctggatgatttttggtctaataacgcatgctagtgttgatgttttttggtcaagatgggaatgaacaggaagaattatgcagcaggctttattttaaatgccgattcacattactctgttcaagctgcgttgagatgttaaactggcttactatagactttgtaaaaaaaaaaaaaacaaaacaaatggctccagaagagtaacaaactgaaatctgagatcacacaggttggaaatatgtacataactgcacaaggtgtcaattctgctctacagtgcagtttagtcagttttagttgcataggtttccattgtatttatagtctgtttatgctaaatctggccaaagatgagcattgtccaccactaaaatgcctatgccactgggaattctgggttaattttgtgaccagaatgcagtgatcaaaatgttcaatctttttacagtggcataggaagatggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttattttgtctcttggagattgttgaacgcagcttgtctaggaaagggatgggactagattctaaaatttatttgggaccatgggaatgatagttgggaagaaaactttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgttaagtcataataaactcttaagtcaaattaagcagacccggcattggcggtgtagccataactttctgatgttagtaaaaacaaaattggcgacttgaaactaaatcatgccaaggttttgatacacttgtcttgagatattaacgaaacacttcaaaacactgatacaaagtgtccagattctcagatgtttgttgtgtgagttttgtttagttgtatttttttttcagtgaatgtctggcacattgcaatcctcaaacatgtggttatctttgttgtattggcatattcagtgacttgtacattcagcaatagcatttgagcaagttttatcagcaagcaatattttcagttatgtttcaaaattaagaatgggtttaaacttgctgaatgtaaagattgaccctcaagtcactgtagctttagtagttgcttattgtattagtttagatgctagcactgcatgtgctgtgcatattctggttttattaaaataaaaagttgaactgcacagtctcctttgttgttgtcaattgtggtttacttttagaggtgaaaataaagttgtgctcttgcctgagttgtcgtttgattgtccattttttaaaatgcctcttgtaggcagaatgagtgccccgtgtaaagcagtgttgggatacagtgcaattacatttttctgctagatgggtgttgaaagatacacattagtatataacgtgtatttgtagtttttcttttgaaaaggtttctgtagtcctgggatttgctgtctcaaacttgcagagaaccccttgcatctgcctccccaagtgttgggattaaaggtacgctccagtggagctagagaaagtacccaaggagctaaagggatctgcaaccctataggtggaacaacattatgaactaaccagtaccccggagctcttgactctagctgcatatgtatcaaaagatggcctagttggccatcactggaaagagaggcccattggacacgcaaact

SEQ ID NO: 35617 - DNA, 3313 bp, Mus musculus
aaacacaccatcgttttcatttcttcagggttagctggcctccatcactttgtgccttggcagaatgagttctggcctgaacagctcctcttaggcactgaacagagaaggcatttttgtgttcatactcctctcctgttttcagcatctcacccttcccaactattattacatgataccatttggtttctgtttgtagaccattctttgtcagtgcccagatggtcacaacttaccaacaagatactgtgagaataacttgtgttcggtcccacaagtaagggtggcctaacagcacaccagagacagactcaacagtgagctcttgctaggtggagggagaaaacttcaggagttgcttagggctgtgtagtgctgacctcgatcctaatcagtgcccaggccagacatcattactgcagtagtactgagcataaggcacccttttcagtggctcagtacctgctctacctcttccagtaaagcacaactaaggtgtgggaaaaaaaagaaccattcctccctctggtagaatcccttatgctccacttgctcttgagagcacatctccagaaatgctggcaaggcctgtgtgtgaccatctaccacgtccccccagacagaatgagcataggaaagtgaagccagctgaagttcaggtgagcacagactgaaaaaggtactccaggactcggggacatggggaacttctgtcctcactggccttctggagtctgagagaagagcactggtggcatccttcctgcccttatacaggtggcgaaagcctgcacctagaacccagcggctgccccagcagctcacctgctcttctccactaatacacagctctaaagcagtgtgcttatgacctacaggaaaacaatctctgaagtcagagtactatcagtacagccgtaccccgagcaatcagaggaaattgctcaaagcttcttgactgcttccatttcatcggccagaacacacacacacacacacacacacacacacacacacacactagagcaaattaccagagattgctaaatcagtagtcagctgaaatgttggaaagccagagtgcaggtcctttctgccgccccagccctactccccacaacaggagaaggagtgtttggatctcctaagttcgttgcttaaaagatgaagtgagctgattttctaatcataaagcagtaattacttctcacatgcatcgtattcctatctgaacactgaaaaggaatgtgtccctcagcttaattcatctggaagtttcccaatgtcgagataacattggaactgctttagcagcaccccatcagaggagatggcttaaaatatcagctcagaaaggcaaaagaaagagttgacctacttcttgctatttgcattcagaaggcagagtctcaggctattggtggcagaatagataaagctgcagagttccccagcaaaggaagagtggcaggaagcggtcccttccctatatctaaggcctggggcaggcaggccaagcattcctttgaagctactgttatctttttaagctttttatctgtgagttctgttttccaatcaggggtctcttcattaaggttaccagggttttggtttgtttttttttttttttttttttttttttttttttttttttgcaaaaagttaaatcaactgaaccaccctccaggaaatggggagctactcagaatggaaactgctccttaagggtgaggcagcccaaagcattctcttgtctcccactgatgggatgttcctttagcatctcaggtcagtttcttacacgggggaaaaataagcttagcttgtcacaaacgctatggagaaaatggcttgattagtgaattcttaatacaaatgtctccttggaaagaatagagggcacactgctaagcattccaaaaatcaagcccctggcatgcctcatcacttcttgtttcaggtcagcattctggtgggtagatagtggtggctgtttgtcagaactgaacacagcctgctccatctgttctcttcgcaaggatgctgatgctgaggcacactgaagcccctgaacacatctttcttgatgcctcgtttcttcctatggctttcagaagggctgcatgttcttctcatcgctgtttttatttgggggcacttgcccttttctggcccttttagaaatagggtctccctctctgtgtggtaccactggctaaggaaaccgtacttgggaggcctcatttgtaatcagctatgcctgggcactgcacacgtccatttgccttaaacttgtgggaagtctcgggttgcccagcttacagagtgaagttcagctcccacatccatccggaagtaggggaaaagaggaagcgcgtccaaccttcctatctgcacttcctgttggtgccttcaggccacagcagcagtagcagctataggcaaagagcagcaccgtctctgggacgggcatccgcaagtcttagctgttagagggatgggagagaccattcctgacttcccactgtttgtcacccgaccctccattaactcccttgaatgaacctgtgcaaatggaccaagcaaaagaaaatggaaggagatgtttgcagccacatgggagaccacattgctggccccaagcacaactccagctctgtgtatgtgcaaaaccttggcacttggctactgcttagagttcaatccattctttatagcatgtgactgagtaaggtccggggatgatgagtcttttggacccaggagagaatctcaacagagggatttgtgcttgggagtagaagtaggcattcctccacagagagtggcattgcctttatttttcatttggcagagaccaagaattggggggtaggggttgatttccagtctttgatgtcgcctgggatgtcctctgcaggcaggtggtgctgagaccacagcatcgtgttccagtgcagtgtaggtgcattgccattcagactcagttctggggtggttttgcataaagctttgccaatgtgttctttctttctgtatgtattattgcctttttataaaaggttttgaagtattgtctcagtgataaaaagagagagatgttaatggttgttgtatatttcaccgtatccgattgtaagtattcgcagggtacagcaaagccttagcttgcaagaggagctgaaggggttggaaaggttcggattctttgtaaatgtcctgcttttctttctctctgtgtgtatctatttacatgccttagcacatgccctcccatcccaacccctttgccctgtcacctgaacaacca

SEQ ID NO: 35618 - DNA, 1066 bp, Mus musculus
tgggagccacctcctacgtggaaaaagcctctttgttatcggccttgtgtcagcaggtcgtggtccctagagactacctagttgtagtgtgacctacatttataattattgtcatgtccgaatagataggaggagaaaatcaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatacctttctttcctttatttatttgaaatgattagtctagtgattacaaaacagtcataaatttttaaaggcctgttttctctctttttttaagtcctttatgtaacatgcggatactgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaattacagccaagtacattccgttcacggggcacacccaggggagtaagaataaattgctattatgactaagttgtaaacctatgcacatcccttgcatttcgggcaactttataaaacagaaaaaaaaaacctgatttttattaataataatcatgtagtgaaatgtgtttgtaattttgtctcaatttaatttgttgtaaggtgggagggggtattgctggtttcgccatttcagatctgtgttgtctaagagtattaacgttttaattaagcaaagaaatgcggatttttaatctgtatgtaattgttttaagcacccatttaaagagaatatactgtgcaatgaagaaaccagtttaggcatttgctacaaactgaattattccaaaagaataatctataaca

SEQ ID NO: 35619 - DNA, 1169 bp, Mus musculus
gcttataaccacctgtaatgagatctgatgccctcttctggtgtgtctgaagacagctacagtgtactcatatgtaataaataaataaatctttttaaaaaagttttaaaccccaaactgattagactaagaggaactgaaatgatcagaacttttatggaaattgtatcatattaactcactgcactgagtttaaaatatatataaacttttaaaaagtgttattttaaaaatcactttacagggctggagaaatggctcatctttactgctgctcttcagaggacctgggtttgattcccaacactcgtactgtggttcataactgtctgtaacgttagttccagaaaatctaatgccctccaaggacacagacatacgtgtaagcaaaatacccatacacataaaataataaaataatttaaaaacatcccctttaagggcaggtgtggtggtgagccgttaatcccagcacctgggacgaagaggcaggcagatcttcgagtttcaggccagctagggctgcaggatgagagcttatctatgtgaacagcagttgagaactttgaaggcctaagtggagaagggttccacgtgaacagcagttgagatattatctttttgttgttgttgctgttggttttctgttttttgaaaattgctttacagttctatttaccatgttaaagataaatgatattggcaaactagaattactaatatttaaaaggtgatatgcaaagaggtatgcagtttctcttcagattgctcattctggcaggaaatggaagctatattaaattatacattgagcttatttaatatatttgtctttgtatgatttctataaatcatgttgaatttttcaaagtattaaagagttggttatttgatattatagaaaaatattttataaagtataacttcctaaatctatcctaattttaaagtttgtattttagaaatctcaaataatattttaactatagaaaacaggaatgattcccttttcttccttcctcatgcactctttccttaaggcaattgtgaaattataaaccaggaatttaaaccattaagactgggcaaacaaaatttaagatgcaccatttaatctgaagcaactctgtcttccctgggtaggagaggaagatggcccttggttctga

SEQ ID NO: 35620 - DNA, 1115 bp, Mus musculus
cgcttcgcggtccccgagggtccgcacgccccggcagcgcggtcgccagccaccgcgcgaggagcagcgggcgggcgggcggcgccgggcccgggccgccctcgctcccacgccccggccccgccgcccgcgccggggcggcagccggcagaggaaaggcgctgcagtctccgggcctcacggccccagtcgagcttcctcagcaccgagggcttgcgggtcctgagtggaggacacgagcccggagccgggcactgagctcttgggcgcccccaacccagttttcagaaccctccacgctgcggccgctgtccccttcggaccatggccgacgacgacgtgctgttcgaggatgtgtacgagctatgcgaggtgatcggcaagtgagtctccacgcgagggagcgggagtgtggaaaaatgcttttcagcgatgcccggggcctcccgcacccgttccgggcctgccccctgccctctctccctcccctctgcctccctcgttctcttcaccctggagaatttttagacgtgtacctgggtttcctgccaggaatgggtctgggggcttcttagtaatgcgtggaggccaccgagccccggtcggccaccccataaggcgtggggcgggctccctgcattttatctgacggttacacagggacgtggcaggaccgattttgtagttgcttcctgggaacagttggggtttttgttacctttcctgtaccatagacctttcacgaaaagagcagcctgcatttcatgagcttgtgtggagagagcgagagagcgcgtccggggtttttaattgtggggtgtgtgtctattgtgccaggatattagacagatgcctttgtgttcaccccatgcccggatttaagagggtcattgaagacggatgcgtccagtttcagcaaattcttcacctgccatagacaaacatagaaagagttgggggcacccaaatttttaatgcctcgttatgcaatgactgtacaatcagtgctcgaggctcccttccactgttgttgggatggtggttagcgtggtagagccgtctgctttgagtcaccgggctggtctagaatatagaactgacagtccaaatgctca

SEQ ID NO: 35621 - DNA, 1216 bp, Mus musculus
tgtctataaatagctttggtttttttgtttttgtttttttggatttttcgagacagggtttctctgtatcatctggttgtcctggaactcaatctgtatgacctggaactcagaaatccgcttgcctctgtctcccaagtgctgggattaaaggcgtgcgccaccgctgcccagctataaatagcttgtatttgacattagctgccgctctggtctcatggtgtaatggttagcacactggactttgagtccagcaatccgagttcgagtcttggtgagaccactcattgataggggtggtgtgggttcaggttttctttctttctttcttttttttttttttttcgagacagggtttctctgtgtagccctggctgtcctggaactcactctgtagaccaggctggcctcaaactcagaaatccgctgggtctgcctcccgagtgcaggattaaaggcgtgcgctaccaccgcttggcgcaggttaagattattatgtgactgatgagaacctttttttaaaagaaagttgaagccgggcggtggtggcgcacgcctttaatcccagcacttgggaggcagaggcaggtggatttctgagtttgaggccagccgggtctacagagtgagttccagggcagccaaggatacacagagaaaccctgtctcgttctattttatttatgtatgtctgtgcatttgcatatgcatttgtccgtaaaagtgagcacgtgttctgtggcgaacagtggcactgcatccttggtgctgagaactgaaccctaattctacgaaagggcggtaaatacttttaaactgctgagccatctctccagcatataaaatcttaatatgaagtactggttggtctggaaatcacagaaatttgcctgcctctgcctcctgcatgctaggattaaaggtatatactccgacatctggccagtttgcatatcctcttttaacaaaaatcttttgaatttaaaaaatatatttctaattcaccctgtataactctacatggttatgaatcttgcagtcttaattttatttttttattactcttagttatgtgtgtgtgagggaggttatgtgcgcatgagtgaattttgctgcagaggccagaggtgtgtgggatcctcctggatggagttggagtaaccttgagaaactggatatggatgctggaaatcaaactcaggaaatctggaagagc

SEQ ID NO: 35622 - DNA, 1275 bp, Mus musculus
gccacaaataggaagcacccagtagctgtttcaaggatgttttctctattttgttcccttccttccagaatggtcatgtatgcattcaacccactatgtactgggatgaaggaggcctattggaggaagaataatgtgtgtcgtctgaagacaatctccacctaaatttacaacctctgagctatgggtttcctttaggaaaacaggagggaagcccatgaatgaatctacatatcagctaatgctttatgtacctcacatatatacatgctattaaacttcaaattacttatagatacttttatgatgagtaaaagtaaaaatccaactatatactatatttaaatgatcatatcttacttattttctcaatcaatgtgtacaaaaagatcaaccttcaggaatagtttccttaaaagtttagaatttaaagaggggattctatataaaaatggctgctctattcttcccaatgtttttagtaaatctgctctgaaatctcccccacatatgacttcttaaaatcccctgatgattgctcgtcggccttttggctaagatcaagtgtagtatctgttcttatcaatttaatatctgatacttcctctatctgaggacaatgtattaaatggatttttggaagtaggagttggaataggagcttgctccgtccattccacgcatcgacctggtattgcagtacctccaggaacggtgcaccccctccggggaataagagtggtttgaaaagtagacttctgcagcttttcttttgtctgcggttcttgcttcactattactcttagtctgtttctatcgttgctcactctctctgtctgaaatgactggcccctgtcactattttctgaggtaggctgttgttgtactcttagtcagtcactctagaactctgattagtttctttaaatctcttaataaacagaatcttactccagactcactgcaagaacaagttaaagaactatcaacttcacacatagacaaacaaacaaacaaacaaacaaaaacaaacaaaaaaaatcccctgatgaagaattcttcatggccaaggaaaaggcatgccattatgtgttgaattgttcatcatttattaaattgaatcaacactagcacttggcagttgtagatcgaccaacaatagattttcacagctttcctgctaacccgttgactgagagcatcgtggtgtgacgggtggaggctggaatcatttggaaagaataaccttgtccactatagtaagatatcttttcc

SEQ ID NO: 35623 - DNA, 1164 bp, Mus musculus
ttagcctctgcttttactatagatgcaactgtcttagcatagaaatacatactactacagataggctttgtttcttttaactatagcaagaatttctattaatgatctgtgttcatctgtttaggatgttccagctcttgaaattacccacaccttcttagagaggaacctgccttccgtgcctggtctgctcaagatcactggtttttccacttctgtggctcttctctgctttgtattgtacaagtttaaacagccccagtcctgaagttttcacccacaggcctcctgcttgatcatccttagcacaatgagcatgtaaaggaaagtgaggatgaattacagcctgtggtttgggcaatttaagtgcacttgatttaaccctgctcagtttaatttcagtctttgtaaagtggtaacagtccaaagaatcacctagctaatttccataagaatgagtttcatcttgtttgttagactaatttgtgttggttgatagaataaaatgttgagtgcttaatttcaaaaagttaagtgcttatgaggaataatttctggattctgtttttttttttcttttgcctttaatgcaaaacagctaatggtttcagaaataaaataacttgacttactgtgacttttgtgtagcatccaatgtgtacagaggaaaatagtggctgaaatgttccctaggtatcctcactgattactagttccatgtgacgcacactacaataggcacttccttttctggactgtatctagacaagcattgctccttgtcagtaacattctgtgctgatttaaggaaagtagcattattttaatgtgttctatggctgtctgatcatagaattagatttctaagcctacctgtgtcttcaaaatggttaaatatttgtcttggttgatagtataccattttctctcaagtgccaaaggacatatgaaattttctctgttgttacagtcaaacacagaatgaaattagggctctgtgtgataacatgacctcttttaattattaggttttataacagacattaaattgaatgattttatatatctgtactgggttctatatcttagtagagttgtgggtccagaatggtgcctgtatttttttctttcccatctgaaatcctgtcaattaaaaaaaaaaat

SEQ ID NO: 35624 - DNA, 1169 bp, Mus musculus
tattaatatctaattcagtgtaatatttgtagcatcattatgagtatttttattgacactttgatttttaggcaacagactttatcaagcagaacattgtgatatccagcggcttcgtgggaggctttttgctaggcctggcatcttaaggacttgaaggctctatggtagtggatccaacaatgagaggaagactgtggcagcagggttatctcttaatggcacatgctaccagtctccaaagtaaggaacagccggctggacgattgcaaatgaagcagcttagcattttgccgcctgaagcttaccaagctagtatctcctgtaagacaacctatgtgctgtgtacacaatagtattcttgagcaaccatggattttgcaaatttttaaatttaacatttgtttagaaactagcctatgattatcatcactggatatagtggagacagaaaaagctgttacatgtactgtccaatgaaatattaccctatctacttttcaaagttttttgtgctttactgtctagtgctaataattaaatattgtcttatagcttcaatgttatggctgattttttttaaagatgtgtttgcaataaactgaagaattgttttacccctttgtggaaggcaacaatagaattattaagatattaaactcttctgatatgtcaatctttagttaggtttttcccccttctctttcttactttgcttatgtgtaatatttacattaaaggaggattttgtaatgaaatactacgcgactaaaacactttccctttctctaatgtctgcagtttttgaaacgtctccttgtacgttctaatttttcaagtttgtttgctttaacagaactaatttgggagtatgtcattagttggtcattgatatgctttattaatttcaaatgcatctcattttttatttctaaaaatcctaattatttttttgtctcttcaccaaaaggtacagattgctttaaaatacttaatagtataatatgaacttattgtctgaagaactgtgattttctgtgtagtcctaaaattatagcttaaatataattgcttccttgattatatgatgtaagcactagggctctcaggcattgctagcgttccatttcttgaacattaggccagtttacttgtttctctgggccagc

SEQ ID NO: 35625 - DNA, 1240 bp, Mus musculus
atgaagctgttgcctatggtgcatctgtccaggcagccattctatctggagacaagtctaagaatgttcaagatttgctgctcttggatgtcactcctctttcccttggtattgaaactgctggtggagtcatgattgtcctgatcaggtgcaataccactatgccaccaagcagacacaggctttcaccacctactctgacaaccagccaggtatatgaaggtgaaagggccatgaccaaggacaatgaccttcttggaaagtttaagctcacaggcatacctccagcaatccttggggttccacaaattgaggttacttttgacatggatgccaatggcatcctcaatgtttctgctgtagataagagcatgggaaaggagaacaagataacaatcagtaatgacaagggttgattgagtaaggaggatactgagtcttctaagaaggtaagaagtacaaagctgaggatgagaagcagacagataagttctcctccaagaattcactggagttttatgccttcaacttgaaagaaactctggatgatgagaaacctcaaggcaagatcaatgatgaggacaaacagaagattcttgacaaatgcaatgaaatcatcaactggctggataagaaccagactgcagagaaggaagaatttgagcatcagcagaaagaactggagaaagtcttcaatcctaacattactaagctataccagagtgctggtggcatgcctaaaggaatgcctggtggcctccctggtagagcttccctatccagtggtgcttcttcaggccccaccattggagaggtagattaagtcagtccaagaagagggtgtagcattgttccacaggggcccaaaacaagtaacatggaatgaaaaaaaaaactatttacactgtcaacaggacaaaatggcaaccaacagatccttaccaatcctacatctgatagagggctattatacaatatatacaaagaactcaagaagttaggctccacagaactaaataactctaccaaaaaatggagaacagctcttgatctcttgccttcctgctcttggtctgttctcttatccatttccctctctccccattcctctcccccttccctctccacattctcatggctggcctctaattctcttcccttctcttctcttctcttcccttcccttccctctccctctccctctccctctccctctccctctccctctccctctccctct

SEQ ID NO: 35626 - DNA, 1142 bp, Mus musculus
ggatgaaggccctgctgggcaaggtaaggcaaaccgcgggccggagcgcggacgcggtctctcgagccagaggcgcgctcgcctggggcaccggggccgggtcaccactcattgtggcctcgaaagacggccgaggggcttccggaaaactatttcctgctactgcgctcccctccaccccctgatacctcgcttgctctcttgagagatcacttctcttggagccagaggacagaggcagtggcgcttttggggccaagctcatgtggggcttccaaattgactacgattttaccgcccttggaggctaggcggatgatctctgaggtgcctagggagggtcatgagttcgtaaacagctgtagatttccttaaatcccccgctcgttatcttccctggttattaaggctctttaggcagtctgttcctgatgcctgctttagtcaaacatttcgggatggcttcttgtctctgctccctgaagggggaagttgcacgtagtttaggtccgtaaagagtttgcatggggttattgacttgtatcatcatcggtgtgtgctttacctgaagttaggtgatttgtttactttttggatctttctgccaaagatctaccacagttgtatgagtgcgttttctggagcttggtttcctgtgagtctgtcaggagcagttggggaggattctgggtgtagtctcttgtttatttgtgtgcaaagttgttggtactgtcatttagttaagtaatggctgcttctgtccgcccaagatggcgggacagggtgggaggagaaagtgagccgggggaggtttgggggagggaggagaggtaaacagggaaataaatagtatcagagaagaataggcctctcctttggagtatgtagctcagtagttaataaaaatgatcacagattatttgcatgtagaatttttgtccccttctctagctttgaaatagcgtgcatacgcctggtaaatgcttatcaacctgtagcacatttagttacccatggtaagctattgaacaaaggctggagtctcagtctgtctacttcagtttatatttcctgaccaaagtgtgattggaatggtaggaggaggtttttttgttagctgggactctcaaacttggagtgtc

SEQ ID NO: 35627 - DNA, 1189 bp, Mus musculus
tcctggatgtgtgcttatagagttaaatgggtgatccaaagtaggaaagatagacaaaatgaaggcaaatatatcaagcttttatcctgctttcgttatcatataaattcaagtgagaaatcactgcaaaaaaaaaaaaaatcacagcaaaggcgagtgcttataaatacctactatagtaatgcttcttaagactttcctaaggtgaaacataattgtgacttataattattctccttcttttagcattatctgcataccagaggtactacagtttacagtctgattactggaaggttggtacacattttcatgcttatttcttatttgtttttgttggcacatttattgttggttataaaaaataaagattagagctcacttttttttaatgttacttctacaagaaagagatttgaagacggaaatcaatatcattttgttattttctatttaactactttgtattttattaaaaagaattagattgttgacattttattgaccagagatgatctgatcgcatgtgaaataattgaaaaatcaaacacagccaaacagctttcagctagcaagggcttgggttaatggtttgtgtggtgctggggattgaacccagggacttatacttggtagacaagcacctcacaactgggttacatttcacccctttgtttatgtatttgtttcccggctaagaattttgaagtcactatatattcttgatatttatcattagtgtagctctggctgtcatggaacttattctgtagaccaggctggccttgaattcagaggtctttgctgctcttgcttccccagtgctaagtgagattaaagatgtacaccaccgccacctggcttgtattgtcacttttactgattgattccgttcctttgaaaaagctttttagttttatgaaaacctatttgccttttctggactttattttcctgtgcattatttctgaagtcattgcctatactaatgacattgtttctcctgacttttatttttcctagtagcttcatagtttcaggtctcaaatttatttctgtttaattttgagttaagtttttttacaaggttggagataatagtccaattttaatcccttgcatagtttaccagaatcaatgtgttaatgaggttgccctttcttcgttaatactcttggttcttcgtaag

SEQ ID NO: 35628 - DNA, 1197 bp, Mus musculus
tcacctcctccctaccttcactccctccttcatacacataagggaactctaagttccctgagttgatcttggaaattgagaaccttttgtctcagcttcctaagtagctgggatggcagtccttccctactagacccaccttagaattaagagtttgaggttccttgaagaactatgaattccagaatttttcataagtttcagctgctttttttttcttttagtaattagtaactagatgtttccttaacgtgaaatttatttctgcttttcgtaggtagcttgccatattaataaatagtttcttgtgtttgaagttggcatcagatcagagatccatgattattcatctttacatgctgatatgctgattctctcctctgtggactacacacattgaatttatatgcttttcatttgttccctgcagatgagacaaacaggagttgcacaggtacggcctactggaattcttaatgggccaacagttgactcatcactgcctacaaactcagtttctggccagcagccacagcttcctctgaccagaatgcctagtgtctctcagcctggagtccacactgcctgtcctaggcagactttggccaatggacccttttctgcaggccatgttccctgtagcacatcaagaacactgggaagtacagacactgttttgataggcaataatcatgtaacaggaagtggaagtaatggaaacgtgccttacctgcagcgaaacgcacccactctacctcataaccgcacaaacctgaccagcagcacagaggagccgtggaaaaaccaactatctaactccactcaggtaacaagactagctgcttaggttgacttctcacacagtagttcgtgtttattttgtttatgtatggtaagtgtttgaacaattgtttttatatgaatcatatagtcctacaatgttgttgctgtgtttcaattcagtatacatgtatatactttctgtcctggataatttccgcagatagacaatctggaagatttaccaatgaagaaaacaaacaatattttttaaaccccaagacgatttctaacttatactggccccagaagcaaaatgcctaattttatagtagtagtagatagtggtcaacatctgagtatagacagaatgagtcgaagagaataaaatgccaaaatggagtatgggagtgaaga

SEQ ID NO: 35629 - DNA, 1278 bp, Mus musculus
tacaaaaggtggccaggtgggagatcttaagggaaattgtactgtttcgttgtgtaacaaggctgttgaactttaacagagaataatttccgccagtttcataaagcaacatatatatttgcagctgtgaatcaaggagcacaactaacaaatgagcataccaaaatagtctgccttgcttttatttccaggctcctccattaccatccgcctcatcttgatattgttccatggacattaaacatgagaccttttctgctattcagaaagtaacccagttctgcaccactgctatttgtagctatctcgtaaggctgctggctgaaaactgtgtctatgcaaccttccaagtgtggagtgtcaaccaactggacgggagagtactgctcctatgccaggactctcgtaaagctaattagctgaacttcagagaaaaaaaaaagaataataattaccacgttttgtatatatctgacaaaactggcaacatcataaagactactgacttgaagacaacctcttttatatttctcgatttctgggctaatgaatttgttttcacctatcttttccctttcagaattttattcgggggggaaaataactagcctagctggtcatttctttgtaaggtagttagcaatatttagtctttctttggtcacctttttttttttaatgtgaaaagttaagtaagaaactttttttactgcttttatgaatttctgtcttgttttgaaactatgatcgttataattttggttcccaaataaaacatttaaaaaaaataattaacagcaacgtcacaaagataatggattgcacatagactaagaaataaacttcagaattgtgattttttttgtttctaatcttgatgtaaatttacactatttataaatacatatttattgcctgaaaatatttgtgaatggaatgctgttattttttccagatttacctgccattgaaattttaaggagttctgtaatttcaaacactactcctattacattttctatgtgtaaataaaactgcttagccttgtacagaaacttttattaaaattgtttaatgtttaaagagttttctattgtttgagttttaaaaagaatttatgtacagtgcccaatttttgttcacttttcaaatctgattatatatattttatatatacttatgtctgtatatataatatatatagaaatctagatatatgtataaagatttagaatttgaatttttcttgttttaagtttcacatctatggtagatttt

SEQ ID NO: 35630 - DNA, 1173 bp, Mus musculus
ttcccctttttgttggctgtacctttcagaatcaagagccactgagagaagatgactctgatttcatcctaacggaaggtgacctcaccttgacctatggggatagcaccgtgacagcaaatggctcctcaagctcctacacagcctccacaagtctcgagtgtggtcggagaacaaaaagcagctctgaggaagtacttgagcgagacctgggaatgggagaccagaaggtttccagccggggaacccccctcgtgtttccactgcaggaaaatgcatgacttacctgtaaatcctgagggatcagggaggctcttataagggtgaggatggccaaatgcccaagtgtgtttgatgtgttgtattgaccatgttaagactattgcttctgtttcagtggggcctgaaactatcttaccactcaaaacttaactcaagactcagatggtaaagctgaagtgtctctaaattaaacacaaatgcagacctattcccactttttcacatagtagtacactatttcagagttaaacaaaacaacagcatgctttactggtctctctcttcatcctcctgtagtatctgagcatggtggggcagataaggggcttcatcgctatgctatagtgccagtctagctggctcaagaaacatcaaattgggaggacaagttagacaaatgacagtgaagaaaagaaactgagatcagaattccagtggtgccagatgctggtgttgcaccagatgctggagcctctggctctgaagacttacatagctacatcttcctgtcacagtcttgcctgttcaagttgtgttgctcctagactgaggattaggaagcaggcccataggctgggaccttaggtcagtgggagagtactagagcctacagctcaccagatcctgggactgcaaaaattgtgtgtgtgcacaggggttttccaagagcatttcaatatgggagttggggaaagtctagttccttctcttagaatctctataaaagagttactgaaatgttaaaaaccaaaggcaaaacacgttctgttctgttttagttaaactgagggcagaaggtattgggaaattgctgatgataccatagcagtactcacttgacttttgaggttaccatgtgagcccactgcctagaaggtaacatacggacta

SEQ ID NO: 35631 - DNA, 1202 bp, Mus musculus
aaaaaagcatacttaaagttgaaatggttaaaacaggggctggagagatggctcagtggttaagagcacctacttctcttccgaaggtcctgagttcaaatcccagcaaccacatggtggctcacaaccatccgtaatgagatctgacgccctcttctgatgcgtctgaagacagctacagtgtacttatatataataataaataatcttaaaaaaaaagaaagaaagaaatggttgaaacaggatccaagaaatacacatagcacttagtgaatgtgcccttgaactttggtttctttcccgatttcctccatcgttcttttcatttactgaaaacaaacaaacaaaaagcttcctatttcaatgagactgaggaacttaggttttagcattaacaactaactgtactggcatcccataggtacttacttagttttggtgaataatgttaacaatactcaaagttacatattttgtttctgcaggttgatccaaaagattacatgtttagtggactgaaggatgaaacagtaggtcgcttacctggaaaagtggcaggacaacaatttgtcattcaagactgtgagaactgtaacatctatatttttgaccactcagctactattaccattgatgactgcactaactgtgtaatttttttgggaccagtgaaaggcagtgtctttttccgaaattgtagagattgcaagtgcacattggcttgccagcaatttcgtgtgagagactgtagaaagttggaagtctttttgtgctgtgctactcaacccattattgaatcttccacaaacatcaagtttggctgttttcaatggtactaccctgaattagcagcccaattcaaagatgcaggcctcagtatcttcaataacatttggagtcatgttcatgattttacacctgtgtcaggagagctcaactggagccttcttccagaaaatgccgtggttcaagactatgttcctatcccaatgactgaagaattcaaagctgtgcgaatttccacagaagccaatagaagcattgttcctgtgtcccggggtcagagacagaagtacagtgatgaatcatgtcttgtggtattatttgccgatgattatacaactgcaaatgccaggaaactaattgatgaggtaaggagaaagagaggagaaatagacatagctaggactatgctactttgg

SEQ ID NO: 35632 - DNA, 1170 bp, Mus musculus
acgagagagccttgattggctatgggaatgatatggaacagactaggtagatcttaaaccaggagtttgaaatgatagttatttcattttcttaggtatgaaatcatattgcggttaggtaggctatgaatgtggagtatcattgtgtcagcaaaagaaaaacaaagcatgggtgtgtaggggcccgaaaaatgactcagtgagtaaaagcacttgccaccaagcttgatgacttgagttcagctcctgggtccctcccacatggaagaaggagagaactgacttccataagcgtgccttgccatgagcacctacacacacccacatctacataaataaataaataaacacataaatgtaaaataataaaaatctctgtggccaaaatttgactcttagtaactatagttaaagataagatggatttttttttttttttttttttttttttgagacagggtttctctgtgtagccctggctgtcctggaactcactccgcagaccaggctggccttgaataataagatgaatatgtatgctgttctttccatgtttttagaatgtgtgatttttttttttcaaaataagaattggaagggttggagtaatggctcaatggttaagagaagtggctattcttccagaggacccacgttctagtttcacgtggtgtttgacaattggctataatttcagttcccgccattctgatgcactcttctgggttcctcagaccctgcatgatccacaggcatacatgcaggcaaaacacccatacatacaaataataaataaaacctttttttaaaaaagtatccattttattctcaaaacccttaaaatttttgagaaaaatccaagctgcccagtagtgacttcatatggaccagcaagcagactcagtgctaatattccaaaaggttggactgggccctcttttaaagtgaccaatagtcattctcaggcaggatttctcaactttggcatcattgacatcttgagtcaggtaattctttgtcctggataggactggcctgtgtgtgataaaatgctgaacagaactctggctcctgtccactagatactaatttcttcagttgtagcaacaacaacaaaatatttttaggcattgcctaatgtcctttaaggagcagaattgctgtcagttg

SEQ ID NO: 35633 - DNA, 3085 bp, Mus musculus
ttatatacagacagtttgataatatccttacatatgttagtcatttagcaattagtaatttttactaatgctataattgttaaaagctatttttaaataactctttgaataccatattatttacttgagtatctaaaataattcatttaaattgagtagttttaatcataaactatttaacttgcttcagtaagcttgcagttttatttcttttcatacaatagtcttattaggaaataatcatgattttattcctaattaaaagttctttcatatctctggtaatttaaactttccaacttaccttagtgctctatgataattcatttaagaatatattttgtttcttattttctcttttaatttagaggcatttgttactaggtgaaattaaataaacctatgcactttaaaaaaatacatacatagccagttaaataatcatttccttcttgcattatatgactaatgagattttgtacatggagttgacatactattttgtaaattgggagatttttttaaaatgggtatttgaaagctgaatgtggtcatggcatatgtagtcccaggctacttgggatgcctaagtggaagaatcacttgagttcaggagttcaagaacagctttggcaagtaagaaaaggctaagataaccagctttgcaaatacttctaactgatcctggcattgctggtttaaggactacttccaagtagtacagctgatttctaagcacaactgccagatgattctcctgttttctaataagaaaaagttagatacaacataaaactatagaacaccaatgaccaagcagggcgtggtggcacacgcctttaatgccagcactggggaggcagaggcaggctgatttctgagtttgaggccagcctggtctacagagtgagttccaggacagccagggctatacagagaaaccctgtctcgaaaaacaaaacaaaacaaaagaacaccaatgagcaacagatttgacagaggtgatcagtgtctgtgactagctattgtgactagcaagagacctagagcaaatcttataagtaaggaatcttttaagtaaggaacacttaggtatgatgataatctagacaggttattcaaaatctccatccattttttttttttgctcatgtcaactagtgttaaagtatgataaaagttttggttacttgaaatcattatttctcaattctatttgataatagtaacttccaggaggaggaatgggaattgttcagaaatacacattgatggatccagtctaaaggtgcacagattcagttttcaagggaaactgaaatagggtgtattgttatctaaactaatcagttctgaaagtgctgatagggcgattttatcatatttggcagggagcaagaacagctttcataggctcatttataggactcaaaatggaaacttttatttttataaaactgagattgaaaatggccacttgtaaaaattccttccatggttgttaccaaaagtgtattttcctgtttaaagtggttttggaaactttcaggccaacttataactatcatgttgaattgtaaatgtgtagaaataatgcttttttattttgaattaataatattgagtacctacactgtgcctagcctaccatcagcatttcaacatttcttttattataagagcatcatgttctacagagtcaatatgatctcataaggtgcaaataaaaactgctggcagggcaggtataataatttctatcatagtttacaaatggtctttgcaaatagtgatcagaggcattaacgtttccctgagctaagctaaattaaatgcattcttttctgccttgattatattactaattttctttacccacatttgaaataatctcaatacttgctatttcaaaactaaaatgcaatgttatagggggtatacattgagtttttaatcgtatcaataatggtgtgtaaaaactcaagaatattatataaaggagacattaatttaagattttcccaccaaatttagtatgttaaccaaaacctaaaactttatatccatttagatgggaactttttacaagtacttttatgttgtttctgcaagtctagacttcaatagtaatcatgatatactaactatattttatttctgaatagttttttaaattcatgaaaaattaatagccatgaaaactgattttattgtcatatttgtttaagcatcttattagtttacttctcttgcattaatagtactgctatattttgggtctgtatatttatatgtggcatttataaaattatctagtgttttaaaaatactttgaaataaatattaaaattaaaatggttcaatgctacttttttgaagagtactctatatttactcatacttgtaccaaaatttgataaaatttttattttcttttgggtgttttgttatacaacttttaattttaaaaacaaaataaagtggtctaatctctgttttatactaatgagaaatgaactgttaaactgcgtgtgtatgtatttgatgtatatatgtgcatgtgtatatacacaaggtactctaaagaaatgaaaaggaagaaacatattttgatataaggaatttacatcatgttttctttgctaaaataagtcacattttgttatgggtgaatatttgctaagattaggcatctttccttccatattttaaaaatatgctgggtatagcatatacaattgtaattctagtactcaggaattcaaggccagcctaggttatatattgaattccaggccagtctgggctatatagcaagagcctgcctcaaaaaataaagaagtgtgataaattttcattcaggcttataaaagtagatggtattttttattgtcaagtttaccagtctttgtcctcctttcctatctcacaaaacaaatactgaaagtgcaaattggtttgtttgtaaaaagataacattatgtttatttctacttataaaggttcaacaagtacattaagaacatttggagcattgagaacaagcagaaatgataacacaataataaaattgcttcctgttgga

SEQ ID NO: 35634 - DNA, 1215 bp, Mus musculus
atgaaaaacaaaataggtagaaactggttgcacaacctcgttgcctagtgcacctaaccagaatcttctttcccagagtgcttctcttaaataccttgcctgcagccatttctcctcagcctggagggtggagagtgggggtggagagcagagcacagcagagtccacttgaacaaagcattgtattttacttagtttaatatttctataacatctgtaatggtaggaatatagagcctagcctttgtaccctttaaatagtgtggctcttacatattatctgatgattctggataagtaaaaatagatttttttctttttttgtttaaccttaagagtgttctacttccataactaacattttctttttttattttagatgagctctgacttcaaatacttgagttattagaggataaactctcccgtcaaggattacagaagttgggagggggatgctgttcatattcaattgaagagtgcccaattcatattaagctctcgacattagttaccatcattgtcacctttctttcacatgtgttctgtacacctctgttcactagagaagagctcttattccaatactgttgctttaaaatactttaaaatacaatattattcctcacaattttttcagttagcaactaatacaggttacagtgttctaactccaggatccacactctttcttcttttctgaatcaagccatggcactgggatatgaatcttggtcatgggcagttcaaaaggaagtacccaggaatgacttggaggctgttttcaggacacacaagcttttggaacatttgcgaaccactttctggcctgtagaggagattctcagtatcatcacacctaataatgcaggggcagttatcatacccgagtgataagagttagtaaaagctaaagtacaaggatgttgaagacttatagattttgtatggccatctcctttttatactgcttattttatccctttcttatgttctaccaaccataacaaatgttctctaagcgatacaaagccatctcctgtttttttttttaactttgaagtttagctgaaactaatcatatttttgagggtgttgagggaatcaggaactatcaggtgtttatggaaacgtgacattagagagctcttagaagctttgatcatggatgcagagaggaaggctaaaaatgaggttgaatattatcatgggaca

SEQ ID NO: 35635 - DNA, 2902 bp, Mus musculus
ctagcatggaacatttcagcaggtccttcaaggaggccaccaatacatgggtgaagcctactgaggacctccagtactgtgttaagccaactaagaatgtgagctctaaggagcagttgtggggtagacagcttctcaggcgtcccacaggaagagcttcatatcaggaaactgatggctattgccctgatttggagcccagtgattcagaagcagaaggggaggggagtaaagaaacaccaagggtaaagagagagagttctgacagagaaaatccttcccatgattctgctcgggagtgccatgggaaaaccaagacacaccctcattcccacagctcaatgcaaaggtgatcagaaacgcctaagagtaacccagcctttgccccgtatactgggggaaatataaacaccaaaaggattctagtatatattagggggaattgcagggaaaatgatggtttgaagtttttgaaagcatttcaggtctagtttttataagcacattacaagagttgcagattgtctggggttgctttgtcggaggctgctgggaacagttgggcccagagtatttgctcagttagtacttcagggcagctttcccgttacattaacacactgattaatctacatactaagaatccttgcattgtcaatggatttgcaagaggatgtgacagacactaaaactacttatcttttgaaactataacatgtgactccttgaagctcaaatctagaaaatttctaattccactggtatctgtaaaaccttcaagagagagaccaggagagcaacagtctcagatactgactcttactgttgtcttccttgcttcatgcaaggttgagtttctttcacagtatcctatcttccaaagtcagttcttgtaggtgtccagtgcctgttcctagacctacttcttggggacacattcataactctcttatccagctaacaagctaacttgtgaatagtgtttacaaaagtacagaagtactacttccaaggaaaatgctctgcttctcaaggcatttgtgaagatgtccagaacatttcccaaagtgtgaccttttctggtatatttgtaccaggtcagggtttttttctgttgttttcaaataagtttgagtaaagtttggctgacagtttttgtatacctgctttaatgtttataaaatttttattgaggaataattaagatatagtgtaatacacagaggcttaagtattcttaacgtgctttaattttgaaacagatttttattgtcagaaatttgaaagcatgtgttcagcacatggatataatttagctttttatgaattttaaatccaaggccatttcccaagcataaaagttggagccatttttcagaacttgcttataccacattaccaaataatcagccttgattcatttctagacgaagagaattttgaagcaggggataaaacaagtctgcttcccctttaagcaaaaggagaaagtaacagtttataaacatgtgtgaggcagactgtaattctcagcttccttttcttcttagccttaaaataatattctctttcttctagttcgggaacatatagagagaattttcaaacaagaggccattttcaatttctgaagtttcatgctagtgaaagaagccagctgcagtaggtgccagtgctatggagctagaaaactcagcagtttgcctctgcttcactttcattcctagaacctcattaaaggtttctttggggttttgttttctcctgttttgaaattttgtgtattttgcctctcttttggctgcatcttcaaaataattccttttgtgcctatgaacatgtgtgaacagaccataacatgaataataggtgtcctgtattttcttttagttgaaaacatgagggagagaatttcctttcttcataccctcagcttctgtgcttatttgaatactcatagggtacatataaatttaacactttcatggtaatgagtataatgaagctgagttgtaaattccttaaaggccaacaggttgcctgtgtcctttcatgcttttgaattctgaggcaggggagcaaacatggaaacagtgctttagccaaattccatatgtaatgccattggaagagtattgcctgaaaaattcaagtcagggagataaaatggtaacttttttagagaattttcctgggtaaacaaatgagccagccttccattgtatacattccaaatgccccaagcatctgctacattttgttctttgaagtattacctcttaacctttgttaatgttttttgtcttgtcttataaaagttttgaagatgaactcaatcttttttcaaatgtcacctttttatcaatactttttcattaaattatgaaaactgttaacctctgtcagtgtgatgattttctattctggcataccgattttttacattgatgaatttactgtatgttaaaaatccatacaaatgaagcaaactgaagcaaggttcagggaggaagaattgaatgtttagaagcacaaatcatcacaatatggtgatgcatgtttagcaacccagtaggaagctgaaacagaaaaataatgtctaggacagcctgggttacgtgataagaccctgtctcaaagaaaaagcacacattcagaattcaagtcaataccagaagtcaaagagaaccctttgtattttgcccagaaatcatgaattcatcaggccagtaagaaaagactttagaatcatcatttaaaatagccagggacatggttcctatctaaaggctattgtttataatatttattctacacagagctctgagagtgtcttgtaatcaggtttatatggtctcatggcaggactttgtgtggtaaacattttcaagttgtcaaaggt

SEQ ID NO: 35636 - DNA, 1195 bp, Mus musculus
tggtctacaaagtgggtcccagggctatacagagaaaccttgtcctgaaaaaccaaaaaaaaaaaaaaaaaaaaaaaaaaagaaaaagaaaaaaagaaaaaaaagttggaacaatctcatactaggaacataactgtacacctgaaagctctcgaacaaaaaagagaaactacacccaaattgagtagatgacaaaaaaaaaatcaacttcagggctgaaatcaataaaaatcaaaccaaacaaccaaccaatacaaagaatcaatgaaacaaagagttgtttctttgagaaaatcagtaatattgacaagccctcatttatattaactaaaattcagagagactatttaaattaacaaaattagaaatgaaaagtggaacataacaacagatactggggaaatccaaagaatcataaggatatacttttaaaatctgtattccacaaaattggaagatttaaaagaaatggataattttctcaataggtaccacttacaaagttaaatcaagattagataaacagaggtttgttgaaggacatcggccgtggagtttggggttcggacgaagattgaagtcatggctggtgcagaaagtgatggccaattccagttcactggtattaaaaaatatttcaactcttataccctcacaggtagaatgaattgtgtcctggccacatatggaggcattgctttgctggtcttatacttcaagttaaggcctaagaaaactccagctgtgaaagcaacataaatggattttgaaatgtctgacctcacctgttaagtcccatgcctgaagaagctgatgtgaactcatcatgtaatacacaatttgtacaataaattatgaacctggaaaaaaaagattagataaacaatttaaatagaactataacccctagtgaaatagaagtataaagtctcccagctcccctcccccctcaaaaaaaaaagcccagggccagatgcttttagctcagaattctatcagactttcttttttttttttttccaaaagtcccccatatccatccacccccactcccctgcccacccactccccctttttggccctggtgttcccctgtactggggcatataaagtttgcaagtccaatgggcctctctttccagtgatggccgactaggccatcttttgatacatatgcagctagagtcaagagctc

SEQ ID NO: 35637 - DNA, 1438 bp, Mus musculus
tattattgccatttccactctactgaggatattgtgaggtttgtgtttttgaaaaggcctagtatattcaacattaacatctgattgaagatcttaaattattatagggtcctatagaataagtggacccataggaaattgccaatatccaaacatttttttaatctttataaatagcactttccaaggatgaaacttaacagacagggtgagcactcccaaacaagtacgtgaggccaattattcatttggaaagaaagtcaaaatcttggatggggagatggtgatgaattcagtggtgattagatttggaagaagagctttctaggcctcgagagcagcaaatgtcacagccctgtggtgggaaggaatttcacgtatcctaaaagtagagaaaggattttaatcagggataagagattggttagagattggagggcggattagagaccaggtcatgcaaggccaggatataactttatggagcagcaagaagccctaattgacctctccttctcctcagaaccctgactttcatggttatgatagtgaccctgtggtggacgtctggaatatgcgagctgtcttcttctttggtttttccatcgtcctggtctttgggaccaccttcgtggcttatgtgcctgattacaggtataggggttttctaagaaagttgagtgggaaggggcagaggcaaaggtagaggttggaggagtctctggccagaattcttaccctgtactggtgggggatagggtgctaaagttgggaacttctgtctagtaaggttccctcacatcataacccacttgttgcttttaggatgcaagagtgggcccgccgggaagctgagagacttgtgaaataccgagaagtcaatggccttcccatcatggaatccaactacttcgatcccagcaagatccagttaccagaagatgactgatggcttaccgagcagggcctaagaagcattactcatccgctgcttgttatttacctggttcctcagaacaccttattaaaggaattgaaagtatgactggttactgctgcttttgttatggaagaggatatatgagtgtgtgacaagctttcaagggccactgctgcctttcttgtctgttgctgtgtaccactaaggtttggtggcttagtactgtatcccatggccctgtggattgcatagcaaggatatgtggctccccttgaatctcaggtggttgctattaagtagtagctagggctaaagccatcagaagcacatctggtctgtatagtcaaggtttcaaaaaaagatgtctggcacttcagggttcagtacagtaacctgggcttcttcaagcagtggttctcaacctatctaatgctcagacccttcaatatagttccttatgttgtgctgaacccccagccataaagtcattctcattgc

SEQ ID NO: 35638 - DNA, 1223 bp, Mus musculus
ggcaagcatatgctacctccccattccctgtgagaacggcccaggagtccagaaaaaagagtagctattggctacccctaagaggcccgctctttagaagcttgctgtcctttgaagttgaaagacaactagaagctccacctctttccctacagggccatctagatgtcaccgctttcttcttacgaagaaaatgaacagacctctcaaaaacaactctctcccagactaacagaaatgataacgttgattcggtagcgacacggcgtgggaggcaaaatagagtccgcacctcgccgaactcgtaaacaaacttaggccggggatctatttagcaaggtaagggcggagcgacaaaaatcgcgctgggatcaaccgcagctgcgcacattgtatttccgtctccctccccccccccgccccccaggactccgcagtacaagctgtcatggcggcccgactgttaagcttgtatggtcgctgcctgtcagcagcgggggcgatgagagggctcccggctgctcgcgttcgctgggagtcctccagggctgtaatcgccccatccggtgtggagaaaaagcggcaacgagaaccgaccatgcagtggcaggaggacccagaacccgaggacgaaaacgtctacgcgaaggtgagagggaggggggaaaacgggacgctgtaggggccaatctggaccagggaaaccagtgtcaaagcggacattctccggcccgagatttgagcagtggacaaaatcttcgaatattcagaaattttgcctagcttgtttttctctttcgttgccttatttgcagtcagaaatcacactgaaagagggcagcacccaaagcatgttagaaactttataattagggtaatactaaactctaaggtaacacgtgcataatgccaggctgtgctagacactttgtatctatttactcatctcaattctaaagtagcgtgattttgaagtaggcactataactgttactgaagtaggcactgtaactgttacagtgacatagatgaggatactaaaacacaagttgctagcccaagatcacagcttgagtaggtcatggagctgattatttgcattcaggactgaattcctgtgctttatggagagcagagattctggagtcagacatcttgggttgaaaattattcacttgtatgaccttggacaagtaatttaatctcttggtgcctcggtttct

SEQ ID NO: 35639 - DNA, 1117 bp, Mus musculus
gggttgtcttcctgaactgttgcacggaagcacgaggaaatggaaaacaatgtccttgggttataggacagtagggaatcttgacaatgactgtctcctcaaggaggccctctctgctccaactgccttgacccctttcttccttccattctctgtagagtctctgcaggaggtatcacccagacgggcagatcatgctggcagcaacaggggtggctgagaagtgaaaggagccagctactgaggaggggccccagcagcccctaaaactcctatcaggacatggagtatgaaagacggtgagttatcccctccctcccctcccagtgtgagcactggtttaggatgaagggcgctctaggcaggagaaacaacacagcaaagaaatggactcttttcagcacatgtgcatctgtgctctgagaatgcacaggtgaatgacacaatgactgtaggtctcccctgtaagagactgtcttgctatgtatagcattacatggaagagcacatagtttacaggtgataccaaacagcctgatgagtaccatgactggacgtgaaggtggggtttttgttaatatgggtgtggaggccagagagtggtgccaggtgtccacccaattgctcctccatcttagtttttgagactgggtctttcattgaacccagagctcacagatttagctatactggctggccagcaagcctgagggagtctctttttttctacctcttcatcactgggattgaaggcatgtgctacacctggtgtttttatatggacactggataatcaagcttatgccctcatataccacaagaagtttactgattaaggcatcttccaggcctgcttttcttttttttttttttttttgtcttgagacagtttctctttatagtccatactggccaacttgtggttttcctaagacctggggtgacaggtgttccaccacacccagtttatacacaaagtgctttggtttggttttgagatggatcttgttctgttaactaagttggtctcaaaatcttgagctccagttctacttcatcttccttagtagctgagaaaacggggtgtgacatctcatggtatatatagttttgtttt

SEQ ID NO: 35640 - DNA, 1143 bp, Mus musculus
gtcgagtttagtcacttgcaggacgctacacgatggatggaagccaatcaggttgctttgccgcacttgaacccctccccccaaaacaaatactactttataatcgagcgctccccatcgcctgaatcttatggacacagttccctgccctgtgaccctgtgtcccatatccctgcccctttttcccccctcctgacccccactatttcctcttcccatctctcactacccactgggcttcccatttgtggcccagtctcaacactgacccctggcccccttcctactgccaggcactagcgctccctcacctctcctggctgagctttcagagaaagagctgccagggtgggttcccttcttagcttcccagaccccagcaggacccttttgctcccgagtcagcagagccagaacttggttgtgctctcaggaccactggaggtcctgtcactgagggaacatagatgttggcacataaactagcaacacttgttttgccagttttctcctgcatgtgaatttggccctctgagttccatgcagagggacatcactgcttttggttgaaagttccagtcaagtgtgatagttttattgacaccgtgggctcagttcactggcccctcccattcacagcaccctccccacccacaggaggccccacctctaccttctcagtaaggaactgtgctctgtcagctacggaggggccagctcccctagcctggcactgaatcccaactcaactgcgttgggaccttccaagactcaagggtctaacctggctacccagccctatcctgatgtagagtcactggtgtagagcactggaaagaagtgtcaggggaggaaggggcagccgtggtaaagtggagggtcctggcagaggcagccctgtggccggctctgtgggtctggtcaataagctagtgcggtgggcccaggacccggccaaccttgggaaggtggcctcatggcgggaaatctccgtctgttaaattggctttctttttccccttctccagcattagcgctcgtgcgctctttctctttttctctcccctcctctctcttccctgcccatctcccctcattcccagtgtagcctgtgtagtgctagccctgagtatggcctggcac

SEQ ID NO: 35641 - DNA, 1155 bp, Mus musculus
cttaccaatatgatgagacatctggctactactatgacccccagactggtctatactatgatcccaattcccaggtaagcgaaaggtagcctagggaaactggagtgtggttttgtggcagctacccctatacatcctccctcattctttccatcagtattactacaatgctcagagtcagcagtacctatactgggatggggagcggcggacctacatacctgccttggagcagtctgctgatggacataaggacacgggggcatcatcaaaggagggaaaagagaagaaagagaagcataagacaaagacagcccaacaggtgaactgccggccatcatctggttgtttgaagtctatgttctctcacctcttgctctttcctgctataggaaatggggtggtgggtgggcatggacagggataggaactacttcagatagacagtactcctgaattaggtctattttgggggttccagtactcctgaattaggtctattttgggggttctgtagcaagaccacctaccaccatgaagtggcttgtactgtctgcgtgagctcttgacagcttttctctgtcctacaaagggaaccttcatgctggtggtgggtgtgtattgatcccagagaaattgtcgtaagctcacgaggggttgagaaggaaaaaaaaaacattgcagggttttctagtagggaaaagttagcaggaaccttagtctctgtggagaaaaggtatggcattgaagcaagcaataaatattctctccgcaacctgagggattctcaaaatgtttcatgccccaggaaaaccacaagacattaacgtggcatgatatcacatgccttagttaggtttctgttgctgtgataatcgttgaccaaaagcactatgggtatgaaagtatttcatgatgaagggaagccaagggaggtacagatacgaagctacagagcaggaagagctgctgctgcaggggcagtgggtgagaaagtagagacccaagcttcaagaaccttcaacctcaaccctcaaaccccagattgccaaggacatggagcggtgggcacgcagtctcaataagcaaaaagaaaacttcaaaaacagcttccagcctattagtgctctacgagatgatgaaaggcgggaatcg

SEQ ID NO: 35642 - DNA, 1192 bp, Mus musculus
agtatggtggcatatctacagcctctgtgtaagtgcaggaccgggcaccaggcgaggggaggttgctgctggcagaccactaacactatgcactgtcccctgcagggactttgaacaacccactcgggatggattaggcagtgacaacattggcagtcgaatgctccaggccatgggctggaaagaaggcagtggtctgggccgcaagaaacagggcattgtgacacccattgaggtgagtctctataagccattcttgtccccaacactcccagtgcacctctaccagcctgaaaaaccctccttcccttacacaggcccaaacacgagttcgaggttctggcctgggtgccaggggcagttcctatggggtcacctcaacagaatcctataaggagacactgcacaagacaatggtgacccgcttcaatgaggcccagtgaacagctttgaaagcagtttctacagacatggggtatccatcgagggacagagaagatgaactgtggaatggtctaaggaaggctcttctatctaccagcctcctccccaaccagagaagccaaattagacttggagttggtgacttttgctgggaaattgggctcaaatcatgttccttttgtaataaaatctaaaaagcctgcatcttccatttctactttctcatgtcctagtatggtttcttacacaggcacagaatgcataaacagctatgaggctaagctggatagcaatggtggctataaatacctgggatattagctagcaaccccaactgtcaaggttcaggttatggcccatcccttgtcagagatctgaggtttgcttcagagcctggattgggaatctgtggtcccctatccgcacttaaccctcacttgatcttagtctagactaaactctgatttgccatcctgagctggagacggtgctttcaggcttctgtatgtaaaacacagtaggtgcttatcccctggttgtccctataccctcagcatggtgatgatctcaaagggatataggaagcttagcctgttaagttcccaggccaagaatatcttcatgagcatcattcaagttcacccttgctctcttcatccacaaatgtaaacaatagtgcttcgctctctggcctacaacctgtgattcctagttatccttccgccattggcagaggctctgaatggac

SEQ ID NO: 35643 - DNA, 1099 bp, Mus musculus
attcttgctctctgtctctagggaatggcgaagaacggcagtgaagcagacatagacgagagcctttactcccggcagctgtaagtagggcaggagtttgcctaaggtgggaaggggcactgaaagaactggatggggtgggctggaccgtgacctggagtcccctctaatttgacaggtacgttttgggccatgaggcaatgaaaatgctccagacatccagcgtccttgtctcaggcttgcggggcttgggtgtagaaattgctaagaacatcatccttggtggggtcaaggctgtcaccctacatgaccaaggaactacccagtgggctgatctctcctcccaggtatctcttcccaacatcctcaccccccaaccccccatcccccaccgcccgctgagatacctgtttctctgtgccacagccttatcctcctgcccacctgtctcttacagttttaccttcgggaggaggacattggtaaaaatcgagcggaggtatcccagccccgacttgctgaactcaacagctatgtacctgtcactgcctacactgggcctcttgtcgaggacttccttagtagcttccaggtacttggtgattgctcagcttcctgcttgattttcacagaaagaactcatgtgttgtatttttgatactattcactatttaatgtgttgtctttggcatcaagcattatgcgtgagagcagagaagatgcagacaggatgagaccttgggcctatgcagacaggatgagaccttgggcctgcctttggggaaaagatggagacagtgtcctgctatgagtgtctagctcttctagtataactttaggcaggtcacttagatcctggccttataactctttccattttcagaataggaatggcagcagtaccgacttttcatggggttcctatgaggattaagcatggagaatagcagcttggacacaggaaagatggcacaggcacttactagttaaaaagcctaggctgtgagagctgaaagtctgcctcgggggactttcaaggtaccaaggtccccaagggccaaggtactgtagcaacaatcagacagagtagtaggagctc

SEQ ID NO: 35644 - DNA, 2652 bp, Mus musculus
gcccatggagatcaaagtgctgggtgagctggggccatggaagtatcataggggaactggttaggagatttgaaagagaagagtccctgggttcagagtgatgggagctatatcctgagtgcctgaagtcgatcaaagaatctagtaagacccaccagagccagtgaacatggggaagaagggccaactgttcgattgttaataggagcatgggcccctaggatctgagttgtattttgaatggggcatcatgtctcaactgatttggggaaaagcagcctatcagtataggcctgggaccagggacatgagagtctcatgatatctgaactagctctgaagcaggggggagatagtttctgatccccagtgagaactgtagttgaaagggtatctggtgtctacattgagtcaggcatatggtttttttttcctttgtctcttgagttttgtaaactttaaggagggcatataagactgacagcctccctatctactactctaggtccttatacctttagtatctgtgacacttccaacttctctgactacatccgtggaggcatcgtcagtcaggtcaaagtaccgaaaaagattagttttgtgagtattgggggcagtagttcgtggtgggtggttctagaacagtgcttctcagccttcctaatgctgtgagcctttatttaatacagttccttgtattgtggtaaccccaaccataaaattggtttcgttgctactgttatgaaatgtagtctaagtattttgccagaggggtgtgacctatacagttccaaattctctgttcatttcttcccttttgtgctgctttcctgcagaaatccttgccagcatcactggtagagcctgactttgtgatgactgactttgccaagtattctcgccctgcccaactgcacattggcttccaagctctgcaccaattctgtgctctgcacaaccaaccacctcgaccacgaaatgaggtatgtagttgagccagcagtcagtaaggatagaaatacttggtgctaaagggccacccatacctgtgcttgtcaaccgtccatcctttgacagtagcctgattaatccttgcttgtttcctttgccctaccaggaagatgcaacagagctggtgggcctggctcaggctgtaaacgctcggtccccaccttcagtaaaacagaacagcttggatgaagaccttattcggaagctagcttatgttgctgctggggacctggcacccataaatgctttcattgggggccttgctgcccaggaagtcatgaaggtcagtggggtttcatcttgcttctattacttgctatccaaatgtgtgagggcctgagtaataccggccacttgctctttccttgtccttcactaggcctgctctggaaagtttatgcccatcatgcagtggttgtactttgatgctcttgaatgtctcccagaggacaaagaggctctgacagaggagaagtgcctcccagtatgtgaatgggctggagggaaggcaatattgggggtgtttctcggggagcttgtctctgatcctcctcacttcatgttcctcagcgtcagaaccgttacgatgggcaggtagctgtatttgggtcagactttcaggagaagctgagcaagcaaaagtacttcctggtgagtggtctcattggacacctagtgtgttcacctcccttggtctctgcccaccccttctggggttctcttctgcataataaaggaaagagtcttatctctttaacctgttacctcttggtctcatcttcagattataaaaggtcatttcttacagccctgggacttggacatgtatgtggcagtagactttattggtctatcatattgcctccagcaggcatgagaaactgtgggtggctttgtatccgcttgtatcaccctgacttgcctttgtgtctctccttggctgtttcttaggtgggtgcaggggccattggctgtgaattgctcaagaactttgccatgattgggctgggttgtggagagggtggagaggtcgtggtcacagacatggacaccattgagaaatcaaatctgaaccgacagtttctcttccggccctgggatgtcacggtgagatggatgggaataggggaatagatcatctcattttcctgtctttttcctatccacggtatttcaattagagatatacttatctttcctttgacccttttcattcccctgtttctgtcatttattcagcaaacattaaatagtcctaccttgaatcagttattttcttctcttttcttttctttctttttctctttttctttctctctctctccctccctccctcccgctccctctcgccctccctccttccctccttccctcccttcctttcttcctttctctctttcttttttagtactcgggcttgaatctaaagctaactgtatgtagcctccctgcatgctagacaggtagttacaaagactaccactgagctgccctttcatttcctttttctgttgactttttttttaaataaagatttgtttacttatttattttattttttaatgtatatgagtacactgtagctgtactgatggttgtgagccatcgtgtggttgctgggaatttgagttcaggacc

SEQ ID NO: 35645 - DNA, 1175 bp, Mus musculus
tccactatttcataaaatccatttactctgcctgcagtgggcccgggatgaatttgaaggccttttcaagcagccagcagaaaatgttaatcagtacctcacgtgagtaacttccacatcttacccttctgcttgccaccaaagacattcagctgtcatcctcaatgctaggtgcacacttttcaaaggacactaaatgtttagttctcatgctgttgggggatcaagatgaggagctttctgtggagaaagtgggattgccctggagcctagttcagtggccactctctctctctctctctctctctctctctctctctctctctctatatatatatatatatatatatatatatatatatatatatatatacatatacatatatatatacactcttgcctcttggccccctctactccctaacagagactccaaatttgtggagcggacattgcggctggctggtacccagccattggaggtgctggaggctgtgcagcgcagcctggtgttgcagcgaccacagacttggggagactgtgtgacctgggcctgccaccactggcacacccagtactgtaacaacatccggcaactgctgcacaactttcctcctgaccaggtaacatacttgtctggcaacatgggtttccttgcaaccagtttgctgcagactcttaagtagcttctcccagttaactagtccagatgtgaggcaaaagatgtcagaaaattgacctttttgttttgtccttcatttcttgaagcaagagaacttgctgttccttttcactgtgctgtagactgtgtctaacctgtgctgtagactgtgtctaacctgattttttcagggttgtagtgaaccttgaggccaagatcctcgacttgagagcaagggagtcagcatttattcaaatcccagttttctctaaacttgggcaagtcatttctctgtacctttctttagcttgaaggaggaacagttagatatgtttcacagggccttctgtgaggattcattggtatttattaatactaagtacatacctggcgatccagtctagactagcaagtaaagcaagtgttagttttctcagctaggaccttgcagtgtaggtcttagatgactgattccagccctctttgggacccagccaagggtagtgagttgggg

SEQ ID NO: 35646 - DNA, 2956 bp, Mus musculus
tttcaggtttgctctctgttctgctctgcctttccccctttgacccttgattctaggatatctctccaaaatcttatctgactaaccctttgtcgtaccctaaggttttctaccccactgtttgcatctaaagggctgtgtttttctttttgtacagatgacagccgtcttgaggagctcaaagccacattgcccagcccagacaagttacccggatttaagatgtaccccattgattttgagaaggtgcttggcaggggccctggatgggacagttggggtgagctaagcacagacggggttgtaaggaatggggatctaggactatggagccagtctaagcctttacagtgatcagatcatggactgccacatagctttccttctgatctgggacagaccagcaggtaattagcattggaggatagttatatcccaagagtccagaaaattttctcatctgatctactactcttattcaggatgatgacagcaatttccacatggatttcattgtggctgcatccaatcttcgggccgaaaactatgatatttcccctgcagaccgacacaaggtcaggagacttgaagcctgatgttctatccactctcgggcttgagtttcttatatcccatcctgttctgtagaccttcagtctcttataaatgataacattttccttggtctatttctcagagcaagctgattgcagggaagatcatcccagccattgccacaaccacagctgctgtggttggccttgtgtgtctggagctctacaaggtagttcaagggcaccaacagctcgattcctacaaaaatggtttcctgaacttggccctgcccttctttgggttttctgaacctcttgctgcacctcgtcaccaggtaggtgcccacatgcaagatagacctataataaagtgtatctcaatagaacttgctttggtttgcattagacctggtcactaggtcagagttccaatcaaaatatgcctgcatctttttttgcaagagtactaaggaaataaaagacagtagatcagagtgattgagaagatagtgggtagaagatgagaatggggttttccttgtggcatacgacctgtcattgtaaaggttcagtgtttactcagtgacatgggagccatgagaaggctttgaacaaaaaaggttatgatctaacttaactgggtctgaatgcatcagggcagggaaggcagggagggcagggacttctggaatggaccacatcctattctctttcttattgcagtactataatcaagagtggacattgtgggatcgctttgaagtacaagggctgcagcctaatggtgaggagatgaccctcaagcagttccttgattactttaaggtaaggcctgtctccctctccccttacctggaggacaagatggataaattactttttggccctcctgccatctaacactgctgattccctctcctgccttccagacagagcacaaattggagatcaccatgctgtcccagggcgtgtccatgctctattctttcttcatgccagctgctaagctcaaggaacgattggatcagccgtgagtaggctattgccaggcaggctgggaagggccctgtgttgggtggggagcctcagcttttgaagctttcactcctacccatcacctcccccgccctcacctacctccccttcctcttgctttgcctccttggccctcttcccttaccctcacccctttccctaggatgacagagattgtgagccgagtgtcaaagagaaagctgggccgccatgtgcgggcactggtgcttgagctgtgctgcaacgatgaaagcggcgaggacgtcgaggtcccttatgtccgatataccattcgctgatctccgtgcattcccctaagccccagtcctccctcctcagatcctttccaatcctggtttccatttggcctcaggcagtggtccatgtagccaagcctggccttccctattacccagcaacctcaagaccctctcaccgctgctttgtaccttgtttggaacctaaatcccaataaaaggataattacccagatgtagccatcctggctgtctccaaggaaggaagaagtatgtctagagttctctggttcaaataagtaccccaatgggctactccagctataagctttctgggcagagaaaactgggaattgatatcttttatatactctgcataacagacatgaggtaccagtgaagttatgcagaccagtacctgggtcaatatgatttaagtgacttgaactgggttcaaactctgtcttctccatgatcactactagctgcctccatccactatgaagaatacacttaacagtgatcaggtgggggctggagagacggctcagctcttaagagcactgactgctcttccaggggtcctgagttcaattcccagcaaccacatggtggctcacaaccatctgtaatggtgggtctgaagggagtgacagtatacacacatacaatcagtcaatcaatcaataaaaacagtgatcaggctgcaagtgctaagttcgcatgttttgggcattctcccttgggcagatcccttccccagtttgaagcagccagactctgggccatccttttggtcttttgagacagtctctatttagccctggctggcctggtactcactctctataccaggctggcctcaaattcacagagatctgcctgcctctgctttcaaagtgctgggactgaaggcgtgcgccaccactgccaggccaagctgacctttacagtcatagttccccacagcaccaggattgcctgtacagttatttcaagttcatgctgaggagccctgaacaacccagtctaaggaacatcaatgtcatgaggcatactgaaggtttttcttttctttttctttttttcttttttttttttttttggttt

SEQ ID NO: 35647 - DNA, 2105 bp, Mus musculus
tcttccttacttataggcagtgtgacagaagaaagtcaagcttctcaaaagaagaagcaacttgtgccatgtggggttgtacccacaggtcatcccccacttatatacctctttatttatagctacttccatatttgcactaaaggaggtacagctacaaaaggaggccaacattcggtccacttctatgcctgactcaggtaagtgtggccctcttctcttgctctatccaccttcctgcttgcccactcacagccattcactctgctttcccctgcaggcaggccagctttccgtgtggtggataccgagttctaagccaagttttaagccacagacagaccaaggccccagcaggcagcggctggagggatgccacaccccttacagggcagcccccatctgcaatcctccctgcttgttgcctgcttacctgcctgagccacactcccctgccaacttgtcccctgccacctgcccaaacaccaaaccactggcctggcctgtcaacccaaccattggcctgtctgctgggtgctaacaaagctctcaccactactttgcttgatgtgtctgtctctgtcttggtagttgctggtgaacagaatggccatgccaggtttccacactaaggctaggccttcccctctaaatcacactctctcccaggaccactaccccatggccagccagggatttggagctagcccaggccaggctcttaattgactttgactagaaggtagtgagtgatgccttgggtctgagcatcctctgcctgcttgccacctgtcccacttgcctctgttgtatgggccttcttttttgttagtttcttttattgtttttttattattttaaatgaggttctcactttttaatgcaatatctctgtatacagactggttgggcgctactccctgagtatggccctcctacagtattttgtgcaatgaagtcccactcccagcctttgagaggtagggacccagaccctattcagatcctgaccatcactataccctgggattggctatgggaaagcatgcctcagccactcaccttcctcccctacctagtgtccccagctatagggggacctgagaactaccagagactgggagatggacatggtgggggctactttttccctcctttagtcccgtagccagggcctctttccttctcagggtcttccccagcccagctctgcctagccctcctgtcctgtcctactcggtgctgttgagtaggggctctgccaggaattgaccagcttagtgaggagccatatataatatgtgcacaagcagggggacatgtgcgagcttgtgcccaattgtaacactccagtccctaggagggtaaggcaggccaaggacagtctcctggatgtatggtttgctccccttcctccaccttaagccttgggacccttaagcggggtgggagggcaagggagggtgccctcctagtggggtttggggggattgggttcctgaatgcaccataattgctgtatgaaatattaaaaaaaagtctaaagttcaaagtctggttataaatcatcaaaaaggcaagggggctcaagttatggtgattactgggaccttcatgactccatacctggtcccatcaactaagaacattgggaaagagttggctagaagtgtggtgggactgtgggagaataaagtctttggagggattgcacttggaatggtaggatgagttgaagcagtagggtagacttaattgtgtcaacgggaatcaagcacggagtatagataagttagatccatctcgaattatagacaagcctgaaaggatggagacaggaaatatttggaaggaccagtggtagatctagagtggtatgaggcagaaaggtccagtctgacactatgaagaggtcagttggagagagaatgaaaataaagtagggttttgaccacttaaaggaatctagtagacttagaaaagttcaagagtgaggtcatagagccagaagtttggattatagacaagcctgaaaggatggagacaggaaatatttggaaggaccagtggtagatctagagtggtatgaggcagaaaggtccagt

SEQ ID NO: 35648 - DNA, 1097 bp, Mus musculus
ttggtacatccaaaggatagttcaaactgaacatggcagtagactttgcagggctttttttttttttagacctctggcttctccagtacttctctttggtcctgggaatacagaggtgtacaagaaaaactagagacaacttcattttgtatgtaattgtctctacagagagacttgtatatagttttatccttacacctaaaatccagagttcttaccatggaaggcaagcaaagctaaattatctggattaatctctccttcattctaattcaaaaggcttctctgacattaatttgtagctgattgtatatctgcttacctgtggctttagagcgcaggccactgatggtgttcttaaccttttcatgcatcactgcttcaccactttccaggttcatgattaagaactgccaggtgtgttggcgcatgcctagaaacccagctacttggtcagctgtggcaggaaaagccacatatgaccagcttgagtaacttaccaaaactgtctgaagaatttttttgtttcagaaaagtgttgggagtgtagctcggagatgaagcattcacataacattttgagagagagagagacagagactgactctttcatgtgtgtttaccactaacttctccaccatacccaaataaaactttgggatggccctctatccttgtggccctcccttgggagtcttctctgctctgttacagacgatatgtgaccaaacccacctcagatgaggatgatggggatgagaaaggtgagtcgccaaggaggtgagaaggaagcgagacccaataaagatgagtgtgtcttactcagcagggctgaagggccgaggagcagcgggtttggatttggatatatgacacacacagggttcttctgtgttgaagcgcagttccctggagtacccacattttgatccttgacattatctccatcctagttgatgaagatgaggatgaggatgtggaagatgacagcagcagtgaggaggaaaaggaggaaatgtctgcgcccactgttaatgatgggacccgagaagcagagcaggagcaggctgggaccagctctggggtcactgagagat

SEQ ID NO: 35649 - DNA, 1207 bp, Mus musculus
aagttctcattatccacctgaagcgtttttcattttccaaaatttcccgggagaagctggacaccctggtgcagtttcctatccggtcaggagctttgcagagaaaggctgtgggacctgggagggtacaggtggagcccaccagtatttactgtcttctcacccacagggacctggatttctctgagtttgtcatcaaaccaaagaatgagtcttctccagacctctacaaatatgatctcatcgcagtttccaaccattatggtggcatgcgtgatggacactgtatgtaccaggctatgggctggggcatgccctggttggctggatatagactaggggtcaggatgtacccagtacatgactaggtttatgtgtcagagaaaggcaggggtagcataaagtagatttggatactctagagagccaagaaggtggtaagaatggtttctgtttatttcagatacaacatttgcctgcaacaaggacagtggccagtggcactactttgatgacaatagtgtctcacctgtgaatgagaatcagattgaggtatagcttctgtacttcttcttgccctcttttctattatccccccccctgacatccaaactgaccaatgtcctctctttgcagtccaaggcagcctatgtcttgttctatcagcgccaagatgtgggtcgacgccagtcccagacttcttcatctgacactcctgcctctcctgtctccagttctacacccaactctgacatcatggatatcaactaaggagccctagaacctaccatggagaaggaagccccctttgccactctctcctgtctaccccctctctttcctgtgtttatcgcccccctctgcccccccagacattgcaggcttagtctgtggctactgttctcttgtaccgctgtattactctctcagaaagaagaggccctatgcccctggcagtgtgcccctgcctgtgtgtgcccgtacagcagtgacttcctctcctagtcttatttatgctccccctccctcttttcctcatgccaaagtgttcttagtggctgatactggggtttacatgaacacagagtgtattttcttattgagaccataccttcttctctgtgttaagtatccataaaaagctccagattcccatgttcaacagtgtggctttgtttcttcatatgtacttactatgtaccagtca

SEQ ID NO: 35650 - DNA, 1174 bp, Mus musculus
tacatggtgttgtctgctgaggtttcccttctgtgcctctgtgggggggggggggtagggggtgggagtggggggagcagtgcgaaagcagattccttccctggtccagtgccctcacccacatagagtcaagtgatcaaatagaaaggactagcttaggaaatccctggaagtggttggtgcttgtttagttggggaggaggtgttacacatgcacatgtgtgtgatatgcactctcagtatggcccagattgtctcgaggaactcatcctactgagtagctgggactacaggtagtgcaaccatgcttgccacagtgccagtttagtgtcttttttttttcacaacgatgtattgggcaccaaattgtgcctagcccatatcatctgggtctctttaagttccatctatcacgccaaaagccttgatgcataggtgctctgaagctccctagtaggaatcacagacttggagtggaaatctgcctcgtttgtctgatacatttgtatggtgtgtgtgtgtgtgtgtgtgtgtgtgtgtgtagtttctaggaacctgtaaactggagtctaaatgtctggcttctagtgccaggtgtgaatagacttggccaatttattagactgagaaattcttagcttttttttttttcttttgagacaaggtttctctgtgtagctctggctgtcctggaactcactctgtagaccaggctggcctcaaactcataaatccgcctgcctctgcctcccaaaggctgggattaaaggcatgcaccaccactgccccgcaattcttagctttttttttttttttcagcagagaaatattaataggagatcaggaggcctaggatttttagatttgagaaggggctaaaagatgagcgttgttggtcaaaagatggaatgcctgggtagaagtagaaaggaaacagatgtgtctctctgacagctgaggtttaatggggaaccctaatgttttcctcaaatcctgcccctataacaaccaagttgcagcttgtatctcttcttttgtaaacaaagggaggatcatacttcatttgaatatcagttcatctacactcaaccaatttcaaaatatgggaaagtacttccacatctacaaaaggtttttgttttttgttttttgtttttgttttttagtttgaatt

SEQ ID NO: 35651 - DNA, 1217 bp, Mus musculus
tcctcctacattccacctacgtggctggggctattgggttccagttccagctgctgagcttaggacagatggtgtctgcaattcctttcagccatggaggcggagatagacgtggtttctaaaaataactagtggttctggaggagtcctattttgttaaaagcatgcaagtagtttttgttgcagcttttatccctctaagattcctatcctcgttttaaaatatacttaaaagatgtagagatatagaaatgcttagaaaaacatattgaaaagacacagatgtataagtgcttggtgaatgcacgttgagaaacatttcacaatagtaaattgaacaaattacaattgagtttattacagcttgtttttatttttgttttgttttgtcttgttttgagataaggtaggtcccaggctggcttagaactcatgactctcctgccttagctttccaagtgctgggataaaaggcatgaaccaccaacccaggctcagaaatgtgtgtgtgtgtgtgtgtgttacagtagtagaaagctgtctcatagatggaccagtggggacccatccagttggcctctctctattccttatccacagatgtagggcatcgctggaatgaggacccatgagctcctattagccaaggcaaattctcaaatttatggccaactcccatatagaaagacagaagtttagagcactatttccaggttttgtgccttgcattgaagaagaggaaggactagtttttatggctagccttaggaaagccaagtaagagaaggggcaggggacaaggtcagaaaggtcttgcttcaactcaaagtacagaatacatcaattctctatataatttgtggcagtgtgttctgagcctgtatcactaaggagtttctttctttcttttttttttattaggtattttcctcgtttacattttcaatgctatcccaaaggtcccccatacccacccccccaatcccctgcccacccactccccctttttggccctggcgttcccctgtactggggcatataaagtttgcaagtccaatgggcctctctttgcagtgatggccgactaggccatcttctgatacatatgcagctaaagacaagagctctgaggtactggttagttcatattgttgttccacctatagggttgcaattccctttagctccttgggtaatttctctagctcctccattag

SEQ ID NO: 35652 - DNA, 1121 bp, Mus musculus
acctctattagctacctgacagtacctttgattctaccattagccttatagcttatgctctggaatacccacagtgccttttaaggtcattggtactgtcttcatttccttcaatctaaaaacaaggtctgatgatcctccattttcctgtcccctgtctgtgtctgattacccattctctgaagctaagacagcctgtttatttccattgtgtgcctgagacctgtgatttttcagtgcagtacataatggcttccccattaatctctagagagtcatgtgttctgcactgtccagaaccgtgtgcactgtctcctcactgcagtgagtctcagatcttggtactcaactatgacataagcaataggagattctcagcagagaagggttagtatcattgggctggttcataaaaagtgggatttagggaacagtgggaacttggagatggaattttatatgtcctctgccactctgctttcaggctgtcattactagacctctgaatttctcctctgtcctctgctaggaggcctatggcagctgcccagtcctacctcagcccatcttgaaaacaatcttaggcaacatggaaccaccacgaggccctcctgttagtggggctgagccatctcgggcagttggcactgtcaaagtgtacctgcctaacaagcaacgcacagtggtgagtcactcaggcagtactggcaggggttccagatagtcgtagtgtgggatcagaagggtggcgagggttagggaatgaatgctgcagagggaaggaataattggctagggtacctattggatactgaagaccccaatctctacacacacacacacacaggtgactgtccgggaaggcatgagtgtctatgactctttggacaaggccctgaaggtgcggggtctcaaccaggactgctgtgtggtctacaggctcatcaaagggtaagtatggaaaccccatgccattcactgggtccctacacacctcctttcttcagtgccatcttattcctcctcatttgtcttggagtcttccactatctgaggtaacccaggtgacatctttcgtttcccttcattgaccattggaaggtctgcaattcactatgcac

SEQ ID NO: 35653 - DNA, 1201 bp, Mus musculus
cagggtcccaggtagggatgtcgtagatgaaaggccagggggccagtgaaagaaggattggaggaccctgagagattatactttcgtttatttgtttacgtgataaatactattgagtacctacaagtgttgaatatgggcatgggattgtgggatcattggtaaggcacccagtcactccaggtttcatttttttcatctgggaagaggggatgagattttccctagtgggttctgaagaggattaagggttgagatatttgcaatgcttaaagcaagatctgatacagagtaaataacaagtgttattcattacaagtgtatatataaaatcatctagtttgttcatttcttccagtataaccacaccccagtcttttctctttgaaataaatgttactgtatcagaaagtacttttatttcacttatgttggatatgatagcatatagttttgcataatatataaaaagtaaggttaatgtattattatttgtagttatgagtgtatgtgtgttgatttacctgtgaatttaatctcaggatggtgaaagtaacagaagaatgtttttctgtaaggtataattcatgggaggtggaggcaagacgatcaatagttcaaggctaccctccactaagtagcaagttcaaggccagcctgggctacatgagactgtcttaaaacagtaaaaaaggtgttttgtaacgtgatatatgtataatcgttatatgatgtgtgtaatgtgtattacataatataatatgtgtattgaaaacgttgccattttaatataggtaatgctcattattataaaataaataatatatttgaaaaatacatgtcattatgatatgtaataaaaagtcatatcttaccctttctccaactatctttgtccttcattgttccttctttagacctttctcccaatattaccctctctgagaacccactcctgactcccccagggacactttctacctccttcatttgattttcctctttttgtgcctatcactgacaggcacattatatatttgcttttttattcttctgcctctgctaaaaactctacaagggcaagagctttttatttatggtatccacagtttgatctcctctgtttcgagttgcatctggcacacaggaggcactcagtaaatgtttcttgggcagatgattactggtctgaccaacagac

SEQ ID NO: 35654 - DNA, 1122 bp, Mus musculus
acataactcactagaacaggggttctgagaaccatccagtaagggtatgaggcatagctattgggattccttgtaatggcccttgaccctgctggatatcttcttacatgaggggctcacagtcaagattggtgacttcggcctggccacagtgaagacacggtggagtggggcacagcccttagagcagccctcagggtctgtgctatggatggtaagttgggccaggctagatggggagcaatgggagatgtggacttttggattgggacatgccaggcaaagtggggatgtctttgccaggtgggaatatctagactgcccatgttttacctcacatgggtggcactgagtcattctcagtgtaactatcaggatctgatactgtggactagtcattttttgtccctcatggtccccctgccctgtctggcctacctaaggcagctgaggtgatccgtatgcaggacccgaacccctacagcttccagtcggatgtctatgcctatggtgttgtgctctatgagctcatgaccggctcactgccctacagccacattggcagccgtgaccaggtgagcctcataacttacccgcagttctcagggcttcacactctaggtcccctcacttgtacagacagtagtctccccgccctaagcctaggatttttctgaatgaagagtcctggaatctgtcttttagatatcttatatcccatcctcctcacacatccacaaacccctgagccagaacccttaaaatccagatttctttgactccctatattcagaatgttcctagaccccaaacccttcagaagccccctgaacattctgagtgtccaacactcaggccctttgtgcttctcaaatacccatagtcaccctgaatttggggtcttggaattcataacactctaggtcttaaattctcacacaattctccgaatttaagatctagaaccttccctgttcttagataccaggtccagatatcaagtatttgagctttgagtactacataagtaagtctacatagacttatttatgccccagactcctacagaaatggaagtttcccccaagaagtagtgctctgcattttcccgaatcttagtat

SEQ ID NO: 35655 - DNA, 1549 bp, Mus musculus
ttaatataaatccctctcttttatcagcagaaaatcctccctagtcctcagggacacagactcctctgggccttagtactagacacctctagtcctcaaaaattaacctaacatatattttaagattcatagatccctgggcctcccagctcaaaccccaaatcaacccattcctccccacacaccagatcatctttatggtgggccgtggctatctgtctccggacctcagcaaaatcttcagtaattgccccaaagccatgaggcgcctgctgactgactgcctcaagttccagcgggaggagcggcccctatttccccaggtgggctgggtaggagggctggataccttggggagatgcactgtgagtaaagagatagaggcagatattgaatgtgaaccatgttgaaagctggggattggggatattggagtatctctgggactctggacacccctcttcatctccacccgctcccagattctggccacgatcgagctactgcagcggtcactccccaagattgagcggagtgcctccgaaccctccttgcaccgcacccaggctgatgagttgcctgcttgccttctcagcgcagcccgtcttgtgccttagacctcactcccagcccaccagggagccaatttcagcataccatgccaaggcacaccgacctaccagccaataactgttctgcctctgccttgatactgcctcaggattccctatcccataccctgggaaatttgagggaccccaaaaactgaggtctcctgctttctccataatttggtctcctcttgggtttggggatagttctaatttggagagctgttttatctccaatggctgtgactcagtgcaaggattccactcagaacctctttctaaagtttttgcctgatgtgtcttcactggattttggggttcccagcaccccatgtagatttgggggtttctttttgtctcccccactattcaaggactctcctctttaccaagaagcacagaattctgctgggcctttgcttgtttattttgcttcccgactcttctcttgggggttcagagccgctgaggggtggggcaagtccaggcaaggagtggaggttggaggaagatgcagaccacaaaaacagtgccactgtacgcattaccacaggcggcatgaatgaggaccacatatgccaagcatggcacaaaaggaggccaagtcagtcacagataaacacattggcaaaggtaggggagtgggagaccacaggccttccttgtgcaaaggattctgaggatgggtggagtttgcatatttaaagacagctgtcagaggcaggaaattggggaggggtttctggaggagggaacttaggggtcctagaagtggaaggaacttccagtatattgaatgggatggagaggaagaggtgaagggaagtccttgagggactgcttggtggatggtaggtggcatttgaagatgtggatctccagagagatgacctatggaagaggtttaaggataggggcttcttatggaattggaaatt

SEQ ID NO: 35656 - DNA, 1165 bp, Mus musculus
atatctaagtcctctcagctgaccccacattcgcctcagtctcagcttcatcacccttgagaatccatcagggttcaggggcatgcttgggggtgggaaggtcacaggcacagcctcaggatcagaggggcagggctggggctgggcctagggtaacattgtgtttctctcccttcctccccttcctcttcccccttcctcccatgcctccaccttgtctctctctagcaaatcccagtctctgaccaatgccttcaaccttccagagccagcccctcccaggcccagccttagccaggacgaggtgaaagctgagaccatccgcagcctgaggaagtctttcgccagcctcttctccgactgacatcccactctgagaacccctaaacccctagacagccctctctgggtcctgagtccatttctcacttttggaacctccaaatcccttgagaacccctctcctggttctcctagagcccacttctcattcctcagtatgtcccttgagaaacctggtcctaaatccagttctcacatttgggaatccccaagtccatttagaatcctgttcctggtcacctccagatctgtttgagaacctccaaactcctgaagacctctacttctggtacatctaaagggtgatttcttccctgaaagttcctgaatggcagaaaacctgtttctgacctaatacatcgaatcctctcctggagctctgaaattcctgaaaaaccctattctactcttggtcctgaatctctccaacacaccttgctcctaatcagaaatttccaattccataagaagcccctatccttaaacctcttccataggtcatctctctggagatccacatcttcaaatgccacctaccatccaccaagcagtccctcaaggacttcccttcacctcttcctctccatcccattcaatatactggaagttccttccacttctaggacccctaagttccctcctccagaaacccctccccaatttcctgcctctgacagctgtctttaaatatgcaaactccacccatcctcagaatcctttgcacaaggaaggcctgtggtctcccactcccctacctttgccaatgtgtttatctgtgactgacttggcctccttttgtgccatgcttggcatatgtggtcct

SEQ ID NO: 35657 - DNA, 1159 bp, Mus musculus
attcaggacctctggaagagcagtcagtgctcttaaccactgagccatctctccagccctccctgctgccttttcttatgcttgctcttcctgcatgccaactgttccccatactatcacttctctgccctgtgggacggttcttcaggaggcctgtctgagtgacttcaagtgacagttctctaacagcaattccagaacactggctttctgttcctcaaatgggagaagctgttcttgggtttaagcacaagtagggcaacacaaacccttcctagcagctccctggtgtgtgtgtgtggggggggggagggcgggagagagagagagagactgagactctatacaagggagagaacaaacagagggaaagagaaatcctcagagatgggcctttttcccctcttctaggtgtttccctgtttatctatcccttgcaaactggagagtgacactcactgtttgtggacggatcaggtcctcgtgggctctgaggactaccagagccgtcactttgcttgcctgccacggaatccaggcttgtgcacctggagatcccttggggcccgatgacctgaagccttcccccaggaaaaactgaagcctgaacactgtctacttttcctccatctttctttctcttagatggtgaaataaagaactatcagacagcagcaatatttctgtatagtgtttgggaacaagcttaagatactgataacctgctgggagcttccagaaaccaatgaacaaggaaaagatgcaaaatgttgagtttggaggctagaaatgaagcttagtggtagagcacatgcctggtatgtagaaaaccctaggttcaatctctagcggaaaaataaagcgggggtggggtggggtgggagtggggaataaaggccagcctagtctacagagcaagtttgtgaagttcaggacagccaggactacacagagaacccctgtattggaaaacaaaacaaaacaaaacaaaacaaaacaaaacaaaacaaaaaaggtgttgagtttttatactttacagaaattttgatatattggtaataatctcaacattgggattagcactgagaacctgcaaaacagaaatgatcattactttgcattatcaactaaaattcatttaatattccctctactcaaa

SEQ ID NO: 35658 - DNA, 1831 bp, Mus musculus
gtggcagcgcacaggtgcacatcccttccatcagtgtggatggcctctcgacccccgtggtgctctccccagggccccagaagccatgactaccaccaccaccccttttttggagtccatccatctatgctcctgaactctccagttagccatctcaaggagaaacatagttaaactgacagacttaagctctgattgtggtggggtggatattcctggaaaagtgaatatttcactaactcctccacccaaaacagacaacttctttcttctttgccagcctcccagtggctgcccttacacgtctcctacttcaatggtggggcggtttatttatttattttttgaaggccactgggaagaatctggcccaacctttttaggggagtgggtaagacatctcacccatttcctccccattttttcctaaaacaagacaatcagggcatggcttgagaggaacctttatttatttatttctcagcctgcccttggggagttgagggtgccctgtcttcattttgcgacatgggttgaagaactagcttgttttgttttattattcctggctgtatctgagtccagggagcccttgtacgatttaatggtttgggagtggtagccagggaatcaacactgttaaaataggaattgctacctccctaaccttcttctcagtcagcttgttcttttctcaagtaaccttttggccagggaggactattccttttgttgttcttcccccctgagaagccattcctttgtctgccaaatttcctggggccctgcctattacctcccaatggagggtttttttgggtggtggtccccgtctggggggcccctccagctagtactccaggtctctgtctcccacccccttccattttgatagtataatctatttttaaatggggcttttcaataggggagagggaaacatctcttcctatatcagatgggtgggtaggcgggtgggtgggaagtaagggatttggaggcggtcttcctgccacccccaagtgtttattttttataccaaacatgtatttttggctccctcccagccccccaatttcctgcaggcgggtacaaaggacccttttaagtgtccctggagttgggagggaggaatgggggacatggagcctgtcttatatcaatctaggctggaggaggtggatcaaaagactcccaggctcacctcctgtcagcactggcccagaccaggcctgaagacctgggggttggtgatttgggggacggtgctatactcgtctccactacttgttttgcttccccaaaatggacctttttttctaagagtcccagagaatggggaattgttcctgtaaatatatatttttaaaggtgttgctgaaagctgttggtatttttttttctcctgtgtcaccaaaataagccatgacagccacgaatatgaagaacaataagggcgaggcaaagattgactgtgagagaggcaaaatgatggcatatgtcagagactgatacagactgctgattggtaaccagtgtgatgagagaaaccgaaagattttaaatatgtgtgtcgcaggtcagaagtgtgaccgcaaacatttttgtacatgtgtatgcatggtcttatgtgtggtgtgttgtctactggaacactgtcccctcctttgagacagggtctcatctttgcctaaacttaccagttgggatacacttgctggccatcaagtctcaaggatctacctggttctaccttgggattacaagcatgtacttctatgcctggaatttttacctgtattgtagggatcaaacggtcaccttttaccac

SEQ ID NO: 35659 - DNA, 1107 bp, Mus musculus
accagccatcttctaattttttctctatctaccatcttagtacctgttaaattgtactgtgaaatgcctttctttctcacgctcattgtcttttacagtcagataataagtatcacttacagttttttacagggctgagacttgaagccaaggtctcctgtgtagtaagcaagagctctattactgaactctatgtccctagcccaagttacaggcagtgtaaaggaaaaagcttatactgtgggtaactaaaatagtgtaaagcacagtttcttttgaatgaattatgctagaaacaaatgaagggatggtcaaaacttatctatgtgggtagtggtgagtagagaaaatgtgggctccaagttttgtttttgtgtagggaagaactactttgggtgagaagcttgaaatatagatagtgctgtagttaaagagatggctcagcagtgaagagcatttattactctttcaggagtcccaggttctatttccagagcctgcatagcagttcgcaagcttctataattccagtgccagggtatctgactccctctcctggcctctgaacaccaagcacacaagtgctatacagacatacatgcaggcaaatcatccatacacataatacgtaggtactggaggccacacagaaggcctcaaactcccactctcagacaagtgacatttgagtcagtttattgggtgaatcaagccatgagctatctggggaagaatattcttgacaaaagggacagtgtgtctggcaggcttgaaaaactgtcacatgtgacatagcttaggaaaaatgagtatgagggaacgtactcccttagataaataaccactcacaagtatgagcacctgcaatgatcattcctggattcgttcctagagttgtcgcctgtacggttccagtagttcttctcttaagctttccagagattttagtattagtagacctgaaacctgctaagatttctaaattttgctgatcaaactataatttgatcaaggtcattgtaatgctgaactatggacatttagaacaagtcccactttttttttctttttttttggttttttgagacaggatttctctgtatagcc

SEQ ID NO: 35660 - DNA, 1220 bp, Mus musculus
ttgcctctcaccttctggttatctctggtgttagctggccttgctgtcactgactgcagcttgtccctcctgcaaggctgtgtgtccgtactcctgggaggccagttctctccaggaggaatttgagcatggagagctgtggcacagggtcagctctggggtgcagacagaaaccagaaggatcctgtctctggctgttccttggttcctgtgtcctgatggcagacgctgggtgacagcagtttctggttcactgccagcgggcctcatggtgccttggtggtgtctgtggtggctgtagatgcacagctcggccagaggacttgtggcccctggggccggtgtgtctgggcagaaccgtgtatgtgggccagcctcaggcatgcgtgtctacgctactgtagggcgggacttcctaccagtagcggagtcgtggcccagagtacacggtgggcaggaaaagtaagggcccaatgtagcctgtggcactggcagagcatgagtgggctgagggagctcagcgagaaggggaggagggcagcagaatccaggcctggcctggaattctcagccaccagaaataaactgtctctgggaccatgcaggtggtcactctgaccagtgggaacggggacttgccagatctgggctagcgagcgtggttgtggctgagatgggatgcaaacctgtagagtttttggatccaagtcacaccaatgttgtgatcataaaatgataaagagggccgggcgtggtggcgaacacctttaatcccagctctcgggaggcagaggcaggcagatttctgagttcgaggccagcctggtctacaaagtgagttccaggacagcaagggctatacagaaaaaccacacacacacacacacacacacacacacacacacacacacacacacacacaaagataaagaggtattaatgtatgttctaaggtggtatgatgaggcgtgggggaaggggatgcctctgcgggcccatgccaaggcatcccttccccctgagggaccagccacaggacggtatagcatagaatagagtttatttagggcatggggaggggagttaagagagtagtagagacagagaaagaggcaagagagaaggagagtgtagagaagtagaggccggccatgaccatgtggagagagggggggagggaatagggagagaggcaggagcaagggggcaagaggtaagaa

SEQ ID NO: 35661 - DNA, 1183 bp, Mus musculus
catagccccagtcaaacaatatttaatgtataaatatttactgaagttgggtcctctgtaaaaagctttcttaatggctgagccatctttcaagcctcttttttatggtttaattttgggtgaacaagtaagcaataggctcaggtttgagggggcaatgttttaatgctgtaggtcaaacaaggggctttgcagatgtgaagtgctcccacattctgctgtgtcttccctttatttttgaactccataagagatagatagatagatagatagatagatagatagatagatccatccatttccagggagaaaaaaaatgtagggcccactagcttgttcctggtgcagtctacattaaagattctcaagggaaccagaaatagctatttgatctttttaccaatagaaaatcatctccatttaaggttaatctgcagtcaggtgagagctcaggttgtgccttatcctgtgaatcttggaacaccttcctgtgcaccagatggcaatttgttccagctgcatgtggtaaactgaagtgacagagacatagactgaaaaggatgggataaggatgaactgtaggatgcaaatgggctaaagttagagggaaagagagaaggctaatgaagcaccaagtatgggtcaatggagtagtaaagggcagagttggggagcgaatagggggaaggaggagaaatatgaaatctccagtggagtacagtacttgagactagatgaacataagcaaacatggatttgagggtgaatgggcaaagaaaattgtattggaagtgagggatggtgaggtatagccaatgttcctgctcgatgaagttgagtagagaaccatgcaggtgaatgaaaagaggaaaagggatgggtcaacaaagtaggcagactgctagagtgaaagaatgatgagtattcataggtaacaaggagctatggtatcaagagttacaatcacaagaccttgggtaatgctaggcaattggtgagagccaagtagagaaccccaccatgaacataggtatatgagatggaaacaacctggactctggactcagtgttcaattaaggtcagctctgttctccatgtccttgtgggttatacttagcatgcctcaagatatcatatatttttttaaaaaagtagctcaggccaatgtatcagctcctctgc

SEQ ID NO: 35662 - DNA, 1189 bp, Mus musculus
acatcaaagaactcacactggagagaagccctataagtgtatagaatgtgggaaagcctttacccagaaatccaaccttattgtacatcagaggacgcatacagtaaagaaagcccattgaaaagaccacactcacaagtcaaagcctactacgctatattgtcttttatatattccaaaggaaatatctattcatttaatatttaaaaagtatgacctgaattctagcctaatcattgggataaacagcatttcctttcatctttttcaccctaatgcaagttgaaaacgtagtgtatgtgtaatttctttgaagagatgaagagaccagataaggcaccagtgcaggagatttaagggcttccgaagtgaggcagcatagctaaggactctggagagggttcggtagcacactaaggttcatgaccacagatagctgtgacaaagaccatatgaggtctggggagaaacaagcagaaaaaccttgcatttacagaaagtaatctgacagatttgaggaacagctagagatggggaagatagggatatagttggtcttgtttaatgatttggacaaagtaaagtctgaaagaactaatatgtgtatcagttgtttaaaaaactgtgatcctggcacattctccacaaaaacttttggcaaacagcaagtccaggaatgatttttctcattcaaagaaaagcatttaaaggtaatgaaaaccacaaataaatttcaacttctgggaatacatatactcatatatgtgtaaaaataatcaaaatgcagaggtatttgttgatgcattgtttgaaaacaaaagattagaagctgttgaaattgcatcatgtggattctgcttcctgaaactgatatattcttacagtagactcctcagagacaaaaatgaacagaaagaacgtggatatgatttttctagtgatttgagataatctccaagttacataattagctacaaaaagcaacgcacaataaagtgagtactatgtgctactatttgtatataaaagggaggaaattgtaagtacagaatgaattgtatgtataaactgttcctggaaaggaatataaaaatgtaattacaattactaccttacaaaaggaaagaggtcagtaggttactagggagatgaaacttggagacacattttgtattctttcatagctttg

SEQ ID NO: 35663 - DNA, 1216 bp, Mus musculus
cttctagctgaattgccctacttggcttcaaactaactctggcaatttcttctaatctttaggcttcttgttttccagctttaacttcctcaattgaagtgaaccacatgaacttaacaaactcaacttcactgtcctacattcactgcactgactcccacccactgaactgactgaaatgccttcactcttcttgaactactcttaaatagcacttcttctgagaactgggtgtatcctatctctgactcattctgtcaaatctttctctaattcatcactttgtctgcccctcaattagatgccaaattttgggattaaaggtgtgtaccaaaggattctagctagagttattaaaggtgtgtactaaaggcatgtctacattccagccagatcacacagtttaaagcagatatgttgctggataaaaattcttctaaaaattctcattgccatttctctcagcatcaattgtctcagttccccccaataaaaggacacagactaatagaatggatgcaaaaataggatccatccttctgctgaatccaagaaacacactgtcctaattcttttatatatagccttcgatgtcagctcttcctatcattgtgaagcagaattcaccaagcgttggattgttcacccactaatagggaacgtgagctgggttttttttatttgtcaacatcaaggctatatcatgtcagagttaatggatgggaaagatattctaataaaaatggagctacaaagcaagctagtatagaaatttttattactgacagaatagatttaaactaaaactaatcctaagagatagaggacactacataatcattacaagaaaaaacatccatcaagagtaccttttaatttttagcatctatacactaaatacaaaggcacctaaattcataaacaaaacattactaccacttaaatcacaatattgactatcacacagtgatattgcaaaactttaataactcattcttgccaataggcaggacatccattaaaaaaataatactgacttaaccaatactggacttaaccaatgatataaaccaaaggacctaacagatacttacagaatatttcacccaaatataaagaatgtactttcttctcaaatacctcatggaactttcttaaaaattgacagtatactcagactcaaaatgagtctcaacaagtacaagaaaatagaaat

SEQ ID NO: 35664 - DNA, 1872 bp, Mus musculus
tgaatactactcacctatccttgaccagtggaccccaattgcttccatgttaagagggcagagtgatgttggggtcgctgtctttgagaataaaatctatgtggttggtggctattcatggaataatcgctgtatggtagagatagtgcagaagtatgatccagagaaaaatgaatggcataaggttttcgatctgccagagtctcttggtggtattcgagcttgtacacttacagtttatccacctgaagaagccacaccatcaccttctagagagtcccctctttctggaccctaagatcatccttacaattaagatgctatattcctatctttgcaatgtgtcatgattatcttcttttccccccttaagtagcatatatgttagagttagccttcagtaattgatacagaaaaaaaattgacattgatgttacttgtgatgtttgtatggcctagaatgtttataaagtggtaacaaaccatccttgaaatatatcccatagaagctgatgtttaacatgaaaacaaaaaaagtattgtctacaaagtgtttcttcagtactttctaaatgctgtgtactgagtgtaagggattcctcatcttacattataagccaagttgaaggtggattatagtaaatgtacaactgtgctcactaggtttcaaagtgaagaagttttcctttcatctttaactgtaagatgtcaaagggaggcagcctgctccaataggaaacagtacacaaaaggttgccaactcgcatgagctacctccctcttttcataaagtatttttgacacatctgtcaacccacctgactgtgtgggtgcattgagaacacaccaagtttctaagacacacaggagaaataactgaaattcaccaacactagtttgtgggggaaagcatgacccctctgcttataagaattggtttggggttttttttaagtgtgtatagatgaacacacacatacttatatcaaatacaaatttttaaaaattgactgtcaggtcaaataaatgtgaaattaaacaaaattcttctaaaaagcagcttccatgaaaaatggggattcagtatgcacacattaaatgcatatatttcaaaccatactgaatttaggtggataagggctagaaattttgagcaactaaatttatcacttgaccaaattttaccataaagaattatattctctttttctcctttgctgttgaagtaacttacctgttgtgtggattctgtattctgtacactcttggttcatgaggttatttagcacaaagtgtaacagcttcacctgggaagctgcttttgctctatgatgtccatggtttcccttcttttcttcaataaaaacatttaatgtcattctgctctgtgccatgccgttactcctcagtttgatttccatttattctgtatctttcaaggggtgagattgaggaggtcgaacatggtgtatgtgtatgtgacttttattcaaaggacaaagacttgggccagccctcacctcactgtgtagatactgctttttgcctttgaggaaatggtttgtgaaagatgctaattggatcttaagcagcagcagtgcaaagcctgggtaaactaaaagcagttacatgtcctccctccctttctttgctcttctcttcccttcctactgtgacctgcaaagcttggtccagaaaccctatctaagggtgatgagggtaatatataaatgtcagatatgtacacaaaagctggggccaggtgaggtgctgccactcttatggggtggcatttccacctgctgcaacccaagcatgttgggaggagcgtgggaaagggggggctagtctgggtaggaggtatatacagcc

SEQ ID NO: 35665 - DNA, 1238 bp, Mus musculus
tactttatgtggaaggtgacaaattgattactgatatcatgtccacttaataaagtaattaacacattattgccaatcatctttgggttaagaatggtggtattggttgtagcagttgccatggtgaaatgtgtatgaaataaaccagccagtaattataccctcagattcagctgtacaataggttttacagatagtgatgtttgttcctgtacgctatgtcaaaaataggtactcagaattgatgtgttattcttcctttgtgatttttttatcttttcctgtatttttagagcaaagaaattggagaaatgtcaaaataaaaagtgaaaaacagatggtagaaaaaattcttagtgatttttacatttgtttaatattttagaaatttatataatctagcctaatataatatctcttaatgtttcattttaatagtctcaaaaactataagatgccctctaaggactcatattaagcattttcagagattaatttagtagtattattattctactaaaataaaataaaacttgaaattaaaatatgattgcatttcttttctttttgtttttcaacagctactgtggaatgttacaatccgagaacaaatgaatggacctatgttgccaaaatgaatgaacctcactatggccatgctggaactgtgtatggaggagtgatgtatatttcaggtagacaaataccctgtgaacttatcataataatgtttattcatttttaattgatttatgtattcactttacatcctcatcaatgcccctccttccgaatgctttcccataccctaccctttcctctgagagagtggaggcctcccctaggtatctcccaccctggtacatcaagtccctgtagagctagatgcttcttctcctactgaatgagatctttccatatagtgccagtaataataacaattcctgggaaaattgtaaaaatatatttatattttcaggagacttttatgtgtgtatttgtgtgtgaataatttgagtattctgtaagtttacaatctagcaccaaaccaattcagttatagatgtataatgtatgagaagttagaaagcatttatctccagttaatttttaatgtaagtcccaatactctgtattctagtaaacactatttatacgaagtaatcatttgtttgacttaaaatttggctaagccatattaggaactaaaacatacatacaaatctctttatgtgtaa

SEQ ID NO: 35666 - DNA, 1888 bp, Mus musculus
aagaaacaactatgctattaactcatttcttataaacactaactttgagaagaatccatatgaagaatagtaacaaatgacacctctatagaaaaatggaagtcaaagaattagatagtagacattttttctgttttgtgacctgctaattttatgtgctattttgaacaaccaagaagaagaagttgacttgactgtaattgaataacatacaatttttcctaaatttttcatctagcaattatttcattagtatttaggtaggtaatttccgaggaagaaaaaattattttggacatagtcaattgaaatgttgtcttaggttaagagctttttggttttgtttagccatcattttttgctgaaccaggtgaaggttttttgtatcgtctttacacttttatacacttaaataagaatttttattcacacttctatggattttacaaagcattcttcctctgaaataagagtttttgtgatcaaaatgtagatgtccagaattttcttgttttcatgtttgaatttttttattggattcgtaggtcactttggataactgtgttgaagttggacggattgccaacacctaccatctgacagaagtggataaatatgtcaacagcttcgtcttaaagaattttgctgcattgctgagcactggggagttcctgaagcttcccttcgagcgccttgcctttgtcctgtccagcaacagccttaagcgctgcaccgaacttgacctcttcaaagctacctgtcgctggcttcgcctggaagaacctagaatggacgttgctgcaaaactaatgaagaatatacgatttccgctgatgacaccacaggagctcattaattatgtgcaaaccgtggatttcatgagaactgacaatacttgcgtcaatttgcttctggaagccagcaattaccaaatgatgccgtttatgcagccagttatgcagtcagacaggactgccattcggtctgacaccactcgtttggttacactcggaggagtcctgagacagcagcttgtcgtcagtaaagaattgcgcatgtatgatgaaaagacccacgagtggaaatctctagcccccatggatgccccaagataccagcatggcattgctgtcatcggaaattttctctacgttgttggtgggcagagtaattatgacacaaaaggaaaaaccgccgtcgatacagtgtttagatttgatcctcgatacaacaaatggatccaagttgcatctttaaatgaaaagcgcaccttcttccacctaagtgccctcaaaggatttctgtatgcagttggtggacgaaatgcagctggagaactccgtaagtctttctacttatactatatataggattttttttaattcagaaatttgttgttggtaacaaaaaaaatttagggataaaaatatgcctagggcttcctttgtaaactatttttctaagaaaatatcaaagataatctgtatgatttatttctgcataaaatattagccatgatccaaactataactaatatatagtttgctgaatttgaacagctatataattttcatattgaaagatcaattggaatatatattcaagtaatttatattctaatagagtctgatagaagtttgacatcattcttcattctccactattaaaaacccacaagctgcctggcagtgatggcacatgcctttaatcccagcactcgggaggcagattcctgaggtccaggacagccagggatacacagagaaatcctgtctcgaaaaaaaaaaatccacaagctatgctacttaaaatccttctttacaaaggcttggttcttcttatttcctcatttccagaattgatatctaatagtgaccacacagtaaga

SEQ ID NO: 35667 - DNA, 2026 bp, Mus musculus
taattggccaaacagcagcagcagtaagctgagtattggaatatttaaagtataatccttaattctctgagagggtaaacaattcagatgataaaatgaaccccagtcttgcacttgatacagataaataccctctccctttctgtctcaaggggggaaaagtcatcaaaatgcaaaataatctattaaagttctacagcactactatccatgtgattatggaaagcaattctggaaggtcgaagttttttatttcatgtgtgggaaaaatagaagtgtaaatggtcatctttttttcctccaattagggaaaataaatgtcccagtaagtgatttcaacatgcttaccctatttgttcctaatgtaaattagccttagtagtctattgtttcatgtagttaaatctatagataaataaacaaagcagtgttttttttgtttctttctttctttttgagaactcttttggctctgttttcaaaataccctagatgtatgagcttgtaagcataagtttagcacagagagattgtacacgttttctccattccttactcaacttgtatgcttgttacagggctttgaccagcttcggcttgatggattgctttgtgatgtgacactgatgccaggtgatacagatgatgcttaccctgtgcacagagtcatgatggcatctgctagtgactacttcaaagctatgttcacaggtaggttggcttttgacactctgtgttcacattaataaactgggggacatctgtgtgtgtacgtatgcatatatctaatatataacacacatacaatatatatgtaatatataattccaaacacaaaatccagtattttgctttttgtcattctaaaaaaacactttcaaaagaaatagtcactaatctgtgtagttgtgtgtggtgctatttaaatcatgttttctaccatctgttctacttcatagacttttaaaaaatatctgagtggacaatcacagactctgtgcttctataatatggtctttaatccatcaaacgatatgaaatgacagaccatttgaaagcgcttgtattatatatgatctccattagtatggatagaattgcttcaagtgtccttttagctgtaaaaatgtacaaaagcaaaagtgtggaatggatgcttacttggaataagactttcccttggttttgctgcatctaattactggcagaaccaagcctgaccttaatgatccacctccacttaattgactaacttttcacttaaggtggaatgaaagaacaagagctgatgtgcattaagcttcatggcgtgagcagagtgggtctacggaaaattattgatttcatctatactgcaaagctttctcttaacatggacacccttcaggatacgctggaagccgccagctttcttcagattcttccggttttagacttctgcaaagtgtttctcatatctggggtaagatgttgttatattttatttttcttgtcatacatgttcatttagagttagagaccggcttaattgtatagtcatgtaatactcatcatcagaaaaagatgctgtataacacgtggtgtagaaattaatgggaaataaaaccagtgaattttataaagtggaatcattcaacaaaatccttttctatagtcagatgatgtggaatactaattatatttgataaatgtatgtaccttaacttgttaaataattcatatactttaacttagatttagttcattgattttatacacttgacttaattttatatagtagacttcttgtatagaattgcatagaaaagtaatttgagcttctagcgttctgtttaaacaggcttggctgttttttttttttttcccttctttgaatatggggactcaatcttaagaactagcagttaagtgcaaacttgcaaagatgtgaatctttagtctttagaacatattacgctgaagagtggttagctctatatcaactaatcaatgaactggataacagttactctgttcctacagatac

SEQ ID NO: 35668 - DNA, 1148 bp, Mus musculus
gtcaataggttcaagtttgagacggagttattaaagattttttttctttatacaattgaatcttttactttttattagctacctggttttgttactctgtatcctagctagcctcaattctcctgactcaaggtgtaggactagaggcatatgccactcatacccaaatcaactttttttaaacaattttttattagatattttcttcatttacaattcaaatgctatcctgaaagtaccttataccctctcccccaacctgctctccaacccacccactcccgcttccaggccctggtattcccctatattggggcgtataatctttgcaagaccaagggcctctcctcccaatgatggccgactaggccatcttctgctacatatgcagctagagacaggagctctgggggtactggttacttcatattgttgttccacctatacagttgcagaccccttcagctccttgggtactttttctagctcctccactgggggccctgtgttccatcctttagatgactgtgagcatccacttctatatttgtcaggcactggcataacctcgctggagtcaattatatcagggtcctgttggcaaaatcttgctagcatatgcaattgtgtctgtgcacggtgttaggtggttgattatggtatggatccctgaatgggacagtctctgcatggtccttccttctgtctcatctccaaactttgtctctgtatgtaactccttacatgggtattttgttccccatactaaggagggatgaagtatccacactttggtattccttcttcttgagtttcatgagttttgcaaattttatcttgggtattctaagtttctgggctaatatcatcttatcagtgagtgcatttcatgtgtgttcttttgtgattgggttacctcacttaggatgataccctccagatctatctatttgcctaagaatttggcgcacgcttttagtcccaacacattgggaggcagaggcaggcggatttctgagttcgaggccagcctggtctacagagtgagttccaggacagccagagctacacagagaaaccctgtctcagaaaacaacaacaacaacaaaaagaaaaagtgcaaggccaaatcaactttaatgttttga

SEQ ID NO: 35669 - DNA, 1200 bp, Mus musculus
ccaagcattgaaacacatgagtctatgggagccgtacctcgtcaaaacaaccaaagaaatattaatttatttgggtattaataattatttcactgtgaatgggaccatgtatattaaaacaccatgatatataccttaaatgtataccataaatgatataaatagatgatgggaagatgtattcatatacctatgaatgttacacaagattttaaaataatccataaaggactataaaaagcactttgatgtaaataaaaaataaaatatcagtattttttatttgtcttagtagtggctacttcaaatttccaaggaaaaactttttactaaaatagccatcaagcataaatatttggaaaaatctcaaatatagttctcagaagtaaagcagaatacttatataacacaccagcatctaattataagactaaaactgctagtcaaagatagatgtctccctagatcattgtgtggattctatgacattctcttaaagcttaagaagatgcctgatgttgactctcatgtgcagtaggggatgcaaaatttgaaccatatctgtggaactgtaagggggcaaagttaatgatttatgctgtcaagggaaaaataaagaggattggaagaagtgggagaaggccaaattaagaagcttttgatgtgtgaaggaactgctgcatgtgctgtgttgcatgcactctgttttgttgtatgaatgtgaactaaccaaaacctgtaggacttactgacactttcaaaaggagagatgatagctgtgtgaaatattcgtggaaggaaggctggaaatagtttttgagaccaggtacctattgtagcagtcaaagtgagatgtggaagaacccaatggttgacagtgaaaatgaaggaatggccttgtggaatatttaggttatatttggaagcattctgtggtgacctggagtcacctacttagacttacttacttacttagacctacttagaataattttgaaatttagaacatgactgtgccaacaaggtagtcctcttgttttggtcccaatgcaacctatttttcagtactctggtcaaatcccatgccctgtgatcagccagatggtccaagagggtctcttggcttcggactcatttaatacatttattttcacattgaagcaatttttaccttgttgatacctatggcgttgttcactg

SEQ ID NO: 35670 - DNA, 1179 bp, Mus musculus
ttttttccctgtacccatatcttcgtggtttttctctactttctcctctataagtttcagtgtctctggttttacgtggagttccttaatccacttagatttgaccttagtacaaggagataggaatggatcaattcagattcttctacatgataaccgccatttgtgccagcaccatttgttgaaaatgatgtctttttttccacttttcctgtttttctttaaggacttctacctgtttggttgtgttttcctgttttactttaaggacttgtaactctttagcagtgttctcctgtatttctttaagtgagctattaaagtccttcttgatgtcctctaccattatcatgagatatgcttttaaatctgggtctagcttttcaggtatgttggggtgcccaggactgtctgaggtgggagtgccgggttctgatgatggtgagtggtcttggtttctgttagtaagattctttcgtttgcctttcgccatctggtaatctctggagttggttgttattgttgtctctggttagagcttgttcctctcatgattctgttagcctctatcagcagacctgggagactttctctctcctgagtttcagtggtcagataactctctgcaggtaagctgttctattgcagggaaggtgtacagatatctggcattccaacctgcctcctgtcagaagatgaaggcccgaaatagggcctgaccagaagctgttagcttctgtagtccacactctcacctgagcagactagtcttggagggatccgggaaccaagttggctcccccaggtgctctggcaaagctctcctgggtggggccaacacctctcctctggcagggaagatgcctggatgtctggagctcaaaatggggtctgtcttagaagctgtcctctagggaccttgggggtgtccgccgactcagcgcccaggtgatctggtgctggcactgacaggaagggatttgtgaccctggttaggcaggcttttctgcttctttaatgctgtctcaggtcctgctagagattggattggaacagaagttgtgttccactcactggcggttctaaaattgtgtggagagtccactagggggccttgggggtgtccgctaactcccttgaagtgagttttaaacaaaagactgacttgagaatagaatt

SEQ ID NO: 35671 - DNA, 1326 bp, Mus musculus
gtagatgtgttaatgacagaatgttcattccctcattcaaaaattccttgctccacccctgccccccatttattcctgaagggcattttaattggtttcagggatcttgcttggcagttccttttttaaaagtactttaaaaaaatctccttttccatttccttatggccttaacaattttctgaggataatctgtcacatgaattgcttttgccacataagtaaggtactatttcgcatcggttcagctttgtgactatggatttcttatttctttaagtttaatattctccccttgtgcacattcagttgcctttcttttactaacttgtagttaaattcaacctgaaaatgttccatggcaaggttgagaaataaacaattcatgttttaaaatatagcctgttttgagcagtgtgctattctctccaggatgttaactattcctgcttgtgttatcattgttttgatagtaaattcctttctttttagagatgtatttacttgtttttatttctgtgtatgtgtgcatgaggactcatgtactacatatgctctggtgcccacagagagcagaagagggtattcaatcccctaaaaacgtgtgatatacatagttttgagctgttctgagggaactcaaacctaggtcctttgcaagagcaatcaatacccattttgtcaataatttattttttattcctgttacattccgatcacaaccccccctcccatccatacaaatccctcctccaactaccccttcctaccttgggatatcaaatcccagcagaactaagcatatcctctctcactaaactgctgagccatttccctggcccctaattagttccttttatttgttcaatttataaactatattttaagcatacaaatatgtattgcaaaccagcacagtatatatagagtttatactatgggactaatcagtttcagggatccactggaatgtagctcccgatgaaaagggaggggtgctctaatgagcttcccttttgtcttccctcctcttggaacctgttggcctggaggtttgatgttttgttatccctttccagaagtttctgacattttttttaactcactgcatttttttgttgttattgttcaaatttggtaataaataaggttctgtgtctcccagttcactcatttcttttcctgttgctgccattgtggtactgagcctgtcttttcagtgagtgtttttaacttgatgactgtaagtgttttgactttaaatcttttatgttgttttactttgtatcttctattcttgttctttcctttgtaggacaggaaatc

SEQ ID NO: 35672 - DNA, 1124 bp, Mus musculus
cttgtaccacattttctttatgcattcttcagttgagggacatctaggttgtttccagtttctggctattatgtctaaggctgctatgaacatagtggagcaagtgtccttgtgatatggtggagtatcttttgggtacatggccaggagttctataacttgagatagaactattcccagttttctgagaaacaatctcaggcattattctaactcaatagttctcaacctgtggaccacaaccctctgggggatcacttaccaggtatccttcatataagatgtttacattatgattcataacagtggccagattacagttgaagtatcagtgaaaataatttaatagttgggagtcatcacaatatgaggaactatattaaagagtagcagcatctcttaggaaggttgagagccactgcagtctgacctaaacacacagaatctgtattcattgttctttcccatactctagcgttctcagactagaggacagaacaaacagggcattggagaagccaaaagagggctttggaagattagaagaggacattgaatcccttgtaactccagttacaggtgattatgagctgccacgtgtgtgctgtgaattgaatcttggtcctctagaagagtattctgtgatttttaaccagtgagccttctatctagccaagtttatatttcatgaaccacatatttttttataaagattcaagagaagattaactatttttttaaatttacatacgtgaaaatacttacacaaactcagataaacattgtaccttgaaatgtaatattcacatgacaatttaaggtaaaccccaatatttcatagtaagtctctccagggacagtttgaagtgtgcggttaccctgcaaaggttatcatggccaaactagatgtgttagaatctgttcttttaagttaaatactcatgtagttcattaaatttccatcatgacctgtcaaaacatcactgatacttttctcggttgcccaaaagggttacatgctgttttcttgataatggccaaaatgttaacatgttttgaattcctaacattggtgggtaagaactaagactgacagtgagtgattagccaaggaactgatatct

SEQ ID NO: 35673 - DNA, 1148 bp, Mus musculus
ctaacttttctgcttttgtttcagtttgtgctaaagaaaaaaacacagatagctaggttatataaattatttcttgaataagttgacaaaaggtgaaaggtaataagttatagtaatattactgaatatcttggcaaactctagactctgatatcttttacattctaagaatttatatggcaatggtggaaagaaaatgcaattaaaaaacttataatataaatttaaatcctagatctttgaatgtataaactgtagtcttgaaccatggcttttcaataaggaaaacaagtaataaaagccactgttttgctcttattctcttgttcttgctcctgctccccctctcctccttcccctcccccctctctctccacacactcatggctgaccctcttccctctccctctccctctcctccccctctctctcctcccccctctctccctctctttcttcccatctctccccctctctctcctcccatctctccccctctctctcctcccatctctccccctctctctcctcccatctctccccctctctctccttccatctctccccctctctctcctcccttctccatgccctgaatacactctactatattctaaaaataaaaagacactgttcttacagtcttgttacaagaattaaataaaggttaaaagcacttggtatatgtgtgtgtgtgtgcgtgcacatgtatgcatatatataattgttgatattattgttttgttataaatatcattgtcatttttgttattactattattagttttattatcatttcagtacccaaagaaaatattacatctgattctctgctaactacaaatatggcttcagagaatacagttagagattccctgccttccctcgatttagcaagtgctaccagtggagataaaatagtaactgcccaggttggtgaattactgttatatttgatatcagagaattcaaactgtataactgtctgatataattattgaaactatctttcttctctaggcaaaatatttctttgttcccaacacctgaccacttccatgtctagcttggctactaaatagtttagtgaggttagctagctatttagcttctgatttttagaggcctcactgataaaacagagggaa

SEQ ID NO: 35674 - DNA, 1449 bp, Mus musculus
gccagatgctgttttaataaagtatcatattcaaattttataaagggtcaatcagactgtagaatttataaaggcattacaatctggcttgcctacttcatataaagttattatagatttaaaggtttgttttttcctttgcattctgataattgtaaagagttttgcttcttgtgtgagctataatcaagaagccaagagtttgaatctttcagtatatattgttttctaagtgaaaagtattttattagctaatgcctctcaagggaagtttaattaaaaccttaactctcatcaagctgaccctaagcagagccactttatccttactgtaaacatttatctggttcctgttaatccttttgaagtcattactttgtttcacatcaggtaacttctaagtattttgcctgctgtgacttcctatcccctttattttctgtattctttggcaagaaaaaaaaaaacattattcttatcctccaggccagcagctgctgactactatggggcagggcctttgggcacacagtttcttttttgaggccctgtaattggaatgagtccactttaaatcctttaacgaggatccattagagggcaagtctggtgccagcagctgcggtaatccagctccaatagcgtatattaaagttgctgcagttaaaaagcttgtatttggatcttaggagcagtttgcttctcggcgcccccttgatgctcttagctgagtgtcctgcggggcccgaagtgtttactttgaaaaaattagagtattcaaagcaggcccaagccgcctggataccacagctaagaataatggaataggaccgcggttctattttattggttttcggaactgaggccataattaagaggaaggccaaggtggtggtgtggtggcagctgaaggcggcacggagatgcgggtctcagcagcagattgaaatccagagtccttttcagagtggctccgcacaccatggtggcgggcagccgaggttcggctcgggtggggccaaaaagaacgagagcaaatgagccttctgaggtgcctggtgggtgttaggcccaagatggcgggggctgctacaagacaggttggcggggccgaggtagcgctcacctcaagcacagtttcaaaaacctattaaaactactgtggtgctaataaagaattgtaagatatattcatgtattttggaaaacctataacaaaaattgtgtcttaggaacctgacaaagtgtctgttccttgttccaaacagcaattaatttagttattacagaatattaataattgatctattgcataccatcattttaaataaaattgacaatcaatattccaaagataagttaaaatttgtgtttttttcatgcttctgtatcttctataaattcatacatgcatgcatcccaattattgtgttaaaaagcaacccttct

SEQ ID NO: 35675 - DNA, 1170 bp, Mus musculus
taggcttttgctgcagtggaggtgggacaatctcctcagattcggtttgccgctctaaaagaaattatgctgcgttatgccgtggggtgcgaggctaagcactgcacagaggatagcttgctgttggcatcctgtggaaggcacgtctgattgcatgaaggttcagtgtcctagttcccttcccccaggaaaaacgacacgggagctggccaagacctctctgggtgatgagcctaagggatggttttgtgtagggcccctatgcttgcacactggggatcagacctctaccttcacccatgaggcttgcttgcagcaattaagatctggccataggttaattaacatcctggccttttgatgcacctgccgcaagcaaaacacaatctccccaggagtggcttggcatgattgagaggtagtcagtgataagactccctgggcatgtcaccaacctaagacagggatcaaaccaatgctgtttgtcacccaaggacgggtaaggggcatggctgctgggggctatctacagacattctctctgccagaaaagaaaaaagggggagatgttaggagcaggtgtggcagcagtcctaaaggcgccagggactgtagctaagtcatatgacttgcacctgacttcctcatataagacacaaacatcttgagtgctgcgcaggtgtaccaggatacaggtgaatccaatttggtggagatttgcccctgctgccctgattagctgaagctgcgtgcctggtgaggtggcgtggcctgctgtgcgtggatgggaactgagagtataaaagagtgagaggcccagggttcaggggagatataaacaagggagatataaacaagggagagatataaacaggggagatatagagaaagaagaaacaggactgaataaacgtgtgcagaaggatcctgtagcagcgtcgttcttgctggcgagttgggggcgcgcgcaagagtagtccactgattcctatgtctttctgtgttgctttttaacaattggagaagattgacattccatgtgtgacctctatcaatcatggcctaaactctcagtaagcaaaatgcatgagtggtatttggatacttcgtctttatcccctactatctttttatcttctatttttattttataccaaccccaattcccct

SEQ ID NO: 35676 - DNA, 2161 bp, Mus musculus
atcggagccaccagctaaacgaatcggctcctccaaaatctataaagcctcctgagtggcctagtccacaaccttccccttatccacagcctcgacccccactaatggggaaccctgaacccctcagggtaccaggaggaggactgctgtgagtacatggagccacagagcacagagtctgggcagactctggtggacccgcccaaactttaaacccttcagtactcgtcattttcctctgctggtatttataactggaaaactaaccacccccattctcaggatcccctacgcctcacagggttggtggagttccttatgttctctcatcagcctacttgggatgactgtcaacagcggttgcagatgctcttaacaaccgaagagcaagagagaattctgttagaggctagaaaaatagcccggaagccaactgcggtctacacagctacaaaatgagatggacatgggattccctttgactcgccccagttgggactgcaacatggctaaaggtagggagagcttaaaaatctatgaccaggctctggtctccaaggtgcctcaaaacgggcccactaatttgtctaaggtaagaggtaatgcaggggcggatcgaacctccctcaatgttccttaaaaggcttataaaagccttcaggcggttcactccctttgatcttacctcagaagcccaggaaagaaacttcagaaattagaaggtgtattacaagagggagacagttactcgatctagtgaaagaggcagagaaaatgtgtgtgtgtaaaagagagaggcgggaggcaaaaaaaaaaaaaaaaaacaggagagatcgtagacaagagagaaatttgactaaaatcttggacgcagtgataaggggaaaaaaaaaagacaggatctagacaggaaacctgggtaactgaagacaagcctcagctaaagaggctcagctgtgttagactcaagttacttatttgagatacacccttcgaggtggaaagcagtggctaaaaaaagccagcaaaagactgtaactcagattcccaccccagctacaccaaggcaagtaagaaaattcttgtgcactgctggcttctacagactctagatacctgggttggcgaccttagctgcccagttgtatcccctaaccaaggaaagagaggtttttgtgtggaccccagatcaccaaaaagcctttaaagaaattaatccttactcagactttgggactttgaaaaaggccagtggcttacctatccaagaagttacaccctgttgccagcaggtggttttcttgcctgaaagctattgctgccataaaactgcttgtcaaggacgctgataagctcactctgggacagcaaatagctgtaatggcaccccacactcttgaaagacctatctaaaagctccctgactgatggatgacgaccaacgctcctgcgacacattatcagagcattttgttgactgaatgagtgactttcgcttcattccacctgctgtcccactgtgtgagactgcacctactcatcactgcgctgacattctgacagaagaaatgatctgaaggatcagatcagccttagcctgagggcagtagcctcgcggttaaaggtaagcagaaggcggggacagcagtactgtggtgaacaaaaagcaagtgatctaggccagcagcctccctaaagggatgtcggcccagaaagctgaacttgtgactttgagacaagctctataaatggcaaaagaaaagtctacagtgacagcagatatgcttttgccactgtacgggacaatatacaaagagggctgttgacatctgcagaaaaagacctaagatgctgtggctaaaaaaaaaaaaatccatggggtggttcacagtatgacagtaggtgtttactattggcttggtctatgagatcggggatatctcatctacatgtgagaaggattggggtgctgtatctatatgactgaaagccacaaacctctctaaagcaagagtgtggctatatgacagggtcctggtccggaagcaggcaaagcttctactgtcccttcagggtccccagggctttaaaccttagctcaaccttaccaggcttcctctcactgcccacagccacactctattccagcttggttcttgtg

SEQ ID NO: 35677 - DNA, 1286 bp, Mus musculus
acaccagatgagtttcctacagacattccggggaccaaagggaacttcaagttagtcaggcatgtttcctttgttgactgtcctggccatgatattttgatggctacgatgctgaacggtgcagcagtgatggatgcggcccttctgttgatagctggtaacgaatcatgccctcagccccagacttccgaacacctggctgccatagaaatcatgaaactcaagcatattttgatcttacagaataaaattgatctggtaaaagaaagtcaggctaaggaacaatatgagcaaatcctcgcatttgtgcaaggaaccgtagcagaaggggcaccaattattccaatttctgctcaactgaagtacaatattgaagttgtctgtgagtatatagtgaagaaaataccagtgcccccaagagactttacttcagagccccgtctcattgtcatcaggtcatttgatgtcaacaaacctggctgtgaagtcgatgaccttaagggaggtgtagctggtggtagtatcctaaaaggagtgttaaaggtaggccaggagatagaagtgagacccggtattgtctccaaagacagtgaaggaaaactcatgtgtaaaccaatcttttccaaaattgtgtcactttttgcggaacataatgatcttcaatatgctgccccgggtggtctcattggagttggaacaaagatcgaccccaccttgtgccgagctgacagaatggtgggacaagtgctcggtgcagttggagctttacctgaaatattcaccgaactggagatttcctatttcctgcttagacgtcttctgggtgtacgtactgaaggagacaagaaagcagcaaaggtccaaaagctgtctaagaatgaagtgcttatggtcaacataggctccctgtcgacaggaggaagagttagtgcagtcaaggctgatttgggcaaaattgttttgaccaatcccgtgtgcacagaagtaggagaaaaaattgcccttagcagaagagttgagaaacactggcgtttaattggttggggtcagataagaagaggagtgaccattaagccaactgtagatgatgactgaagacttcaagttaaacaatgccttgggaaggagttggaatttcttttactagcctaggggtatattttcaaagcaatactagaaagaattaatttcctagctcattaccttactagtagcagctataaatttattcttatattttggcgatgaaaatgtgacctctacttttttttttctttttattgatt

SEQ ID NO: 35678 - DNA, 1854 bp, Mus musculus
tatgcttatgcactggagggcaggactgtgggtggcatggaggtctacaagaccttgtgttcctcttctcatgccgtgctgccttgctttaatttgatttttatgagtcctaggcataagacaaggtttggccatcaagctaggatgaacaaaggactgccatctgctctgcccctgataaagaacaataccaccaataaggggtctctgctggttgctggggttgtaacctacttctaatatggggcttaaaattaaatgtgaaaagtggtatactatatacattggatcaagtctatatagtagctaaaattaagcattccaaagtaatgtctaatttatcaatcaatgaaagtttgaagtgaaacttggctgcaaccagtctttggcgtagcacttgtatcatgaacctgtctaagatgaaaatgatctcttctcatgattcatctgtgagtagctccatagtgaagggcaattagtaaaggctaaagacttacccctttatttgtccttctatttggggttctgttgtctgaaatttgaaggaatacgaccagtgggctcaaatgagcaccactcttagaagttgtgtgcccattcccttaacacaggtagatctgtcttacccgtttcctgggtgggaccttaggaatccagtgccctgagactatgtctttattatttatgcctagtatctcagtcttcccacactggcaaagagtatagcaactggtggttagtgataattgacaaggttctgtccaggctgcttttttgaggtctttgttttagtaagctatgaatggagctgtctcttgcatgatgaataaacactctaccattgtctccactgcccctagctgtagtactggctgataggattatggtggaaattgtgttattggtaatctttgagccttgagagaggtagaaattgttcagaaactgtgtcctctggtttctaaatctattccccacgtgcctccaattttcttgtgctgtgcattttaaattaatcatgttttttcttaattaaatactctttcacagcaatgatttccaactctggctgacgtaagaattgctggggaagtttgaaggggggaaaaagaaagctctggggtggagtccaggctttgatagttttttttgtttgtttgtttgttttttttttttttttgaggaaacctattgatatatgtatttgattgactctaaaaagttgttgtattggaacatgaagaaaacatttaaataaaacaagattctgaaacaaaaaaaaaaaaaaaaaaaaaaaaaaaaaaaaaacattttaaccataatagccacaaaaatatctagtataaacccaagggtataaaaaaatctgtatagtgaaaattataaaatatgaaatgatctcttatattcatgattgcaagaattaagtgatgaattatctacattgtccaaagtgacctatagattcgatgtaatatacaatgaaagaccaataatattactcacagaactagaaaaatatcataaagaagtataaaatattctgaatagctaaagctatcttgaggtacaaaagcaaaactggaagcattacaaaatctattacaccaaaatgtttaaatgggtaacatagagctttagtaatcaaaagaagatattagcaaaaacagtcaataaagagaataatgaggataaagttttaaatgagaagagggaatatatatatatatatttcatatataaatttcatatacatatacatatatgtacacacatacatacacacacacacacacacacatatatatatggaggagtttaattggggttactctacacaggaaaaatgcctct

SEQ ID NO: 35679 - DNA, 1165 bp, Mus musculus
tcatcactgctctgacattctggcagaagatcagatcagccttggcctgagggcagtagcctcgccgttgaaggtaagcagaaggcggggacagcagtgcggtggtgaacagaaagcaagtgatgtaggccaccagcctccctaaagagatgtcggcccagaaagctgaactggtgactttaagacaagctctataaatagcaaaagaaaagtctacactaacaacaggtatgcttttgccactgtacggggcaatatacaaagagggctgttgacatctggaaaaaaagacctaagatgctgtggctaaaaaaaaaaaaaatcaggtggcagatctaaccaccaacaggtgaccccaaggagcaatgatcctggcagtcaaggagcctaaagattattatgacatcagagagatcagctttagacacactgctgagcactatcaagttatggacagtatttgacttggcctgggggccaagaaattcaaaggtgtggttaggtcctttaactactatgttacaggactctctgacttggcagaagaaatagtcaaaagctgcaaggactgtgctatgatgaggtggaatttctaaaagaaatcttcccaaggtaatggacctgcctttgttgcccaggtaaaccagggactggccaagatattagagatcggttagaagttacattgtacatggaggccccatagctcaagacaggtagagagaatgaatagaaccattaagagacccttaccaaattgacagcagagactggcgctatgattagatagctctcctacactttatgctcttcagggatagaaacacccctggacagtttagactgactcccctccacccctccagaggtaaaaatagccactgtgcatagtgctgacatgctgctttcccagcctttgttctctaggctcaaggtgctccagtgagtgagacagtgagcaaaaaagcagctccagaaggcctactcaagagaagaaggcctgctacattagacgtctccacgcagaaaaccttaagactcatgtaaaaaggcccttatcttgtactcttaaccaccctactttctacctttatgggaccccttttgattttgcttctgcttttaattataggtccatgtgtgttaaataggcaagtcaccttta

SEQ ID NO: 35680 - DNA, 1165 bp, Mus musculus; identical to SEQ ID NO: 35679

SEQ ID NO: 35681 - DNA, 1165 bp, Mus musculus; identical to SEQ ID NO: 35679

SEQ ID NO: 35682 - DNA, 1165 bp, Mus musculus; identical to SEQ ID NO: 35679

SEQ ID NO: 35683 - DNA, 1282 bp, Mus musculus
aaccagcagccatacttcctgctcttggggaacaggacaaacactgaccctgactgaagtaaccgtgaggagtccagatctctgtataggcaccccaccttccacccacaaacacctatgcagacaaattcagtcggtgtccaggacagaagctatttactatcttgtaccttccccagttggctggtgggcttgcaatacaggacttactccctgtgtatcaactaaggtttttaattcatctaatgatttttgtgtcatgatccagctgttaccccgtgtatattatcaccctgcatccagtttagaagaaagctatgctggccagcggtcaaaaagagaaccaattactttaaccctggctgcattcatgggaataggtatggcagtaggagtggggatgggagtgtcagctttgatagaaggaagacagggaattcagtctttgagggatgctgtcaatgaagacctagcgccaatagagaagtccattgatgctttagaaaaatctttgacctccctgtctgaggtagttttgcagaacaggagaggtcttgatttgttgttcctaaaggaaggaggactgtgtgttgcccttaaagaagagtgctgcttctatgcagatcatacaggaatagttagagactctatgcagaaactgagaaaaagattagagcgaaggaaacaggaacgggatgcttaacggaggtggtttgagtcgtggtttgagtcatgaccatcttggataacttttttgatttccactgtagccggaccagtccttatgatatgcttagctttagtttttggcccctgtataataaatagagaaatggctttcatccagagtagaatcaatacagtaaaactcatggttcttcaaaggcaatatcaacatatagttcaggtagatgaacacttaggggacaccaatctctaaaattctatgattagaattagtctaaacagaagaagaggggaatgaaaggaaataaaacttgagacctgtgattcatgtaatgtatgtcaaatagcccaaagagttgtttgtgaactttgaaacgtgggcctgagaacatagcagaacaggccaggacattcccaggcaggcccgtctttacatgtctggactggcccggcacctccctatctcccacccctctgacctaagttaaatcttaacaggctgctgatgtttaaatggaccaatcatgtgaaatcgtgccaattcctgcaccagccccactccttttctataaaaccccctagcttccaagcctta

SEQ ID NO: 35684 - DNA, 1152 bp, Mus musculus
aataattaacattggaacaaaagagtcagtgagatggcccagttggtaaaggttcttgttacccaagccgagcaacctaagttggatccctgaaaccaatttaaaggaggaaggagagcactgactccatacagttgtcctctggcctccacacttgcacagcatcacactactcccacacatgtaatgattcttaaaacttgggatgaaagaaactgtgttggccagtggccagctatcaaaggaaaactgggacttcttgggaaattgcagccaacaaaactgtcctaacgtatgaacttattgttattctataaattctaacatagtagaaagacataaatatgtccatctatgtttctggcataatgagatctcaacaaatctctactcctttataataaggcacatatatatgtaagctgcatttgcttacctttaataccttcccagaagtcattacgatctctcctgactgaagtaaacttgcttaggtcatggtacgtactccagatataaacatatttatcttctaaaccgctaaagaggtaagtagagtcatgactgtatttgagcaggaaaggtcaaaaaataaacagaaaaaaaattaaggtttccttctatcagtgctaatttaagatatccacagtaacacctgagtaagattgttgagaattaaatccttattctggattctgaatttggtttgatgcatagccaggctgttttgatgtttgcttattgctacacatttgttagaacactgttataatgaatatactctctcggagataaccaggataatcttttcagacataggggtgttacctattgtttacattttggagattcttaatgctgtggacccagcctagagccttatcatgctaaccaaaactctattagccttagaattttcatcaaagccctggtaactgtgatgttggttaatccattctagaactagtgacttaaaggagagcagatgaagccaattaaatggctgggtaattactgggtacttcaagaagaaaataatgaatttttgagaagagttgaaagaacgattaggaagaagaaaagctaggcagctaatcttatttctggagactttacagatcctaaattaggagttcagatgacaagcaaagc

SEQ ID NO: 35685 - DNA, 1142 bp, Mus musculus
ttcagaaacacatatggttcaattgctcagacattttgtgtgttttattttattatggtaacacatcataaggtctataatttcaaaagaaacttccattattttgtagtgaaaatttgcacctgcaccaagttacctttttaaaagtgattcgccatgagctaattggaagcataaattttctctcattgctttcccggataccaataaaaacttgcagcgaaagctaaaattgcagccacaggagggaaaatgcagtgggtttcttcgcagagtttgaatttgtccaaattatgatgtgttatatttggcaaatcattcagtgttgagaatgaaatcacaacccatgtctggtgtaaagggtaaaatcagcactcactatgtccttttagggttcttaaagttgtttaactttttgtcaccaactaagaattctgttttgaaatcattctttgcaaacacagcccgtgtatttctagaaatgcaggaacgtgttaatgactgttaagttacatgcttatttgtgtcctaccatagattgtattacctcttcatatgtgcccctgaagccttttgaaaagaattgtcagaatattactgtggaggttgaagagtttgttccagaaatgacaaaatattgttatccattcactatttacaaaaatcatctgtatgtatatcccttgcaattaaaatatgacagccagaaatcgtttgccaaggtaagaaaagtatacattcttggagcgtgccatattattgatcatctgctcactgcgtgactcactttggctgattaatgattttaggctaggaacattgctgtctgtgtggaattccgggattcggatgaaagtgacgcgtctgcgctaaaggtttgtttatggtggtgatctgtgtgtctttttggaaaagattgtggagatgaaaatttagtacttgatggtgtcatgctgtaagcttaatgtctttgtatttcaacaagaaaatatgctggagtggcaaagataatatttcatttcctactattacatgtgaactaaagggtttgtttaaatgatctatagtcaaaggtagtgtagatatgagctgagaagatgggcaaatgtgggctggggatgtttatctatatgatggtcctg

SEQ ID NO: 35686 - DNA, 1199 bp, Mus musculus
tgtagtgcaggaagtttcctctaaatgatttgcatctgtatcctcacagattcagttcttcctatgtttcatatcaggctcaattatccatagaatccctatatgttatatggaaattaacacacaaatgatcaagaagtactagactccagtttacataaagtcagatatgatgccaaggtatcctgcttctatattttcagctattctatactccttcctatgatgtcttacattaatattctgtgactttacaagaaaacccaaaatatgctcatcttctaattttttactggtatgaaatttgtgcctaaaagtttcatgtatttcctcagaaccttgcacagaataagcacttgaatagtctcaagggaagaagtctatgttatagaaactgatttaactcccttggagcccttttataatgagcaaaatgatatagacagagaacctagccctcagcgaggttgttcttgaaagagatagaaaatattatttctgtaaaacataacatattgcagtcccaagaaatagtagacggtagtggtggcacacgccagtagtatttgctgaaggaggcagaggcaggaggatcacgaattcgaggccagcctgggctacacatttaaagaggcagtggtggtgcacgcctttgatcccagcacttgggaggcagaggcaggcggatttctgagttcgaagctagcctggtctacagagtgagttccaggacagccggggatatacagagaaaccctgtcttgaaaaaaaaaaataatagtaaataactaccgtaaacgtgctgagtaaaccctaggggcatgcatacacacacatgcatatatatatatcacacacacacacacacacacacacatatatatatatcataacattctctatggagttttagctttggaaatacagtatttgggagaaaaaaaattttttcaactctcccagtaggttaaactttcttgtcatttgtctcatttctaattagaactgtcgatcaccacagtagcctctggatagatttcattaaagccctgtgattgtagatggcacagtttgattgatgtggagcacttaaggaaactcatccccaaacctctgctgcccagggctttggctggcctctttcatttgaagattgtggcaattttcagtgtagggtagctgtgtcagaattcccgact

SEQ ID NO: 35687 - DNA, 1184 bp, Mus musculus
ttatttagttaaaaaacatcaggctttcccaagcagctgcggaagatggaggagaggcaggttctggtattggatggcctaggcaatcttctgggccgcctggcggccattgtggccaagcaggtgcgtctgggccagaaggtggtgatcatacgctgtgaaagcatcaacatttctggaaatttctacagaaacaagttaaagtatctggcctttctctggaagcggatgaataccaaccccgcctgaggcccctaccacttccgaacccccagccgcattttctggcgcactgtgcgaggcatgctgccccacaagacggagagaggccaggctgccctggaacgcctcaaggtgttggatgggatccctccaccctatgacaagtaaaagcagatggtggtccctgctgccctcaaggttgttcggctgaagcctatcagaaagtttgcttacctggggcatctggctcatgaggtcaggtggaagtaccaggcagtgacagccactctggaggagaaacagaaggaaaagtccaagatgcactatcggaagaagaagcagctcttgaggttacggaaacaggcagaaaagaatgtggagaagaaaatctgcaagttcacagaggtcctcatgaccagtggactcctggtgtgaacccaatatagactgtgccatagatagatagatagatagatagatagatagatagatagatagatagaaaaaactcaagggagtgctggagcaatggctcagtggttaagcacactgactgcttttccagaggacccaagttcaattcccagcactcacatgacagctcactaccatctctaacttcagttccaggggatcctctgacattcaagagcacctgcacttacatgcacatgcacataattttaaaataaattggcaagttgtggtggtgtgcgcctttaatcccagcactcaggaggcagaagaagggttcgctgtcagcctggtctacataatgagtttcagggaaccagggttacatggagagaccctgtctaaaaaaaataataaactaaatgtaccatattttcttcagctgagggacatctgcgttgtttccagtgtctggctattaccaataaagctgctatgaacaaagtggagttgggtcctggcctgggtcccatagacacgcttagcat

SEQ ID NO: 35688 - DNA, 1389 bp, Mus musculus
gacatattcaagatcagagagatgaattacaggtgtctttttattacagtctactactataggtatttatttcaggcaatctaattagaaaagtattaatttctccccagtgcagttagggaagagattaatatttacctgtattttcagaggggatggctttcaatttggcgtgcctctcccctatcttctgagttctgaagtttaaaacctgtaccaatgtgtgctggaatacttgagagactgttcttaaagtgtgaagaaactggataggttagaaccccttttaaattactataaaagatccagagaatgaatccatggttttatgtaaacactgccttccctcctggtaaagatgggccaaagatttcaatgcagggggagaaaagacagtgaagagatgggagtaagtttctgagcttagtgctagtctgagtccttcggtgtcagagaaacctgaaaaatggagtgtgggagtgttatagtggcagaggagaaaatgagagttaggaaaagtgaattgtcagattttgtttctcatgcaaactactcccaggtgattttggacaactatggtgtgttattcacgtgtaggctctccattctgttaacaagagagggggttcgaagaaggagagagattgcttcaaggatcagtctaggttcttctataaccaccagaaacatggaagaggtggggcttgtgtgtgtgagagagatggtctctaaatgctataaaagagactcatggaagcagaaagcaacttatcactgacaacttgcttgatggaggcggtgttgtcagagcattgccaggtctgtttggaataatctgggctggtgaagaatgatgcaagtgtagggaatgtaaataaagaagtagatactatccaagttaagtctagagggctcggaaagcaggacattaagaggatttttccctggcacctgatacccagccagccatgtgattatagtgaagtcctagtatgactgcttcctattctatagtgcaaacacaacaaagaagagcagaagcttctccacttacgacatatgttactttggcaagtaatttagcttccgttgagtcccagttttcttatatatatgaaatggtacttgtgctcacatcagcagtacatatactaaaattagaatgaaacagagattagcatggccccttcacaaggattgtaggcaaatttggatagtgttctatatattttactaaaagatgaaattgtagtgatattaatagtatataggcttgctaggaacattaaacgggacatgtaagaaattacttaacagtaccttgatgttgggagctatttggtgaactataactattatcagccatgttgcagaatatcatcagtggtc

SEQ ID NO: 35689 - DNA, 2213 bp, Mus musculus
tgttcagtgagtggccaagcttgattctgtaccaacaatgtgacagatgtttgaacattttgtgttatgtatgtttcactcagtaggcatggcaaaacccctaagagctcaaaatgaggagttccaggtgaagtcaaatgaagccgtccaacacatctcttactaatccagggggaaagtggatttttggcttcttgatacaattcctttgataagagaatacccaagaacagatggagatctttgctaggctaaatagcactttcctctgagcctggatctagattgggttgttctccagcaattatagtaacggcaggatactaggctttgactttctttgggatgtacataagtgggctaatccatcgaacttgaccacttttaacacctgtggataggttctgtttctaagctcagacatgagacgtacagagataaaaactatatctgagttggaaggataagagtcctccttgtagacagtgccactttattgggttagtctttctttctatcttgaattcatgactgacccagaccttgtagattattctctctctctctcttgtctgtgtgtgtgtgtgtgtgtgtgtgtgttcatgtgtgcacacacacaaagagaccctaggtagcaagcagactttatgcctttctgctttgtaccgtactattgctgctagctaaaaaccagcaaaatgtagaaagtgaaaactgaagaaactactttgcagtggataattttaagaaaaaaaaaagatgcttgctcctcatttaggggagcagagaactattccaatagcatgccttttctgaaggccacgtgcttcgagttccgtgctgcctcagtagcgggattgagttgtgatggcgcacgtggcactgccacctctgcctgtggagctgccctgggttcagataatcccctgtgagtagccacagaagcctcagaactcctatggctgggtcactgcacccctgtcaacaagttgtgtcctgttgatagactgcgaccccctggagcctgcattccctgtgccaactccattttcagcatgtgaattttagccatagattcatccctgagttcccagcttgtggactgtgtgtccgtttcaactcctcaaggtagaaatgggcaggctgcaagcccattcttgggtctagggaatgaggtttagattctggatagaagacagctctgaaaagcatatgcttggctttctggcatttctaatgttcagcgggcaggaatgcaaaggagccatgcacagtgtacacattcaattccttttagaacgataggtcccattcagtctactgctttactacttaatagtctggattgtgcacatccagtgatgaaatgaagaacttttcacttacaagtgggtgtttccaaacatgttaaaataacctccagagagaagtgcctggaaccactgttcctggtgtcactttaaagctttttgcttcatgactctagcatttaaaacctgtttgcagccacaaatgtgattaacagaagtttacaaagcaacactgtaccttatgcattatcttaaaatctgtggacattcatctattgttcaagcaatgatgacaaccagtgagataaaaagagagtagatagttcagcatggcaccattggctgttgttagactagtttcattggtgtatgctgtcctttgtaatgtcaggactaaaatatctagcaagccacataaacggtggcaagtgtgtatattgtttggtttccatttgtttgttaaacagccattttacttttccatggtcatgagttgaagggaaattaagataacgctccctccccaccaacactattcaactacctctctatgcctgatttctttaaaagggttcccttcttctaaatctgcacaaaaatagttccagctcatctacgttgtaatcgcgatgtgatatagatggtctctgtgaaaaaaaaattgttcattaaacagaaatttcctgttgtctgtgtctaccaaagtgtattctatcttggaaaaacaattaattggctgggatggacctgttggtataggactactgtcccagctactgggagactgaagcacggggattacgagctcactgccaacccagacaatgaagtccctgtctgccaaaaactaaaaagtgggcttaattgtgcaggcctgccatcctcactgctttggaagctgga

SEQ ID NO: 35690 - DNA, 1111 bp, Mus musculus
tggactatggtaacatggtgagatggtcagaaacaccatatttagtgtatgatagagtggggagactgggaggtggaaaaaataaaatgaaatgaaacgggggtgggagggaggagtggaagggtcctgagaaacaatagggtaaggctgtgaagcccgatgggtggggggatttcaggaaaagccaaccaaggggaaaacaagagatggacaactccccagaaatgaggcttttccaaactggattgcctatcacaatcacctgatgcttatgaaaaatacagattcttggcctgaccatccatagccacacttagatctctggggcaggggagagggctaaaaagatctacattttactcctctgctgtagggaaatggggaatcagccagatttagaaagccctgctttctagaacatttagagaggaagaagaggctttagctctcccaatatggattcctctaagcaccaggaactcggggctggggggtgggtatgttcacatgctcattggtctgagagggaagactagccagcactaatccaaaccagacatacccactctgttacgtctcagagtccagccaatcaaaagcacatgtgccaaaggctttttagtgaactctcactcttcctttctgctttcagacattttagaaaattacgttctgtaggcatgtgactgcaaaataataggaaaactacatattgtttgtcactgtagtcacacattatccataaacaatggtgtaattacccataattattaagctaaaccataaggtaatcaacacaaatgcacgaggcctcgtcatctggttgtatttgcaaagtcatcacatggggatcctccgtgctttcagagagcacagctggagtcaagctgtctccattctaaccaggtaggttacagtttgcagagtcatcctgccggatatcgatgtgtgtactggaacagctacaactaggagtcaacctgcactctacattctagcctcgctgttgtccctgaccagctgtgtgatctggtgcaacgccctatggtctcaaggccttagttttccctctgggaacataaaaagacaagcacgcccccagtgtgaggag

SEQ ID NO: 35691 - DNA, 1833 bp, Mus musculus
acctgacatggtttgctgctttatattttaacaaaactcttaattccatttttggcaaagagtatgatataatccctttatatctatcaagaagcctaagacattgcggagtatattgtgtggaccgctcataaatgctttaaaatgaaatgtagtgattctgttgtaaagcatgagagtgactgattgtgtggtggtttttttcttctacttccagtcaagtatcatcacgtgggaaaactgctgaaggaaggggaggagcctactgtgtactcagatgatgaagaaccaaaagacgagacagctcggaagaatgaatgaagcattcggtggagcatatctatttttgtattttgcaaaatcatttgtaacattccagtctgtctttacaacatggtgatttcaatatttagaaaagttttgaacttgctgtaaattttttaagtaacatcactagtgacaccgataaaatcaactcgtcttagaatgcatgatgtgtttgtatgtcacaaatccagaaagtgaagttcagtgctgtaatgcaaatggtaaagctatttctcttctatctgtagttagaacaaactgaattacaatttgattttcctgagagagggaaaacttgggtatttccacatactggtcaaaatggtaagtgcacacacactggtcaaaatggtaaatgtcctaagaatgaagaaggatcagcgtgtagccatgctgtattctaaaacaagcccattttacccaactgacttaactgcatgatttttgttttatctacccctaaagcaaatctgcagtattccaaaatctatggtattgattcaaaacagaagtccagtaacaaaatgaaacctcaatactgaactcagttagggcaaacccattgcctgtgttcgtggactgatttatcatccatgtctgcatgtggacactctcccacacacagtaactctcacacacatggtcattgacagttggaactaaaacagcatcggaaaatccaaaggagaactttgcaaaagaaaattctcttgcttgtagcagggtgatggttatgtggttattgaccagctgtaaaatttgagaggaattacagggcaggaacaggtatgtgcttttccaaaagccttcactgacatctctgaagaatgagaaaacactacatggcactagctgggtgagtttgaaaggacaatacattcattcctaaggtaacacttaaatccttctgttgttacaagcttgtagtcacttcaaaagtagtcgtcaggtgtctaggtcttgggtaatactcctttggttaatactaaacctagcttaagtagactctacagttgtgtaaatttgtaaaagtattatctgaacaactagtgaggtttcaaactcttgtaattgtagttaaatagtcattgtattttcttgtgagctgtgtttaatggttttacctcaaatcagaaaaaaaaatgaagtgcttgggtcagttaataaaaaggttttacccaatatagtgaggctttcattttttaaacctaagagccggggggtggggtggggggtgggagtagctatgccatagctgattctggtcatgtcatggctagtgtactcatgaactcacagcaagatcaagccagccgacattcaagcaccaactgaagaggcgttcataatcccaagccactgaggagctattgggagctgatcgcaactaaggtagggatagtcagttttctttggaagggcttctagtaggttcctcgtgcctcagtaccttgtacctgtgtgcacatacaggcagcactaattcgatgtgctggggtagttttc

SEQ ID NO: 35692 - DNA, 2159 bp, Mus musculus
tatgttgttagcaaccacagtgcaagacctagaagagggttcaagtgcaaaagcttgctcctcttgccaaagttccaagtgtggatcagagtaactgcaggtatgtcagcaagctttggaaatagaaaacctgtaaattctaaagcttggtgaaacaccgtaattacaaaacttcttgatccaaggacagattttacattaagctttaatttggtgccagtaaaggagcagattagcattaagatggctgacttagccttcgatggctcttttgctgtcataacatcattcatcatctatcttcaaagaggacaatagtggacaaataggcatcttttgatgtgttcgtagattgggtcagaagcaccatgtatggtaacaaactttgctaaattttactccataataattttagataaagaagaaatccagaggttagaacatataatagattttatgactagaatttcatgaatattcactggaaggaaatgaatatattcataatactcaaagggtcatttatgtactgacagttctagaagaagaatctaaaagggctgattgccctttgacagctaagtagctgggactgtttggagttttcttgtttgttttatggaccccatatgtttccatcaaagcaccaggatcgaatttataaaatcagggggatttgcaaaggaaatatcaaaacatcctggcacatcaataatggcacttgggaagaaaagttgtgacagtattctatttcaggctctgtaatcctttcactcagggttgggtgacatcagtttgtaaaaagtcactgactatcccccacactgacttttatagaatagtaacaagtgcctccttcgtccttaacaaagtcatggtgttagaaagacttaagaaaagtccacagttttctagctgtggaaaaattgtttgtgtgtggaatttgtaagcgatgttaaataagtgatttatcttttttgctgactcgttttggacttcttaaatgtgtttttaaattgagatatttgtagattcctgaagacttaccccttagcacagtgcatgctctgtagaaagcttggccaactctttctgccttacattggattcaggacctcagggcagttagttgaccttcattttcccaacaaagctatacccgacctggcaactggctatcagtgaatttagagaccatctgcaacaagaatagttgtttcgaatccgcagaattggtgaagggtagcattttcatgacaatttcagttcagtctcaatttgacattctacaggaaagcatctgctagcagatgcaggtaggatgtcagtctgtggggttacttactatccttactatcgtgtcacacactgagtgcccctaaactgcctcttgagcagcctggtgtctgcagtggttgtgactatggtgtacctaaaggagaagccacaggttgtttctctgatctgcgtattcctctttgaagagagattgttcagtcacttcaaagttcagaaaggagtgaaacagatccacatggattactaagaaagaaacaacctcactttgaagccagtggttggtttcactattaaaactgggtttgacttactgaatctgaaagactgcacatgtggtgagagtgccttttttgttttgtttttgaggacgagcaatgactattcatgttcaaagtaatgttgcccaaagtagcctttgaaagcactaacagctcatatcttgtcagagagttttctggcaacacattactctcctccaattaaaaagctgcctcctttccctcccccacatgttattctattgaaacaaaaaacattatgggtttgtaatagaaagcagctgactgttttgaaacaaacaaacgaaaaaaaaaacccactcagtttcttccctcatttgatgttgtttctcgagagattttaggtatttttgctcggtaagaaaagacaataaaattgcagatctcagcagcatgtgcaaaggttgggatttctccctgtgatagacgtggtgctaagtcatcttgattcagcactttcgcgctgtttctttgctaaatgctttcctggggcctccaagtaacaatactgcttttgctgaaccctggagttttgtacccgtctgtggtaatgcattgtag

SEQ ID NO: 35693 - DNA, 1229 bp, Mus musculus
atgaaacagatgaatttattgactacctattaaactattatcagactccagagtatgcccgattctgtcttgaagcaagtcacctaacaagcacatgtcagtggcagagagatgtctacgctaagggggatggctttcagatctatttaagaaaacaggggtaccactcaaacagcctgagtgaagaggagagcctgcaagggatagagcaggacgaagagcaggactggccacaagtgtatattaaagatcctgagagtaagtcgcaaaagacaggcaagatcaattatgccaaagaatttacaaagaaattaaaaaaccattgcaaggacatagcaagtgaaactgatgagcacctgtctccaactgatggagagagctatcctgtggaaaagattcacagtcacggagtcaaagattctcaacacataagaaaaagcccagtttcctcatcattaaggtcagtagatgtaggtttgccattggcagacttcttggaggaaattagtagcgattctgagtgcttcagtgaaactcttagcatgaaccaagaggaggaggaaaggtctatggctgtctataatagctccccggaaaaaagacctcttggtactgacaaaatcagtacttgcaaacagaaaacgaagtcgagtcagcagaccttgtgttcagagtggaaacatgacaatgagggaaaatactctaaacacagagttagggcaccaggtaaaaggtccaagtctgaactgagatactcgtggcttgaggaggaaggtgattccattagagttgacaagaacataagcaaaactagggggaaactagccccgaaacacatgcttgatgaaggccagtaccatgagtccagttccagtgatgaattagaaagcaccacgaggaagaagaggagacttactagcggtatgtttgaccagaatgtgaaatacaggccccttcatatgccatcaatgccgccaaaacgggctagagcattctatttgggatatttctccaggaaaaggcagactccgtggaagtcagaatataaccaggatgtaagaaggttcaaaagatatgaaaattctgaagattacacgcttgattctgataattactatgtcagtcacgatgacaaccaggagcacattgagtatggaagctacttaggagacagctactctagttctttgtattttaaaatgttctgacggccactttgagcaggaaca

SEQ ID NO: 35694 - DNA, 1100 bp, Mus musculus
atcctccaaagtgtttagagcactgtacactttctaagagaacaaaggtgggggcagtttttctttcccttcactttaataacaaaattgccccccccccccaagcctctatcttgcctaatggatgtccagacattcacgtgctctcacaaagcatcctttactgctaaggccatgccactgacttgggcagaagtgagttctcaaagggaccagacatcagggagactgcaacaaaggccagactcagtctccctcacctctctgagagctcagcacttaacactgtacgtgcggacaggtgagtggtctcttaggaaaccatcctttttctcactaagtatagatgctgtgccaaccaggagagactaaagtaggcagaaccattaaacttggctagcatcttctactagtggctgggacaacaatttccttactttcctggagtcttggtgctgttccttcccgggcactaaggactttctttccagtcctctgatcagccagataagtctgtagctaaccaaaggatcgtggctgaggaatggttgcttgggcaacttcttcttacagtagagctcattaaagctgccaatggggcttccaatgacaggctgcttccaagctctgggatactatagttttcgtgagatttttttttctcctgctttaatttgaggtaaacagcttctggccaaaaccaggcttactaaagtccaaacatttgtgtttccttccactttctgtgttgaaatcctgaccccatgtaatgtttcaggaggtggagcctttggaagataataagatcacgaggccagagccctcaggaatgggattagtgtccaaacagacatgtcaggagctgccctgcttctacgacggaaggatacaacaagaatgtgccatctagaggcaggtggatttccgagtttgaagccagcctggtctacagagtgagttccaggacagccagtctatacagagaaactctgtctcagaaaaaaaaaaaaaaaaaaaaaaaaaaaaagaatatgccatctaggaatagaaagtgagcattccccagatatcaaatttgccttgaccttgaacgtcccagc

SEQ ID NO: 35695 - DNA, 2804 bp, Mus musculus
ctatgcaggtcccaccctaatgcttctgaacctgatctggaaggaatgacctttcttcctggtctaaaggtcataggtacgcttgagggtgcctcactcacagaagtcgagacttactacttctgatggtgctgctcaattcttaaacacttcccctacgccccccagtagtgtcagcagttagaattgtccagctcatgtgattctgaaagctagatttggagaaaggggaacgaaccttaacgattttatgtgtgtgttcttccctttccccttctctgtgattataactgtccctattgccttcttcctatccatcaggtgcagcatgccagcaagcaaatcacggcagataagcaatacaagggcatcatagactgcgtggttcgtatccccaaggaacagggagtcctgtccttctggcgtgggaacctggccaatgtcatcagatacttccccacccaggctctcaactttgccttcaaagataaatacaagcagatctttctgggtggtgtggacaagaggacccagttctggcgctactttgcagggaacctggcatcaggtggtgccgctggggctacatccttgtgctttgtgtaccctcttgattttgcccgtacccgtctagcagctgatgtgggcaaagctggagctgaaagggaattcaaaggccttggtgactgcctggttaagatctacaaatctgatgggattaagggcctgtaccaaggctttaatgtgtcagtacagggcattatcatctaccgagctgcctactttggtatctatgacactgcaaagggtaagtttgctatttgcttagaggctgtgggagatgtgggtacttatttgcagttataggaactcaacctagggccttgtgcatgctaatctagtgctgagctgtatccccaaaccccaggttcctattttttcctcctctttgggacagggtctcactgtgtatccctggctagcctagaacccagtatgtagaccaggctacccattcatagccatccaccttaagacagggtagcaaggtcttgcaccaatataacagaagcccaccactcattttgtttttaattgctgaaggaagccagattcttcaagtgtgaagcttgtggtagataaaatgttagttggttatagtaaataggtcagcaaaactacattttgattttttttaatctcttatttttcaggaatgctcccagatcccaagaatactcacatcttcatcagctggatgattgcacagtctgtcactgctgtcgctggcctgacttcctatccttttgacacggttcgccgtcgtatgatgatgcagtctggacgcaaaggaagtaagttcggcttgatcgtaagataaaaagtcatgggagtgaggcaagttatggccaaaaatgagtgggtggctgcctttaataactacagtctagggctagagatacagctcggtggtagagcattagcccaccgtactcaaggccctatattcaatctccagtgtcattgaaatgctgtaggctctgaaggggtgatggacagcatccatgttgtctgcacaagtgcctgtgagcaaacagccctttagatgcctatgacatggctgtccctgttctccagtcaatgcctgtgctaatgtgtaaatgcttgggtttaaaactgccattaagtgcttagaatagctcagtagtagagagcttagcatacacaaggcctaaggttccatccttagcatggggggaaaaggggggaaaatactttttaaaggtggggctcggttctgtattaggattttggaggtgttcactggcttttagtcatcaactacatgtctttattctttgcagctgatatcatgtacacaggcacgcttgactgctggcggaagatcgcgcgcgatgaagggagcaaggcttttttcaagggcgcatggtccaacgttctcagaggcatgggtggcgcctttgtgcttgtcttgtatgatgagatcaagaaatacacataattatgtcctaggtgttctccccgagaacaggcatgttgtataatataccatatcttgaacattctggacagattctctgggcttgtctgttttatcagtggcaactatttaccagttgaaaagtgggaagcaataatattcatctgaccagttttctcttaaagccatttccataatgacaataatgatgggactcaattatattttttatttcagtcactcctgataataaaaaattgaagaaataaaaatacccaaaaccagttttgttcgttgtttgtttccatataagagtctgctttgtgggggatggggtgggggaacaacacagtttctctgtataaccctggctgtcctagtagaactcaactgtagaccaggctggcctctgctgggatcgaaggtatgcactgccattgtctggctgaaagaacttttagagctagttatcagcaatcaattttgcaagaaataacttggatatgtacccctcgattcccagttcattaacaaagtagaatttgggatcagtgtacccaaaactttggtccattgcctatagcctgtcatagctgtatgagctcccagaaagtctcctgtacctgttccttattcctgtggttaaaacaagaaccacatgccaaagtttcaaatgatactttcaaatgatattaggatatcaccccatttaaatgattcttttaatataaggtaattatagttctcagttttcatccaattgccttcttcacctggctcaagccagtttttaatctcagtc

SEQ ID NO: 35696 - DNA, 1178 bp, Mus musculus
gggaggagacagggtatagactgaattgacagtttctcttcctgtcttgagccagaatgctgggttttagccaagacagttattttcaagtgtttttcgttttccaaaatcttaggaaggaaatgaaagaaagctgcctaaggcaaaagaggtgtcttttcactcacaagtttgggcttctttcctttattacacttatttatttttattttgtatgtgtttatgtgagggtgagggtgtgtctgtgtgagtgcttatgtgccatgacttgtatgttctaggagttggctctcttcttccatcctgtaggtcctgggcatcaaacaggttgtcaagtttaatcgcaagtgatcttagccactgaagcatctcacgagctggaggtttgagtttcttaccctgcccttcaccctgtcctgtgcaaagggtatgaaatgaatgtctcagaaggaaaacgccctctgttaaagattctacaggcctggtggactgattagaagttcatggttgtggagttgggatgttgcagatacagatgtcatggactatcattagcctccttcaaagccattctttgcccgattgtctatctgacttaatctccatgtgactaccatgtgaaaactttggaaatgtactgacagacaactagctttcccaagccaaaggctaaggataccatctgataccatgaggcctacagcagaggttagcctcagtttgctggaaacacctgcctgatgtttccactaatgtattgaaagattatgacttttcttttgctactataaaaccttcataacatggttatttcatttgtatttgcaataccctgaagccatgttccctcataaagtcttaattctctttgaggtaagagctgtttttgcttcgtcacaggtaatagccattcaccttgtacacacatcctggccccgtcctgcccttggcatagagaactgtttcccaacaggctctggtcaggtgatctcaggtcaacaccacctgcttgctcttgcctaaacctgctgagaggaatttgcacagtccagagaagacaagaagttagtctctagtgggcttcaggaggcaacagagtccacagagggcaagtgttacagtgggtagcctgaagttgactttatgcaggggttcttggtacaacactagactaagtc

SEQ ID NO: 35697 - DNA, 2864 bp, Mus musculus
cttttgctttctcatcacatgtattccattagtccttttcccccttcatgaccttctttctagactcatgccctacacgcatacacataggattttaaatctaggttttaggagccaggctttaagttgatgagtaaggattctaaaaccatttttggcatgtacactgagcaggaagggagcgtgaacagttagagtaaacaagaaatgttaagagtgtcatgtgattgtgatatatcagggcctacttttttttctttccaggctgaattggaagccaagaaagcaaaaatgaaggggaccctgatcgacaatcagttcaaataatcaagatctttctgggttcagactggaggcagcagttagatgaggaagagtagcttcaagatgtgttttcgtttctgtttctcccagaagggttttctgaccatcctattggttttctgacactttttcttttcttccattgaagtccttgactccatttcacttgctttctaggaggtagattgtttgtaaaatctctgtatatatgttttctgtctttcttgtctttgagatcaggtcttgttacataccagagtatggccttgaactttgtgagcctcctctcctgtcttagtctctctctctctctctctctctctctctctctctctctgctgaagttccaggaccacaccaccacacctggcttctgtagcagtcctcttttcttttgacgtatacttcttttgcaatgtagctagtactagtaagcatttgactttctctagtgtctgacatagatgtcttttcttcttcaaagttattgcagtttttaaaggttttttttgttgtttttttttttaaatatggtatgagaggaaggtgaccaaaattaagtttaaaatacagccaggtagatccttttaagaaacactgtctctgatctttgaactgttcttagaattgactatggtctatggtttgaatctttctcctatcagtagagatcagttagaaacaccaaacctgcagaaatacttccttactcaaaatcttagaattctaggtgaaccatgctatgtcagacttcagaataaaagaaggaaaagccatgtggctgggggtgtagctcagtagtggaatgcatgctaggcatgtgtgaggacagccccagcaccaaaacaaaaaacaaacaaacaggaaagccagatcacagatgcagggctaggatggctcaggtcggatttaaatatggccttgctaagtaacccaaaggagttagtcagtcagctgggagaatactctatgagtacacagaagggggcatagtgagaggagcttatctgttgttgggcatcttgttttatgtttgctctttgctgaagagcgtctgaaatgtgtcattctccttcaattatgtcagcatccatgtgattcttccatatagttctctgtttgcctgtcttgcaaggcccaaggagacactgaatgtgttgtcttcctcgtgctatctatgatggattgcactttttaaatactcaaggcttgttggtgaggtgttgccaggaaatagttttcttcgccttttttctgatttctgtttctgcgggggaaagccacttagaggagaggtacagttgagctagcaatgactggactgatgtgggttagcgatcctgggaattggaagaatggggctatgttaccaccttcccagttattctgtagacagcagggtcttcctatagctaagtcttcacctcattttctgtcctagttgtgagacagaattaaaattaacatttgtgaatggtcaaatatgtccaggcaatgacctctacctttccgccactttatccccaaattcttatgtgtacagcttggatatacacagaccaccatagaaattcaggcttctattctctggccacagcctgtagctgtttctagtctcacaagctcccatccttttagacctttttaggtgtgactttcgatttgaggggtgattattttgctaataataatgaaacataattgtcgtaacagtaacattaatactcattagtctccattgagtacttggttggagaaagcactttagaggtatgagctcacgcttagcacctcctaggagataagttaactgttgccatcactgttttacaaagcactcggaaactcggaattttcctttcccaagatccactagcctttggtaaagccagaagactgacttgaaaactcaagctctttcctatgctgaactgctgcttctatggaattttgtatcattcgattagaacataatttcattttgaaaaaaaaaaaaaaaaccactgaattgcaatgtaaaaatattaagctagagaactccctaaagcaattctgtagttatgcttgtacatattttatgaaataactcgctctaaccatttgaatatctgacacaagttacacattttactgcttctaacaataatgaaatattacgtcattagtagcaagtaagtacatacttctcattatattttactttctaccagaagttattagaacaagatgtactttctctattctttattaacttccagtgatttttttttagcaaatgtgttttaatattaataaaaagagccatattgacatttgggaaagtcataagtctgcaagtgatcagctgtgagaaaattatgaaaatgttataaaatattcttactctaatagttggtgacatttggcattgtaactatcacttaagaaaaattaaaaggctttttaaaagctaacctgttttgttgggggtgctgacatgtatgaatagttctgagtgtcataccaagcaaaactctcttcaaaatgaaataaaataaata

SEQ ID NO: 35698 - DNA, 2304 bp, Mus musculus
ttgaccttctccacggagctgaccaatgatgaacggaagcaaatccatcagattgctcagaagtatggcctgaagagtaagtctcatggggtgggccatgataggtacctggtggtaggtcgaaaacggcggaaggaagacctactagatcaactcaaacaggagggccaagtgggacattatgagcttgttatgccccaagcaaactaagattttactaagttgtcttataaatgcctcatgaggtagatacacaaataacaaaaaaagctatatgttctggttgaagagtattcattcttaagatgtttcaccttgttcatttcatatagtgctttattaggtattggaacctagagaattctgtccacttgtattcttagcttaatccagcagatgatattgtgcagttactgtttgtgtctttgatatggctctgttccctcagattttagtagtttgtacaagtaaaaacacccatctaagtgcaatttcaccctgaggcaaatacttcacattataaagggcatagcacagccatctgcaacaatatgtaaagtcaatgctgactcttaactacgctaattccagatttacttaacatgtcaggtcattttgtatcaccaattttcatctttgtgagaagccagttgtagagcatttaacaataaattgtgctgtacgtgtaaatgtctttatcaactaaatgatgtaaaattttctttaaagtaattttagtgtgtgtttgtttataacttctaccctgtgatttccaggatattggaagtgatttactgtatcttgtgacatatgacttttaaacaaattctagtcttcatgctgagagagcactactgagagagatgtcgaaaagtttccaaaaagccttgattcaatcagaagaaagaaagcttgaactgtttgttcttggtgccttgcagagagactcagagcaactctccattgtagctttcacatggtttgtgcaccacacccaaggcaaccatagctgtggtagagcttggtaaaagactgaagatacactggtgctttgatgaaaaaggtcagttggctggttcccctctcaaaaagcttattactcccaaagccaactttgtaacatacttaaaactgctattttcgcttatttctggaatgtaaaaatgtataaaaataagagttagtgtatgcttcctgaataaaaaggagccaaagttgatcaaaattagtgctgtaattatttctggagagcagcctagtagcaacactttgggtttttgaaagtgatgattgcacaaaatgtttcagttagagttagagcacacacagataaatgtaatgatttagcaaatgggagcagactctgtcactcatcacattttggggggtgttttttttccttgaatgccaatattctggcttatcaaatctttgggtgtttagttttatgtggttttattgtatcgtaaatgaatcaactaaaatccagcaatacagcaaataaatattaatatttagttaactccagagaaatgatggtaaggactcttaggctgtttgcaatatcttttaaaaaaagatttatttttttataatgtgtggatgtctgtgagggggttatatgcatgtgagtgcatatgcccatggagcccagaagtgtcagttggagcctcctgatgtgggtgctggaaactgaactctggtcctctgaaagagcagtatatgttcttaactgctgagccagctcttgagcacccatttgcagtgtccatgtttggcatacaagtggttcaccgtacatggtaaattcctttttgccctccccttttctatttaatgctaaaaggctagagtaaaagactatttaaacatatcaattagcttttacacctggatctcttaacttagatgcacctctattggctagcacagtacagcatcagccttctgcttgttttccataccatagtctacatacgaacgttagttttagtaaaagagatgtacattttactttggtgcttaatactttagcaaaagcagagaactacgatagaattttgtgattataattatttttttgtacctgccaaaattcactcccattttggaaagttgtggttcgggtacttagaacactgtgtccttggttctgagtgacaaaaggtgggttttagagactacaagatatggaaacttggtttgcattctcgatgtacgtcttcctcccagaatgttttgttgttgtttggttttggtggaaaaatggtagaaaatccaaagtcaggtttgttgataaaagtg

SEQ ID NO: 35699 - DNA, 1200 bp, Mus musculus
ctggaagtggagaattgcaggaaaccctatgcctagaggcgaaacaaaatgaagccagccacctcgggaacagaaagccctaaagcaaaatctccaagtatctcagatacactcagtaatcaggagagccaggctactgagtgaaggctgtctgggtctcctagagaaaggccccttatttgtacccatggagttctgtttgtttttaaaaaaacaagttcttactatgtagccctggctagccttgaaatcacaaaacagaccaggctggcctgaaattcacagagatttgcctgctggtattttgcactggcattaaaggcaaacaccaccacacccagctgccttaggggggttaatccaccttcccagactgcctgccagcctgaaagtaccaccttccttaaaaagtacttgtatttttaaacgaggcctttcatttgcatctgtatatacactccctacttgagcctggaggatttcagaatacttcacaagtatttgagctacacaaccctctaaaagcaagcaaaaactgtatataaagtgaggagctttttgatcagcatggctgatataccccaccccatgctataggaggatagtgacacgtagagaaacgaagggactcatccaaggtcccagcgctattccttggcaagcaaaatttccaatttcctgtctctgggttcctaatccttttcaccaagcaacccaagtatttatggttttttctggagacaagatttttttcttttttttttatgttcagagaaaccagtgttagatgactcttgagggtttttatgtagaaaaataggatagggtgggtaggcacaggtgaagagaaagctccaggccagctgccatgatgctggatgatcagttagctgtaagtctgtaagtcaaaacagaaaatcagatcctgtaagtctgaaccaggaccaggccagtgtacatttcactggtgcactgtgtaatcagggaactcaggtagatataaaaagcaatggtacctattaaaagatgatgctaaatttcattgagaagttctcactgtaaatgagacaaacttttgtctgtcttcacttgaaagtctttaattagtacaattgttactatttttttaaaaaattactctaagttccctgtttacttctggcaaaacaaaaaacactcattagagaaatggtctgtgct

SEQ ID NO: 35700 - DNA, 1541 bp, Mus musculus
ggtctcccccaggcaagggaagcgcctttctgagttctttctgtggtgtgggggatgcaggcccacatgtggtcagaggacagttggtgggaattggtttttcccaacatgctgggattaaagataagcattgcccagttttgggattagtaaaaatctgggtgtggctctgctggggcaaaaagtgagcctccttgttcttaatttagccacttaagcttgatatcaacaacccactctagccttacattcgagttaattactatcttctgtcttctggtatggtacatgtatttagagactttacttgcagtcaggactagactttcaaactttggttcccccccacccccatagagtgctaaggaaagctttgaagcactaggcagcggaccttagatgctttaccgggtagtcttttgctttttgaaacagtcttgtttagcccaggctggctaatctgctccaaccttccaagtaagtgctgaggttacaggtgtgtgccacctttataggtaactttgaaagaaaagcaggtagcaattacagtgcttcattttgtgggagtactgccattatcctgctgaaagaaaagccatgttggttgtttctgatttttgcttttggggtaaaaatcgtgacaccttgacatgaacagttcagagactggttagcttagctctgctacttactgtaagtccttttatgctctagcaagcgctttaaataaattctcttgttcctctgaaagtctgactctgctagaggagcaggtttgttgtgaccaacccaccttgtaactggtggcttctctttgtacaggtacaactctaagagaagacactggaggagaacgaagctgggtctgtaaggattcacacaatggcaagactgaggatttatactgaattgtcatcaatcagtcctaccagatggatttcaacatttaaacctggagactcttcgtgtcttgaattaggatgtttgtccagtaataaaatatagaacctttcaaaatgcttttctggtttataaagtactgaattgcccttataagacccgataaggcttcttctgtggggtaaaatattgtttcctaggagctagagattactcagcagataagggtacttggtattcttgcagaagtcctggtttttggatcctaatactcatagtttttgttttaaaccttaagattgagtccacatgtttaagccacagtgttagtgtagaggtcaggacaactggagtcctctgtttttacatgtgttccaggtgtttatggcaagggctttaccaacagctatctcagtgaaagcaatcccccacttttgcatagtggctttttgtttttgtttttttttttccaagacggggtttctctgtaaccctggctgtcctggaactcactctgtagaccatgctggcttcaaactctgcctgcctctgcctcccaagtgctgggattaaaggtgtgcaccaccaccgcccaacaaagtggcttgttctaatcccttgtgttatagattgagctcagg

SEQ ID NO: 35701 - DNA, 1541 bp, Mus musculus; identical to SEQ ID NO: 35700

SEQ ID NO: 35702 - DNA, 1441 bp, Mus musculus
tgccatgcactaggcacttgtttcaatccctcctgccaaaaaaaaaaaaaaaagtttggtttttttgttttttttttgttttttgtttttttttggaggagaaaggaaaggggaagttattatgtaacatatatccaggtctttggtctggatatatgagtgcataatttagggctgcggaatctggcccccatgttaaagcagaataacagtgttataacataaatggctttttttcctttcaggatcgtccagccatgcagctttaccaaccaggagctcgaagccgaagccgactctgtcccgccgatgacagcatcaagcctggagattccccagtggacaaaaagcaggaaagtggtattagccatagaaaagaaggaggagaggagtgagaagtccaaatggtcataggtgtcctgactgtccaggcagccaaagagcacgtattatgctatccagaagtgccttcagggcaaaggaacagagaacaagaaaaggggtcgctgtgctggtgggatgtactacagaggagtgtgtctaagcagaataagattgcaggctcagaaccgaaggacaatttcattgttttctgcagtttccacaagttaattttaatgtctcagaaaaagatggtagcaagaacattgcaagtgaaaaatgtcaaataagggcttaactttgtatgacagctaaaaagagcaggttcgaaaatcaatgggtgctcttaatcctggcttggagcatcttcgtttgagtggagcagaaacacactaagtttcgttgggatctaactattttgcattgttggtgttgactgttgactctgtagtgtaggagcaatgagcatgtaattgtagcacaagtagagcggaggatagagcaaattatggctgatggaaaagatttaaatagtcacgttacatctatatcctgtgtctgaagttttcataattacagcttgttttaattctgtaaatgtagcatcaaaaattccttgtaaacatctcgtttttgcctttagcgttttttcctattactaggtaaaatgtagcccttggctagttactgacaatctagtctttgttttatcttaggtctgatgatttgagtgcataccctcttccaggaaggaagctacaccattatctgttcctgttatggcagctttcagtcttagcttgtttttgtaatgctgtcaataaatttccacttcgttccggtttgaagctgcgtttatttattcaagtactgactcatatgtggtactgggggtggaaccaagggcctcaagcatgtgatgtgtgtattctactactgagctataacctctccagccccatgccaagtgaggctgttagttttaataaattaaacatttcattctgacttaagttcttgggaattttgaaaggggataaatgatattaatttctgcctt

SEQ ID NO: 35703 - DNA, 2420 bp, Mus musculus
tacttaccattgttctttcagtggctaggatgtagctcagagttagagcacgtgcttatgaggccccgagctacatccccagcagtgcaaaaaagttccaaatgcagttttgggagtctattgtgccaatataagaatactatttctatttaagctggtatttaatagaggataatatcttaaaaatgagtattaagagtgctaataagggaaaatataataagtcagtattttaattaagctgtttcatgatgatgatgaaagtaaaatattaaacattttcaattatgtcctttatattaccagatttcttgtttgagacagagtctcactatgtagccctggatggcctagaactcccagagttccccctgcctcagcctgccaggtgctaggattagaggtgtgtgccactgcacctcactataggattttattttaaatattgttaagctcttcagctttttatatctgtcatgactttaatccttaactttctagaaaccctccttacttcattactgtttgaaagtttaatatatgttctgagaaaatgtgtttctaacccacaactgctgaactaagcagcagttagcatgtagtaaaatctgtgatctttgaacttgaaattatttcatggtatttatacgtctcagtctgataagtatatagtttcctaaagtctaatggaaactaggttccaaagttgaaagtcttcttaatccatacacttcctcatgtaatacaatgtaaagtttataatcgctactttaaaagttaaaacgaagggccattattttttgttaaatggctcctagcaactgggtgaatatgtttttcttttttttaataggaaatgtagtttcaatgcaacaattttgtagtgtataagtattacagattttcttttgattattctccacagagtatatacagtcaatgaaaaaataggaatttatttaaaaatctatcattatttagtagcagtcctttaaaaaatggagggctaaaagtattttatttttagcttgtttgaattatcccttcaaactgtgttctttcacctgagctctaagtcagccattgtttgcaaaaacatatctttccttgtctacagaagaagaaacacacactcgtgtacacacacacacacacacacacacacacacacacacttataattgaacaaaacattaagccaggaatttcctctttgttacattcctagtgaacaaggtagtggttatgcttctatctgttttctttatagctctttaggcctgagtaaaggctatgtagaagtattgtaatttaaatattttgttttctaaagagacttactcagtttctcacctcttcgcctgttgtttataggatttctctctttttttatttgttgtacaaagataataggaaaaatagagaaattgctcagtcctaccacatgaattgttacaagtgttctgtgtcccttgtacgtctttgtcatttgaagtgtactgtaaagttgtctttggtattttaaaattgtgtgagcaggcataggagtcccattgggaagttaggaatacatgatgatccagtgtgaagacagaaataaggaagggtggtaacccacccctgcttcattgcaatcatgagcatgatgggatgttcagagtttagcagtgaggtcatctgacagtagaagagatctatgggtagtggagcccttcagactgttagtgtgagatatagaacggttgccagtttgttatccagatacccataaaaatgtctatcaagcctagagctaggcagagagaaggaccagacagctaagggccagtggctgaactttagtaatgttcacaactcgactctgtgcttgccacactccaaaatcttctccagaacagaaaacaacttattgcagaatggataatgaataaaaacaaaaacacagttgggttgtgtgccatgagtttattactcaataaatattatgtgctttgacatgtttcatatttttaatgtgtggattgtaaacatcctcaaacataacataggaatcaaacaactttaaagggaatggactccaacaaaatatgcttggtctcagtaatgtcccgcagccactgttctcgaaatcgaatttctcctggtctgtagaggaagggaaaaaacaacacacatcacacacgaagcttttttttttttttttggtttttcgagacagggtttctctgtgtagccctggctgtcctggaactcactttgtaaaccaggctggcatccaactcagaaatctgcccacctctgcctcccaagtgctgggattaaaggtgtgcaccaccacgccgagtcacacacatcaaaaggttgaggcaggacttccctccttacattcccagtgagcaagattctggctgggttctagc

SEQ ID NO: 35704 - DNA, 1186 bp, Mus musculus
ctatgtcagtcgtgatgcccaatatacagcctgtggcagtactggtgcttggagtacagcttatgccatatatggtgccccatgtatggactatgtcaataatggtgactggtatacagcccgtgcccactcctatgccacatgtgcagcctatggcagtcattgtgctttgggcacagcccatgcccactcctgtgccacatgtgcagcctatggcagttattgtgctttgggcacacaccatgcccattcctgtgccacatgcacagtgtatgccaatcagtagaccctgggcacagcccatgcctgctcctgtgccgcatgtgcagcctatggcagtcattgtgctttgggcacaatctatgcccatttctgtgccatgtgcacagcgtatgccaatcagtaggccctgggcacagcccatgcgcactcctgtgccacatgtgcagcctatggcagttattgtgctttgggcacagtctatgcccattcctgtgccacatgcacagtgtatgccaatcagtaggccctgggcacagcccatgcccactcctgtgctacatgtgcagcctatggcagttattgtgctttgggcacaacccatgcccattcctgtgccacatgcacagcgtatgccaatcagtagaccctgggcacagcccatgcccactcctgtgctacatgtgcagcctatggcagtcattgtgctttgggcacagtccatgcccactcctgtgccacatgtggagcctatggcagtcattgtgctttgggcacagtctatgcccattcctgtgccacatgcacagcatatgccaatcagtaggccctgggcacagcccatgcccactcctgtgccacatgtgcagtctatggcagtcattgtgcttcgggcacagcccattcctgttcccaatttacagcctgttctaatcagtaggccctgggcacagcctatgcccattcctgtgccccatgtacagcatatgccagtcactgtcccatgggcacaacctgtaccagctaagatacctagcataccacatatgccaatgcctaccgcacagcctatgccagtcagggtggcttgtgtacagcccatacctcttacagtgccccgggtgcggtctatgccatattcagtgagcaatatgcagcctttgccagttacaatgccccatgtaca

SEQ ID NO: 35705 - DNA, 1196 bp, Mus musculus
gagaagctggttctgatgaaacttggagctgggcagagtgacggactgcctgcgagggaagcccctgctagcaggggtgcccactgccttcctgtccagcaggcagcccccagcgctgggagtgctgtagttgagtatcttgttacccttgcataaaacttcgctcaagtcgaaaatggtggcagacacgagggtggtggtgaagaataaaaatttttactgaactcttattcaccccagagcctagacccctcccatctagaggttgttctcggaacactcctaaacttttcaccccagaacgtatccctaaactcctcaccctaccctccctaccctcccaactgaaaactgttccaagaacatttttaagataaaaaaccttcaaaatgacaaaatgaaccgagtacattgccagatgaaggacatgatgaccccttagttatgtagaatcctttggcagaaccccttgtcccttggcagaactccctagtgatgtaaacttgtgcttccctgcccaactctccccccttgagttttcctatataagcctgtgaacagctctggctaagggtcgattctcctctacaccactaggtgccactgggtgtatgagtttcgaccccagagctctggttgtctttgtgctttcatgtcgctgctgctttattaaatcttaccttctacattttatatatggtctcagtgtcttcttgggtccgcggctgtcccgggacttaagtgcctgagtggggatctcccctcgggggtctttcagtggtcatcgtgggcgttcgcaccgggcaaggactaggatctggtatgtcgtgaaggtcccagtgcggggaaggcgcagcctcctgctctccggtcaggagtcccacacgcctgttcccggcgctcctcgcctttctgactctcgccctagtagaagctcttaaagagaaaacaaataaatctcttaaagaaatataggaaaacacaaccaaacaggagaaggaattaaatagtggtccaagaccttaaagtggaagtagaaacaataaagaaaacacaaatagaggcaaccctggaaatggaaaacttaggaaagaggtcaggagctacagatgcaagcatcaacaacagaatacaagaaatagaagaaaaaaaactcaagtgtagaagataccttaaaagataattgacacaacagt

SEQ ID NO: 35706 - DNA, 1151 bp, Mus musculus
tctgggtttggtggctgattatgggatggatcgccaggtggggtagtctctggatggtccatccttttgtcttagctccaaactttgcctctgtaactccttccatgggtgttttgttcactattctaaggaggaatgaagtatctacactttggtcttcgttcttcttgattttcttgtgttttgcaaattgtatcttggatattctaagtttctgggctaatatccacttatcagtgagtgcatatctaatgacttcttttgtgattgggttacttcagtaaggatgatatcctccagatacatccatttgcccaataatttcataaattcattgttttaatagctgagtagtactccattgtgtaaatgcaaatgcaaatcaaaacaaccttgagattccaccttactccagtcagaatggttcagatcaaaaattcaggtgaccgtggtttactgtgagccagtgatgtcattctatcgtgcgctcttgtcaagccatttatgtgactttaataagcttagtaactttgctgactgcaccggggcctatcagtgacttatatattgcatgatgtcttcaacttgagtttgacatgtagaatcactttgatttcatggcaattgacagtcctaatggctcagctaatttgaaactaacaactttgctgtgtaaaaggaaaaatagtgttgtgttcagtaaatgtttgaaaaaaaaattcaggtgacagcagatgctggtgaggatgtggagaaagaggaacactcctccattgctggtgtgattgcaagcttgtacaaccactctggaaatcactctggcggttcctcagaaaattggacatagtactaccagaagatccagcaatacctctcctgggcatatacccagaagaagttccaactggtaataaggacacatgctccactatgttcatagcagccttatttataaaagccagaagctggaaagaacccagatgtccctcaacagaggaatggatacattcattcatttttgagacagtgtctctctttgtagcgttaacttcctggaacttgcaccagatttagaccagattggccttgaatatcataaagatcagactgcctctgccttccaagtgctgagattaaaggcctgtgtcatc

SEQ ID NO: 35707 - DNA, 1168 bp, Mus musculus
aaagacagatagcaaggtataaacatacaatgaaatactatttagttttataaggaaggaaatactagggttggggagaccagtcaagtgcttgctgtgtaaacatgaagatttgagtttgataccaagaaatgtggaaggcttggtggtatgtgcttagaatcctagcactggagaagtagagacaggcatattcctggagctcaatgcccagccatcttagcccaatttgtgagccatgggttccagtaagagaccctgcattaaaaattaaggcaggtctatggagatggtttagtggataaatagcttgtatatcaccaagtatgaggtcttcaatttggatctccagtacctacatatggttggtgggcatggtggcctacatgtaattccagtgcttggaagatagaaatggaagcaagccaattagctaaaacagacaataccattgagctctgggttcaactgagtcaccttgcctaaatgaatgaggcaaatagtaactaggaaagacttctgacatctgtacatatgtgcaagcacacatacacacacacacacacacacacacacacacacagagcttaccacatacatacaacatatatacacacatacatatataagttcacattcaaaaagtacaattgaggaagatacccagtgtcaacctctagtctcatgggcatacacacatgtacctgtacacataagaacatatatgtacacatggatacacacagaaatactgacatatgctctaacatgggtaaattctaacgatatgaagataaatgaaataagctagtcacaaaaagtaaatggtatatgattccacttacctaggatatccaagtagtcaaatgcacaaagactgaaaataggatggttgataccagaggctgggaggaggggaagttgtgaatacatataggatttcaaattagcaagatttaaatgaaagaaaaaccatcatcaacttgagaaaggctgaaggaggtcactggaggaagatgacatgggaggggctggaggaaggaaagtgaaggggtaaattatataattattgtttaattaaaaacatattttaaaagctccagagctctatttcacaatattaaacacagtatatgccactgaaacatgtatttaaaatggttaaggt

SEQ ID NO: 35708 - DNA, 1146 bp, Mus musculus
ttagaaaggggtctcggggctggagagatggctcagtcattgaaggctaggctcacaaccaaaaataaaaagaggtctgggatgtaacccagtgatactgcatgcatatatgaagttctgggttccagcctcacaacttaaaagtagcatctaaaacagactacactcaacagaaaaatctgcctatttctccattactttcagagctactatattttaagaaggaattgtttgcttatttttttggctttggcagtttggggtgtattgattatattaaacctgatatttctactgcaagatgaagcaatactgttcgtgttttttttaaggtgttgatttagaatggcctattttttaagggtataatttagaattgtttcccagctttaacttgttcagaaagttaatttatcctgcactaacaaaaagaaaaacccttctgtacacttttgtgcctcagtgagttcaagaattgatatttctaatgcattgacttttcttctcctggtaccaagtgctaactgtggaatctagtggacgctgacatgtcgtctgtcaggtggctgcctaaccaaagctcacctgggatgatcttacaaatgtattgattttgatagagtcttgtatccctgtcggggccatgagtgcctgtggcttctggagtaaggtcctagacactacgtctccttgtgtttgttggattctttagccactgagttactttgggtgtttaatgctgtgcatgtttatgccccacatgccagctttgcacacctgatactagcacgaggcagatgttgaattttctcgagctattttctctctactgagaactgaagagtccaaagatctgttttcacttcagagattttagttaagcctaaaatagtaatcttaagtccaagtcagtggttttcaacctctggattttgaccccattaacaaacccctgtctccaaaaatatttacattacaatctgtaacagtagcaaaattagttatgaagtggcaacaaaaatgttttgggatggggggggggtcaacagaaagggttgcagcattaggaaggttgaggaccactgggctaagtgatgttagtttgatagcagatcccatgatcaaatcccaatctacctctgagca

SEQ ID NO: 35709 - DNA, 1204 bp, Mus musculus
gttcatttccatcatctgtttggttgtgttttcctgtgtttctttaaggacttgtaactctttagcagtgttctcctgtatttctttgagttattaaagcccttcttgatgtcctctaccagcatcatgagatatgattttaaatctgagtcttgcttttcgggtgtgttggggtatccaggactggctgagttggaagtgctgggttctgaagatggtgagtggtcttggtttctgttagtaagatttttacgtttgcctttcgccatctggtaatctctggagtcagttgttatagttgtctctggttggatcttattcctcctgtgattctgttagcctctgtcagcagacctgggagtacagctctctcctgagtctcagtggtcagaatactctctgcagacaagctctcctcttgcagggaaggtgcacagatatgtggcattcagacccgcctcttggctgaagatgaaggcccgaaacagggccagtcccagaagatgtgttgcctctgcagtctgcatgctcacctgcacagactggtccccaagggacaggggacaaaagatggctctctcaccttctcaggtggtcagagccctccgggcagacacttctcctctggcggggaaggtaccccggatgtctggagcccgaaaatgggtctgtcccagaagctgtgttgcttctgtagtccatactctcacctgtgcagactagtctctgagggacccgggacccaagatggctccctcccctgctccgaaagagccctcccaggtggacacctctcctttggtggggaaagtgcctggatgtgtggagcccaaaaaggggtctgtcccagaagctgtgttgcttctgcagtctgctcactcaccctttgcagtctgcgagctgacctgagcagattggtctctgagggacccggtacccaagatggctccctctgacaggactttttgtttgtttgtttgtttgtttgtttaacagtgtttttattggaactcactctgatatggaactcaaaagattctcgtgcctctgcttcctgagtgctttctgttgctcctgtggtctgacacctgttcacaagggtgggtgtttctcagtgataggacactttcttagcatgtgtcaggccctgagttcaatttgcagtgatggaggtgagggtgcaggggtgggggtggagaatctc

SEQ ID NO: 35710 - DNA, 2616 bp, Mus musculus
tgcctttgttgaaatttcttttataagagcatttctgacttttaaatcagcatcttttacttttggatatttctttttgattatactcattatttgttacacactttttctcacctacagcccaggagtgttcgctggatgatgacaccattctaataccaattatagttggtgctggtctttcaggcttgattatcgttatagtgattgcttacctaattggcagaagaaagacctatgctggatatcagactctgtaacactaatccacatgtgatctgttacaaaacaataaagcaagtacaagttctcgcatgcaatactattgaaggtacattagttacagtcctgctcttagattgggtggtatagtagagctcaaattaaaacaaaagaattccaaatactatcaactacaaatgaatcatatgattttggttttcctgactaaggagtttaaaattactatggcaaaaggcatgtacaaaattatctggttctgtttcactggtctggaatttctgaatgagaacgtccagtgtaggaaaaagccggtttcttctgcctgcatgaaattgagtttggccatcctgatttccagtggatttgtacttgctccttttgcattgcttgtgacttttgtttgcaggttgacttagctacttcggccttgttccatatttgacctatgaaaaaggtatcagtagatttgaacagagcccagaggtaccatgctcttgccagtaaaattcttttcccatgtttttgaatacatttgtatttaatgtggctgaaatgacaaaaacaaaggtcctaaattttagaatagatgttatctttttatttaatctttaaaaaaaaaaactggatgtttcaatcttttaaattgcaagacacaaggcaattccaactgggcatttcaatctggttttaggtgctttagagataattgctaggcagtgccaaatgaaggcattagtgctttgtacccagaaattggcctctacatgcagcactaagattaatgcagatttctcttgaaccttccagtcttccttgttggtggtaatgtgctttgttctttcctttttttcctcaagaagaaatgttagtatgtcttagaacctaggtaacgaagtgcacttatgctcataaaattgcttgcacctaatccaaaagtcatggtcttgccttagtccattaacatggtcttcatttccagtttgcattgactgctacagcacttactaatttggcttttatgtttaaatggttctgtgataatcaaaacttaaatagttactgttcgttcattgtggtacttttgtattcagttctgtactcagagatggcaccaattgttcatttactatgcaccacctactgcttatataagagaactaataactctttcagcccgatacttaacacatcatgtattccttgcagcttctaggacatcttccatacatgtatggatgtgtacatacatatacatgtgtacatactggtatggcccagcacatatttcttaagctctgcagccatatatagaaggtccttgttatttggggaggacagattaaatgcctttcattcacaagaaaatgaagagctctctgggttccaaaatgctgatgttgaatacatgatatatatgcacacatataggcacttgcatgttagcatgttcatgtctgtgactgtcttttgagttatataggagtggcagagattgtgtcactttaacttgttgtcgacttagcctgaaaaccttactagttcagaatcatactcctgactgtcttctggagcaacagggaactgcatggccaacttaaagtacttgttataaatgaaccagaaatctgattttaaaatacatttttcattttaattgtttttgcattttgttttgttaatccttaaaggatggattgtgcttttaagaatgtaagtgttatgtatttgtcatgaatcaacaaaacagcttttaaaaaagactaattggaacaagtgggtggcactggcttaatgctgttaatgtttctaaacgattttacatttagattatatatcggattcatattgagatacctccaaagcactgttttatagaaagatctgacttcaataaatatttttgtattttacatgggccagtttatgtaccgctatttacactattatttcctatagacaatacacactgtctttgtagtttttgtatttttgttttgttttactggttttgcttcttgatggtaatatactctgtctggtgtgggatattttccacactttagaatttgtataagaaactggtccatgtaagtactttccatgttttctcttcaaatgtttaaagtgctagctgatgtacgtacgatatctcttctcagatatttgcctgtctgtttgcccaaaattgcttctaaatcaataaagattcttttatttcttaaggaaatttgctcacattttttcccactgcttaaaagtgaagattttgtatattacatgatggcaattaaaaaaaaacttagaagtgcttaagaatagaaagagctagattgtttccagtatatgttgtctgtatgctactcagtcgaaaga

SEQ ID NO: 35711 - DNA, 1218 bp, Mus musculus
tattagtattttgcatgaatgtatgtttgtacttcatgtgggtgcctagtacccgtagaagccaaaagaggacatgagattccccccagaactagaattttagacagttgtgagctgccatgtggttactgggaatcaaacctccatcctctgcaagaacaagtgctcttacccagtcagccatctctgcagccccgtccctcagtttcttggatgctggggttgtaagtgtgcaccattatgcctggcttctcaattactttcataatagttttgagtggtttgggtagaagaagaggatcctttatttttaaattgattttaagtaacacataaaacaaaattgtacacagtaaaatgagatgtcatgatttttggatgcatgtgaataattctaattttaaagaatcaaactaaacattgctccctggtgttgctcatttctttatgggaaagttttggaaaaatcctttccttttgaagtgtgcagtatactgctgctgtgccgtgcagtgtgttggtgttgaagcgtatcagggttgcttactcctaagtgtcctaactgttatttagtttctcttgattggcatgtcttcatcccttctcatgtactctgcccagcttcttgtagccacgattttacactcaacttctaaagactacagcaaaagagagatgcacactcatacctgtaatggatatagatgcaaaactcttagaaccatagcaaattgaatgccacaacatattaaaaagatcatttatcatggctgaggaggcttgacaccaggggtataatctggggaactttatgccaagctttgagatcaagcacaggcaaaacaaaactccagctggttaggaattggaagttggagttctcagcagcactctacaggtagacttggatctgcttggcagctccatttcatgtctaagaagaaaagaatggtggcaaaaacctatgttccttatccaaggtctttctgaaatgaatctttgccaatacttagtcattatcagccgccacaagctttagcatagtgtttgggcttgctaaggcagctagggctctggagcatgaaaggtagccttttgtgtatggcttgaaagcggttgctgaggcatgctggcttggtattcctcttaggagttttctctttagtttgatagcatgtctctacctgtaaatgacactggcttgcttggatagcatta

SEQ ID NO: 35712 - DNA, 2442 bp, Mus musculus
taaactaatttgttgaatctcatgttatttgacttcttttatacttctgatgaccaaatgaagcagtgtaatgggaatagttgtgtggacttttctcagtggttaacatacccattttaaagagtaatacttaacttttaagaagaatgttgttgaattctatgcatgttatttagtatgatgtgcagaaaactctttaagaaagtacctgggtcttcatgattccttttggaactggggaagagatccctatggccattaaaaggggggagggtgattcttatacatcattaataaagcaaaaggtttatttgcctaaaagtcatttaaagatacttaaactgcatgcaaattttatttactgtacagagttctggatgtatttatcaaatagaaaaaccacccttgacttggttgtttacccattttgtggtttcccttgaaaagaaaagtaagttttcattgttgttggcattctgttacactgaaggggaaataatcttatttggaaacaagtttttcaagtagggtgacagttccttccatcgtaccttatatattcgcatcctaaaggtttcccattaggactctgggatgtgtacataagacttagccccacattcactgtgctgattaacaggaacttattaaaatagaaaatttgctgatcgtcttgtactacaagaacatagcaagaggggaaaacccaggtccttttattaaaactgaatacagtatgaaaatcacaggagaccaaaatcaacaaataagttttataagttgcaggagtaaaaatgtaccagctgcttttcattatgtttcagtggttaaatgtttgggtcgtgctgccgtctttaagttgggtggatcgtcaattgtcagaggtttcctaggatttgcattccagttttttctactaaatgatttttttttttactgtcatgcgcctcctgatttggagaaactcaacatatgattctcccttgtcttccttgcacactccctattgaaaacttcaagttctgtagtccttttttttttaattgcttgaatttaagagttctttatagacattggacacttgctgttcaggaagtgtctccaaattggtctcacacagaaagtaaggaaagtattgtttttcaatttcaaactgtgagtaaaagacttttcttcctcaccagaggactctgctttgcttcctggtttctctttccatggaggaaatggatgatggcaaagaagcagactgtttttgtgttttcttttacattagaacttcttcagtgctttctccactagcacatatctttgtctttatggagcaattaggcatactttcagctccgaagacttgggggctcttatgtctgctattgttttcttgaattctcaaagacctgtggctagctatctgtattttttaagttgcctgtttctctctaatgcatcaacttgcacactgtttgactatgtacagtatttagagttaacttcccggttctttctgagcagctatttcgtatattttttccagctcctccctgatttccttacaggagctcttctgacaaggaatgtggctgttatgtttactggatcatcaacatcagtgttgtaattcatccctgtgttggtctctgggatatggagactattacaccactcactagttactcttaaaagaatttgtaggtaggtttgttcctactaggacgctcttgataccaccttcattatcttgaaagtgggtgcctgtcctgaagttcttaattctttaaaaacttgacggtgtttcagctgaaaagctagccagactactaagggaaactgtttatgaaactgacaagtaatggcaaactccattggattattatgagtttcagttgttctgtatcggttgaatttttgtgctcttccctgtgtatgtgtggtggttctatttttctccaataaaacttttattttaaaaaaatgtttctggggaagatatttaaactcgaaatattgtgaaaaaattgtaaattagaatgaatacataaaatcttcctaatgacttccttaattcacatttgacaattcatacttgattatttttatacttctctttgttattttactggtagttttgagatactgtggaggaggttatggtaaaaagacagtaaattttccagtattctcaaagtagacaattatttccactttagaaaaatcaagggcacgtgtaaatatgtttccttcaaactttcaaagtcagcaatttcctgccagtatagaagtactttagagtgaagttggaagaaaaagaagacatgcttcttgtggtgcttgttgttctgttctgaaccaaaaatccagtcacacatgttcaatggtttctaattcagttcctgagtctgctgaatggtgactctgccgtaaccttgacatctttgctac

SEQ ID NO: 35713 - DNA, 1118 bp, Mus musculus
agctccttgggtactttctctagctcctccattgggggccctgtgttctatcctatagatgaatgtatccacttctgtgtttgccagacactggcatagcctcattgtgtcagcaaaatcttgctggcatatgcaatagtgtctgcgtttggaggctgattatgggatggatccccgggtatggcagtctctagatggtccatccttttgtttcagctccaaactttgtctctgtaactccttccatgggtgttttgttcccaattctaagaaggggctaagtgtccacactttggtctccgttcttgagttgcatgtgttttgctcttttcattcttacaagtggttacagatcatatttgatgcccacgttaagttttgcgttttagtttctgatgtaaagtttttgttgtattaccttgaaatataaacatgtaaacatctttaacagaatgtggagccgcttttaccagcaagcttgaaggaatgttcaaagacatggagctttctaaagatatcatgattcagtttaaacaggtaaaggctggttaaactctcttacctaatcccttaaacttcaggatacttcagttatgtccttgcggcagtttgtattgaagaagaagataaatagaagcccatatatatatatataaacaaataattcatggcaattcaaacagtacagtataggaaagagatcatcaatgaattttaagtatatttagcttacttcaggatttagtcataattaacatccagaataagacagaaacataagtaaaaatgtattacactaaagttagtattagaagaattatacttagatagtaagagcggggcttttctaatcagttggaggctttacatgttcaaagcttgtaatggggatagaggtgaggtgatcaaggacaggggtggtatattctgtctctcttgacatttgggatgagaatttggatctatagttttgaagacctaaataggaggttgttttaaagtattgtaaaaatataagcaaccagatgtaatttgtgtaactagtctcagctgcttggaatgctgaaatagtatgtgggcaatataagtgagaccttgtctcaaacagtagtggcagt

SEQ ID NO: 35714 - DNA, 1099 bp, Mus musculus
gagctgctgctcactaacgttttgctcttttatttttcttgttactttacagtaaaagtcttgtttgttttatgaaagtaagatagcataatgtcttggtccttcagcaggtgcttagcatactttattaatggggaggggaattgagagagtagtagaggcagagagagagaggagagaagtagaggccacacatggagagaggggggaatggggaggaggggaagaggtgaggggacagagtgggagcaagaaggtaagagcaagagcctgattttagagttttgaagccatttatgaatgaccaaataagctgctcaatgccagtatagtggaaagtattttgtctttgaactaattttatttctaatttcactaagaggaaataagacactaaaacctagttatggaagaagccaggaattcagcttcagttctcatttaagacaaaatgggtttcctatatgctttaataatgttattcaaaattaaatgtggatttttttttataattactacttcaaagtctgaggacccagactttgataagtcagcctgtgcacatgtggtattgccaattcagatgatacttttttgtttttaattttagggacatgggattagagttatttagggctcatattataagtgatcaaaaagtacagacaaaaacgattgatggcatccttctcttgattgagagagagcggaatggtgaagcaattgatagaagtttacttcgaagccttttaagtatgctgtctgatttgcaagtaagttgtacttaacactcactgtgctacctacaaatctgattactgttcatagtttgtctgcaatccatggagtgttgttcaaatggagttctgatggaagtcattcagtaaatacttaatgattaagcaaatacttttgttttcccttttttctagatttaccaagattcttttgaacagcaatttttgcaagaaactaatcggctttacgcagccgaaggtcagaagttaatgcaagaaagagaggtattttaaaatgtttaatgactccagtgtctcttacaatagccatttccttgtagaacacaaacttccctttgtat

SEQ ID NO: 35715 - DNA, 1136 bp, Mus musculus
ccattgactagttatggtgaccttgggcgagcttagcaaatgagttccaggctcactttcttcagctgtaaagttggggttgctaagattccctgcgaatgtgttattgttgagacaatttctataaagtttctgaaatacttttcatatagtgtgtactcagtattttaaatcttccctacaagattcatgtcagcttctgttttacacgtgataaaacaagatcagaactgctatttttatctgtcattctcaaatttttatatttgaagcagtaacaatcaataggagaaaaaaataccttcaattttcataggtgaatcaaaataacagtattttggcatcttaaattttgtttatattgaacttttaaatatcacagttaccttaatgttgaggtattaaaaggatcctaaaatagcagtactgttctattttatagttctttggttactatatccttaatatttttctaattttgtttgcatattatttagataagcctaaattaccagaaaactatacggatgagacatggcaaaagctaaaagaagcagtggaagccattcagaatagtacttcaattaagtacaatttagaagaactctaccaggtatgtattagtatgtaaaaccacactttaccaacataagctaagatggaatgcatttgtattttcctttttttaaagatttattttgtatgtgcatgtgctagagtgtgtgtgtgtgtgtgtgtgtttgtgtgtgtgtgtgcatgcgcacacaaaacatgtgtgcccttggagaccagggcttaggttccttctaagctggagctataggcagttgtgagctgtctgacatgggtgctgggaatcagatttggaaagagttctcttaactgtcccctgtattttaacgtcctgaagtacattctttagtagagttttgatcacttactagttaaatggtgccttctttttttatgatcataacacacagtattacttcagctggggatccataattggacagttctgataaggctttattaatattttggtatagtagaggtatgacccagactgggctgttatagcatagattagctattctttttctgtgggttgtcatttctgttgcggtagctcttgt

SEQ ID NO: 35716 - DNA, 1123 bp, Mus musculus
ttgaccttgaattcctgatctgtctccagtgttgggattatagatgtgtgctgcacaccagctttagaatcactgtaacatgaatttcagaggtggttatgtggcttagtagtgaagggcttgtgtagcatgtgtgaggccctgggtttgactctgtagcaccagaagaaacaaatagccactaaaaggtatcagatcaagcaaacttacaaatcccacaaactgccacagagtctgtagtttaggcaataacataatgacagtaaatttcctacatgttactcaatgattatgaagtatcaagatactttcaattgtgtttatcatgaatgcataaaaattcataaagcatgtttctgtgtttttttttccttctgcagtgagaaagtaaacaaaggaattggcattgaaaatatccattatctaaatgatggtctgtggcatatgaagacatataaatgagcctcaaaaggaatgtgcatgggctaactatggatactgtgctgtatctgtgtctgtgtctgtgtgacagcatgaagacaaagcctctatgattatgctgaataaaaattccgcggatgcttaatttctgttagtttcagaaattattttaacttttcttaaacaaaaattataatgtggtagcaaacttggctattaaaaggtatatggtaaataactcaacagatgactcaatgtcctatttgggctaatggtataagagggcttggtaaacatgttggccatatttatggtggactcctagatagtttgtctagttatggagccagaagctagatttagaattttattccattattcagagcacccataagtgttccctctgtgtgtgtgtgaatgtgtgtttgttgttttaaagttcactttggaatgttccaaagggagtgtaaaatctgggtgtagtataatagactgtccttccttcatcgtctgtttctctctatgagcactcctttttacccctgcctcagctttcctcctattccccagttactgtgaagcaaaggttagcctactcttttacctttaactacttgtatatgtatctttaagaagaaaaatagcctttaaaaaatagagctataataccctgaaaatgctt

SEQ ID NO: 35717 - DNA, 2625 bp, Mus musculus
gcatctaacacattgcaatcctcctgtctcatgctctcaaagttctagggttataagtatgtttggtacattgagctttggaatggatttccagttgtaaccccaaacctcagtattattgaataagactgtgtggacactattgagatggtgtggataacactgagtatctttccacttgctcttgtacttgttgatttgtcattccagggtgtggacagacccctaagctgaacgtttcccgaggaggatgccaaagctccatgagtcactctcagaatgacatctcccatatttaagagcttctggtgctgtccattttatgggaatctgctttaagtcagaagatgcatacataccaccatccttttgacaagacattccaaagtcactgattttcagaacattattttcacctgcaggcagtttcttggaacaaggtccccgtgcatacaattttatgtgggacacaccatccagaagcagcatctaaaggaaaattcactaactgacttttagttcatctttctttctcagaaaggagaggaaattgcctcctggaagcaattccttaatgatgtagataggttgcctttgtgtgtgaattctgtaagtgtgaaaacattggggtgattatgttgcttggagggttttggcttcttataaaattttaattccaattcatgggaaagatctttgtgttttaacagcaaaaacatttttattatttaatatgtacccttaaatatgtcatcaaaagttttcttgtccttaaggaattctcatagtatgacatgatcataattgagaccccatttcttattctggttattgtcatatagataccatgatgttctttttctttcccatttcttattttcatcagcatggtcatgtgaataccatgaagttctttattgaaacatcattcattttcagtctaaaatcctgagatatagtcaacattttaaagtggataattcagtggtctttagtacattgactgtgtggtgcagtctaatctcagaacgtgcaggttagcagtcattcttatttctcttctttcttcagccactggaagctactgacacattttctgcctatgaatttgcctgttttgggacatttcatataaatggaattgtgcaatatcatgtcctgggggccagggttctttcaactaccatcttgttatcaagagtcatccatggtatagcatgtgtcaataatccattccttcttaaaggttaaatattccatagaatgaatgtgtaccatattttgtttacccatttattcattgagggacagaaacaattacactttttaagtaataaaattagaaggtcaacatcagtgtatccaaaattataattgatgatgtcaagattatacatggtatgcacagaatgctgtgtagaaatgatgtgtaaattatttgtcagcatttcatgcaagtgtaattactttctaaggcccttctagctatgatttttttggaactgtgtgaatgtagtatattcattagtaaagtttaatgcattaagcattaatttaaaatttgagaacaatgttaggcagataaattatttgccacatgctgtaatggtcatgttttgaatttatttcgttatgcagtatttgaaaaatgtctacataaaggaaaggaaatgagtataattgagtcaatatatttttaaagcaatttttataatttagcagacattgcatcttaatataattcactattaaaatgtgtccttgtggaaatatcgatgtcattttctttctatttcttttgattgatcttgtaaaataggttcctttcctttgttaaatgttctgtttatttttgatacattattctttgcacctgtagaatgtacctgttactctttaacctttttctctaccccagaatccttccatcctctcacacatagaaaatgtttcaatgtttcttaaaattcatagtgtctgaatggtttctaagaatagacagagacacagaaatatttcctcattttctgggaacatcctccaggtctttgttattgatagaattcactgaagtttcttccccctttctttcccctccatcactccctggccttttctctctggcctgttcttgccttgctttggccttcctcctcattttccctcagccactccttcttttgtctatctgtataaccagtttgtttcttttaggtggaaaaaatgaaatgaaatcatacagctgtgacctgaattgtattttcctgagtagatttctgagaattgtgaatgaagcgggcccattttcagttacctgctttattgctccatgcagaaaacctaaaactgttgtgttgtatgttattgtactttaacttgttgcttaatttctacatgtttattttcagtaatggctgaaagtgttaattattccatattttagcacaatgtgctgcatatacttcccaataagcaaataaggttacatttgtacagaatttcacttttgattaaatactgcctgggtttcaagtcccttcccccatttgaaatgcttcctttttaatgttgaaactgaaaataaacagttactgaatgattttgaatttacctcatcttagaact

SEQ ID NO: 35718 - DNA, 1144 bp, Mus musculus
atgcagtactttgtttcgtttgaagtttggcttttaaaggtaaaatatgtactttttattttggtggtattagaggtcaaatatggggtgtagtttgctggacaaactttgctttactgcagagcacccctcctcctggtgttttcaatggagtaggtatatattttaggtatatttataaattcaatggtaaacaactctgtagtatgaatttagagcttttaaaatactaaagataaaaaaatatttgttgctatgtgactttaaaatgtatgtaaaactcaggtattcaccttttaaaattattgggcaataaggcaaacttatttagaaagaattcatatatatgaataaactagccttcttatttatagatgtactaattgagcaatattctgcattttatatatgcaagcttcttgtattaacttatgaaattttaatgatctatttttagctccttcctgctgataattgtattatggatgaatacaaacgagaaattgtggaagctaagcaaattgtaagaaaactcacaatggttgtgctgtcttctgaaaaacttgatgaacgagacaaagaaaaggacaaagatgatgagaaagttgagaaggtacatccctcaggccagcaagacttaccttgtttagaattatgacctttcatttctcatggttaatcaccttatggagtatgttctcttaattttgattatgtgcaatttgatttaggtattattcatttgaactttaatatgaatgataccttcataaagaaaactctttttcttatgaatttcaaaataaaagaaaaaaaaaatcacaaaatattgattttatttttctgtttatatactttctttttaatcctaaagggattctcaaagatgaatgaattctagtgtctcttgtatggtatagcattaagtccaacttaatttcatatttataaattataatgcatatgtatgttctaaatgggaaaatgcaacaacaacaagacaataaaacaaatgcccaaaagatcatattttgtttttcaagtcactgaaatttcaggcaattactgttaagtttcctaactttttttgatgtacagtattatgatacttaggtcaagttttaaagagaaatatctgtattcc

SEQ ID NO: 35719 - DNA, 1668 bp, Mus musculus
ttagagcatgtgtttggcattatgtgaagcccaaacactaaaaaaggagaacaaacaaaagcgcagactttaaaactcaagtggtttggtaatgtacgactctactgtttagaattaaaatgtgtcttagttattgtgccattatttttatgtcatcactggataatatattagtgcttagtatcagaaatagtccttatgctttgtgttttgaagttcctaatgcaatgttctctttctagaaaaggtggacaagtcctattttccagagaagatgacttttaacagttttgaaggaactagaacttttgtacttgcagacaccaataaggatgaagaatttgtagaagagtttaatagattaaaaacatttgctaacttcccaagtagtagtcctgtttcagcatcaacattggcgcgagctgggtttctttataccggtgaaggagacaccgtgcaatgtttcagttgtcatgcggcaatagatagatggcagtatggagactcagctgttggaagacacaggagaatatccccaaattgcagatttatcaatggtttttattttgaaaatggtgctgcacagtctacaaatcctggtatccaaaatggccagtacaaatctgaaaactgtgtgggaaatagaaatccttttgcccctgacaggccacctgagactcatgctgattatctcttgagaactggacaggttgtagatatttcagacaccatatacccgaggaaccctgccatgtgtagtgaagaagccagattgaagtcatttcagaactggccggactatgctcatttaacccccagagagttagctagtgctggcctctactacacaggggctgatgatcaagtgcaatgcttttgttgtgggggaaaactgaaaaattgggaaccctgtgatcgtgcctggtcagaacacaggagacactttcccaattgcttttttgttttgggccggaacgttaatgttcgaagtgaatctggtgtgagttctgataggaatttcccaaattcaacaaactctccaagaaatccagccatggcagaatatgaagcacggatcgttacttttggaacatggacatcctcagttaacaaggagcagcttgcaagagctggattttatgctttaggtaaacttcaccagacaattactttccaaatgtcacagagctcctgctcttttagtctttagtttgctcattctctggattcatgttacatctttaatgtaactactgaatttatgttaaaaggctatacttttatgagtcagatctgtgttcaagtaattcttggctgggggaggttagagttgagagaaaagatagtatcaatttctgacagatagtggatctattagtaataaataccgtctgccatttattaaatgtctactctgtatgctcaaaatatttactacatggattttctctaagcttcaccacaattccatagaaatagttaaccttagagaatttggttgattcttggtaaatcgacatcaagcttagcatggtgccacatacctgaaattccagcaatcttagcagccgaggtagaataatgagcatgagtttgagggcagtttgggctacatcgtgatgccatctctcaaaaagccaaccaaataaaaattaacgtctgccttta

SEQ ID NO: 35720 - DNA, 3529 bp, Mus musculus
tacaagaggagaagctttgcaaaatctgtatggatagaaatattgctatcgtttttgttccttgtggacatctggtcacttgtaaacagtgtgcagaagcagttgacaaatgtcccatgtgctacaccgtcattacgttcaagcaaaaaatttttatgtcttagtggggcaccacatgttatgttcttcttgctctaattgaatgtgtgatgggagcgaactttaagtaatctgcattgcattccattagcatctgctgtttccaaatggagaccaatgctaacagcactgtttccgtctaaacattcaatttctggatctttcgagttatcagctgtatcatttagccagtgttttactcgattgaaaccttagacagagaagcattttatagcttttcacatgtatattggtagtacactgacttgatttctatatgtaagtgaattcatcacctgcatgtttcatgccttttgcataagcttaacaaatggagtgttctgtataagcatggagatgtgatggaatctgcccaatgactttaattggcttattgtaaacacggaaagaactgccccacgctgctgggaggataaagattgttttagatgctcacttctgtgttttaggattctgcccatttacttggaatttattggagttataaatgtacttatatgagtatttttaagtgatttcgtcatctcctaaaagatattgaatggtagactaccatctaaccagcatgtactgacatggaaaggcaacacagatatagttaagtgtaaaatacaaatggcaaaacactgtatctagttggagccaaatcagcttgtgtgtattttgtatctgtacaggacaaaaaggtttgaaaatataagtatcacactcttaaatgtattttttcttcagggggtggggggtgggtcttagaggggcttatagagcccttcactttattttttcatttttttctgtttaaaggttttataagtatgtattacttttataatcagagttcttagtaaatatgttgctgatttaaaggcttaggcatgttcaaacgtctgcaaaactacttatcgctcagttttagtttttctaatccaggaaggcaggccagttaacttttctggtgccaatgtgaactttaaatgtttttattttacctgctttgtggatgaaaaatatttctgagtggtagttttctgacaggtagatcatgtctttttatcttgtttcaaaataactatttctgattttgtaaaatgaaatataaaatatgtctcagatcttccaattaattagtaaggattcacccttaatccttgctagttgaagcctgcctaagtcactttactaaaagatctttgttaacccagtattgtaaccatctgtccgcttacgtaggtaaatgtagacgcctggtgtatatggcttgtagttttagtgttggctctccgtgttgagattctttctcagtgtcattctgtgtcctacaagtttcatgtaggtttcgatgttaggatggttaagatgtatatagtacaaaatgttcagtctttgattgttttatgtttgtttgttttcatgactagtaatggtagtggatactttaaaaatattttctgaagatccttaaaaccttggaaattgtaacatactgagaagagtggttgtttgaatatttttaacaacttgtataagtcaatatgaatacaatcaaaagctaaagtgcttcatagaacacgggatttaccttaagtaattatcatgagagacctcttgtaaagactggtctattttactacagagaacagtttgagagtgaaactgttacaatttagactttttgttgtattttctaagagaaagagtattgttaggttctcctaacctctgttgactactatggtaagtgatgttattttaattgcaaatttaaatagaaaccaacagaattaagtaactgactgtctctctctctctctctctctctgtcttcttcatgaaaatccttagttctgtatactgccttctgcttagatttagttatatgatcattaggttacatttgatctaagttgactaagatttcaatttcaatttatatttcaagcattctgccagggaatagttttaaaaattgtttccaaggcacttcaggtacaagtcatataggtagtttgtttaatctagtccttagcctaggactcaaggactgaatgttttcaaataacacttttcttgttctcagagcctcagttcattaaaactcttttaaaacctgtgtgctgagagttaagcaagacctcttttcttgtcttcatgagttgcgaaattgaattcatggagctgatgtggctaacaagtttattttaggaattgtttagaaaatgctgttgcttcgggttcttaaaatcacagcactccaactctaatcaaattattggagacttagcagagctggtctgaaatcacactaaaaaaaaaaaggtactggatcctttccagtatggttgtgtaaaaaatggtcactcggaaggtcacagaataaccggctctgaatcaccacccctgagagagttcagtgtctgcgtgctgatggtcttttgctgtataaagttcattctagaattttgaagtaaccacccgttttactacatattagtcatgtgaattttgaagttattttgtaatagttactttcatttgttatttactgtgttgatcaagatgtgtgtgagtgtttagcatttattaaagtattgtctttcctcctagacttttgcctcttcctgtagttaggggtagaggtgaggtgagtggagtgactacaatgtgattcgctggggtaggacagtttgttgtcttgttagtcacagtgtgttgctctgttttttattttagtaagatttatattttgagctctctgaatggaaagtgccactgcaaccttagctgcatgcattgttcccattagacctaagtcttcctggacttctgagtccccagatactggataaaggaagaggagagatggagtagcctgtctgtcactgctatgagagaagcaagaaagtgggtagagaaatacttcacattttagtcacatcttctctttttaaaaaggtagccatcagtgaaggaaagaactagtcaaaaataggcttgacaacctgaattcagatccccagaacgggcataaaagcagccaggtcatggttagtgcactcctttaatcccagcatttgggaggcaggggtagacatatctgggtttgaagccagcctgatctacagagtgagttccaggacagggaaccctgtcttattcataaaagaaaacaaaacaaacaaaaagctgagcgcactagcccaagcacctgtaatcccagaatgcctacatgaaacaggaagtagctaggagaatgccccaaagctcatggtcagttaatggcttatgtattaatgaagaggcaccatggtaaacaaagtgggaaggtgagagcccaccaacatccacaagt

SEQ ID NO: 35721 - DNA, 1118 bp, Mus musculus
atcagagctagaaatgaccttagaaagtcacttattcacactaccaccaccaccttcattttattgttgaggcaacttaaaggaaaggtgattggcccgaagctatatagctgattagtgatagattccttactggaagtctcaggtgtttgtcaactcttcattctattacactcttatcagggcacagtaagtggtgctttgtagtttctacagtaagacggttgctgatactttcaaattaaacaatatgacagtaatgcttgagtggtaaagttctcttttggaggctgaaatttgcagatgtgagtacagctgtttggcatttactatgtgcttatgtattattaatgagcatttaagattactctgtaagtatattttatcactgtctatacttaccaacaaatttgcattttgatgtaataatggctttcgtgtaatttctgttttggcatttttgttatactttacctgaaaaaaaaaaagaccaattcttttgtcatgtgttgtactatatttgtgaatataattttatgactcgtttatggaaactcctttatggaattgctttctgctctataatctgtcatttgttgtagattaaagcttatttttctgtgaataagacttattcaataaagcactattctttaaaatgttatcttctttgtatttgatttgttttgttgagaggatctcatgtatcaacccaggctactggccttaaattccgtatggataagggcggccttggatttcttctgatcctctctcctctacttccttagtgctgtgactacccggtatatgaagcattgagaatcaaatccaagacttaattttttatttttattcattttattattattattattattggttttccgagacaggggacagggtttctctgtatagccctggctgtcctctatctcagaaatccgcctgcctctgccttcggagtgctgggattaaaggcgtgtgccaccaggtacccttacctcctggaccacacacaggcacataccccattctgtgatacactgcacatatcagccaggtggtatgtccatgactttaatcccagtactcaggaggcagaggcaggcagatct

SEQ ID NO: 35722 - DNA, 1159 bp, Mus musculus
tgctctttcagaggtcctgagttcaaatcccagcaaacacatggtggcttacaacaatctgtaatgggattcaatgctctcttctggtgtgtctgaagacagctacagtgtattcatataaatgaaatgaatatttttttaaaaaagaatggtttgaatacccagtgaaattccactggagaaaaggaaattttcaattcaaagttgctgtcaattggaaatagcttccaggttagggatgggggcttatttctacttccctgccagcactgggactcagtactgtgcaggccctgtgcatgctgccacagatactgtgcgttcatacatgcacatgtcctattgtgtctagaaggtatcttctatcaccactgggtctcagtctttctgctttctcttccacacagttccctgccccccccccaacccccaacgtgggggatttgatagaaacatcacatttagaactgtgcatttcaaggtctcttattctctctgcacattttcaacgtgtttctctgtcttcgttcccatctactgcaggaagaagcacctttgatgatggcttggcaagacactgatctatgagtatagtagaacgtcattaaaagtcatttcattgttctattccattagcagcagagcagcagtattaggtgcatgacctgtctagtctccggttcttgtccacccgagcagtgtcagtcaggcatgtgtttcatcatgtgcagtgggccttaaatattatcagatagtggttgtttgtcctacaagctctgtgccaccattgcaccagtgtatcttgtaggcatgtcaccattgaagatagaggggaaccacttgtacctgggttgttgtttgcctttttcctctggaaacgtgctgagtgctttccagtgtcatgaacactagtcagtttggatgaaggctctaggtaggtaccatgttcaaggagaaattgttggtgttgtctttagcaatagggtcttatcattagtttgtggagagaaatcaatagccttgccaataaatagcctgctttccatggtgcccctttggccaataactcaattagatataacccattcctgtaccagaggtttcatttggtagcatgagatgtgtagttggggctttctctcctgatacttggtgatta

SEQ ID NO: 35723 - DNA, 1191 bp, Mus musculus
ttatataaatgtttttctttatttcagttatcagcaaaccatgctcatttttgtatatcgctgaattcaattttgtagttgttggtattctttctcttttaatgaaacatacttgtctttatagtttcagaaatgaataatattctccaaattctttggtttcatgatgaagctcaacccttcaaccaatttggagaatattattagtctttttaaaatcatagtataactaagaattaagaaaagtatatagtctttttaaaatcatagtataactaagaattaagaaaagttcgaaataagcaatgtagttagtctttttgtaaaataacttttaaggtaagcggtagtataatggttgcctttatacagcacagtccagcagctctctacactttaatctgtttgttcccccgaaccagattttgttttaagattttaacatggtccggacagatggtttgttcttttgtcctgaggctggtgtgctatttgtctaagaggtttcccttttcaattgtagttacacgagcatgcagcttaccttgtggacagcatgtgggattgtgctactgagctcctgaaagactgggaatgtatgaatagcttgttattagaagagcctcttagtggagaggaaggtaagggcatctcattattttcttctttgtccgtactgttttggaatagatcttgcaaattctgcacattcttattaatgttcattttctatcattgtttttgggagtgttgggaaccaaactcaaggtcttgtacaatgtggaacgaaccctaattctgaaacatatttcctgtctcatattcacatatatgaatattgtatgatgtacaaagatttaatagctatcaaaatttagtgtttttagccaggtttgatagtgcgtgtatacacacacatacacatatatacacctatatatcgtgtgtatatgttgctcaagttcatactttcttttgcatatatatataaacagcaaacttaatcagaattctgatatttagaaaggtgagatttgacttgttctagtcttttctgtgataagaatggattctcttttgtatatgaggtcagtctctgtgcatagacagaagaaacttacataatagttacaagaggcatatatcgaaagaaataggttaactctttctgattttcttttttagctctaa

SEQ ID NO: 35724 - DNA, 1153 bp, Mus musculus
tagggtttctctgtgcagccctggatttccagtaattcactctgtagaccatgctggcctcgaactcacagagatccttaccttgagagtgcaggaattaaaggcatgtaccaccacctgggcaattattttcatttttcttaatatgtaattaataattcatagggagaagaacctgatgaagatgacgcatatcaggtattgtcaacattgaagaggatcactgcttttcataagtaagttggatctgtgagtttttgatatatagcaaaataaccttgtgtattttgtgtgttattatgctttcaatttctcttcctcctcctcctcctcctcctccaccaccaccaccaccaccaccaccaccttctcctcctcctcttctttttcttcttctttttaagaaggcatgttatattctgaaacaactatgcttaggcttagtttttaaaatttgaatgttttgttttttgttttttgttttttttacagtgctcatgatctttcaaagtgggatttgttcgcttgtaattacaaactcttgaaaaccggaatcgaaaatggagatatgcctgagcaggtttttatttatttctgtgacatatctactggctatgctgcactttgacagtaaaaggttgtgacttaatttcacccctcatcctgtatttctttttttagattgttattcacgcactgcagtgtgctcactatgtaatcctttggcagcttgctaagatcactgaaagcacgtctacaaaggtatgtggtatttcagccgcgttcttgctaactcgtacccctgattttcagcccttttagacttttagcaagagcaaagtcagcgaagtcatacgtatttctactttactctatgtagtcatagttctagtttgcatattcaatgaaacattgatatgttttatgtcaagggatgattttgccggatttaaagtttgttcacatgaaaatattacataatttgactctgtattcttaatattgttaaattcttaaaatatgtgaaggtaatttttaaagatttatttatgtgtacggatgttttgtctgcatgcatgtttgtacaccagaagagggcatcaaatcccatgaaactacagttaaagatggataattgtgagcctttgtgtag

SEQ ID NO: 35725 - DNA, 1127 bp, Mus musculus
tcactttggatcaagtcttagaattacttagtaagaggatatcaaaattcaaaagtttttgctactttatgatgaaagtttatgatgtgaagataaatcacttggaggtaaacagcaccatggctgtaactcatgagacccagcaccgcattcatcaccagcaccacaaacagagcagagttgtctaaaagcatgccttgactttttctttccttgttgttacatgtgttcatacccaattaatattggctgattcgtatttggataaaagtaacccattaagtttaggacaccaatatgatttctccatttaaagtatattattgtgacacagctgtgcctattcgtatcttgtttttttgtttcaagtgtcatcaatgcagtgtatcatttgtcttttatatttcaattagaaaatgtgcttaaaatatgttaatttatattgtttctcttctttttccaaacagctttttaatgagatgatacaagagaatggctataattttgatagatcatcctcaacatttagtggcataaaagaacttgctcggcgttttgctttaacttttggacttgatcaattgaaaaccagagaagccattgccatgctccacaagtaaacactctccctaatactttattcattgcttgtattttcaagaatcttaattttgtgtccatccttttgtttggaatacctaaataagcttgttttattattggcttataaagttcctaagtttaaagaccattgtaatgtggtccctcccctgcacttttataaatatacatatgtgtctatgtgtgtacatgggtacacttgtgcaaactgaactcatgtcgtcattcagaatactatccatctcctttgaaacatggtttgtgcctggcctggagctcaccaattaagctagtgagccctaggattacttgtgctctgtcacatgaatcgcacatacttattgcttttacttattttatctaattctctccacgtttaatttactttcttacttcaccttgttgtatgccttttagtatataggttataattttaggtgccatttaaaagctattcatagagtaattagtgtaagaagtacatttttttcctgtgctgtcccccc

SEQ ID NO: 35726 - DNA, 2666 bp, Mus musculus
ttatgtttgtgagttaattgacaccttaatgaatactgctgttattttattatggattaatgatcattttacttttgtatttatatgtttgaagagatgttttcataatagttttattaatattttagcataacagtgatgaagtataatatttacagatttttattaagaaatgtgaatgactattttaacgagatttttttcccctctctcattaggttcttggggtgtcaatgttttaatcccagtacacatttaaatctgtggtgaagtcgttttctaagtggaagaggaaatttgaaaataaagtgtggtagatacagtgaaattctgtacagatttttctctaaggagaatataacatgcttatgcttaccaagatgaagtgcattgaggggcagttttgtttgcctgaaaaaataaaggacaagtaaacaatttgatgataagctacagtttttcttagaaagtaaatattttatttatgcgctgttagttggcttttaaaggaattatttcatgcttttttaaaaaatataacaatctgaagaagtatttggtacagataagaatcttctcacatttatttactggttgtactaaataatgatgacctctgctggatttctgtttacatccacgaaacaaaagttaaggatggatttattccccgaccctgaaattgtaggatagaattgtttttagcattctaaatttaaatgcttaaaacatcaatcaacaaaactttgttttaaatgttgtaattgtggaaaaaaagttaaacttataagcagaacttttacaattttttcatctaaaatgtattttaagatatttttaaaatccaagagcttctgtatacttttcagaaatatccagatgcagtgaactgccagaaggtaaccagtcttgaacatgcttatcccatagcagccctgaacgtttgcttgtcctttaagataaaaatgtaacgttgtgatattccttccagtagtgccactgtattttgtctccaaataaaagaagcttattgtagtatgtttgcagaaaatttaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgactgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaagtgaattagtttaaaacagaaagtggccacttgccattttgacatcgactcattttgcgaggcttaggcagctagacatcgtttaaaacaaaatattaacttatattacatgtatatctatcttttgtcagtcgtctctcagttcttgaggtatattattttaatcattccatgccttaatatgcttgcaatacaagaatatcttcagatgtgtgaataccaaaaggtttctggtttttcgagtcaggaaatcaacaagcattgggctgtggtagccaaaaaaccataggttaaatgaacgaccacaacatacatttgttttattaattaatggttaacaaataaaaccagacttgtctaacatactttccatcaacaaccattgttacgtgcaaacatattgcatatgttccttcacacaccactgcatttcctagaactgctgagaggactgtatatatgatttgaaacctaggttgatttcttttctcactcttgaaaggagtatttctttgtgaaagcagttcttccagctttgttttgaaccagctaaactgttttctatattactctaacctgttgtcctccacattctattgtcctaattgtactgtttgctgatttgtatttatgtcttgagacagtaactttttgaataaaaataaacctaccgtgtgttgtatgctttatctcttgtaatcaaagggggagggtggtttcaaatgctttacaaattatatttattatcacactctaatgtgtttgagtgggatcatttatagaacacatcaccagtttatatttttaataaatcacatatattttaaatgtgactaaatccctagttgggttgtttaaaatagaagaagcctgtagctcttactgttttcattttcatctggtgtagattaagcacactttgaactgtctaccttgttcatttaggatagatttaaatgccaactgtgtcagatgtatgaaaaacgtttttctatcacaattcaatgtaaaaaacacaatcattaagtttgaactaagtgctagggcaaaaatctagcaaggagtcctgatttaagaaaatctattttgggtaatgggctcatgatgtgtgaaagccagcatttaaaaaatatttattactgaaaattgcgtcttctgtgtgataaaatttgcattgcacgttttaaaaagttaccactgtagatg

SEQ ID NO: 35727 - DNA, 1219 bp, Mus musculus
acattgcagttacaaaattgcaatattcatgctgccaagaaaaaggaatggagcccaagtagtaacgcctgcaaagtgaagtatatattatagctagccgcaattgcaactctacaactctttgtttttgttgattttaaatgtaaagttgtgaatgacattaacacatatgaattctttggatttaaaatgcttatagaatatacatgacatatctaaataaatttcagttctattacagtgtaggaccaaactaaaaaataaacaaataattattatataactagtagttaaaatcccatatataaagataaaaagcatttttaagaaagaagtgtattagatatccccaatttggaattatattgaagacatgctcacttattggcttattttgttccattggtgccttggctagtagcagaaatacaagagggattgagttgattcaagtcttcaaagattaggccttaccatgaagacatcttttaagaaatgtctcatcgtttctcagccttttggctaagatcacgctaagatctgtttttattagtttaatatctgatatgtcctctatctgaggacaatatattaaatgggtttttggaagtaggagttggaataggagcttgccccacccacgccacgtattgacctggtattgaagtacctccaggaatggtgcaaaaaaaaaaaaaaagtcttatatacattgacatgaaattatcttgaatccagtgtatatccatcacctaaatatgacctgtgttttataggctgcattttaagttttcatctgctttaaaatctctatttatctccattttttcattttgtgctgatgacagtgtttctctatgatcaaggaaacatagttgaccttcacctggacactcttttttctgttcactggatgagaatttcagagtctaagcaacatctacatattcaacctcttcttttccactaccccatctattttgtagcctataatatcaaaagagaagcatccatctactgggataagtctgatttttctcccacatcatcttttagccttgactttgatccctactgctttttaaaatcttctataactgtacttcctgggactaatgattccagaggtttcagaaaatatttcttttgatttccaataactttaagcccagttaagtatcatacccatgatgctatatgaggtatcccacttaatatc

SEQ ID NO: 35728 - DNA, 1462 bp, Mus musculus
ttccatgttccagtttgcctacttttggaaatgtgtcattcatgaattgtgatcatggtgtatgtatatagtttgtatgttgttggtgcgaaactcacttttctaaaaagtttattatgtggaaataattgtcgtagaatcttgtgtttctatcaaaaatctcagatgacgaggatggtttaggtattcaagtattctgctcatttgagtgttgaagagtaatccaaaactcagtgtttttctttcaagccttattttcatttttagtctctgtcttcatattgatcaaagagtgcacttgttttcacttcttgccttagtactatcaagacttgtggatatatttgaatgctgtcatttgagtaaatttcacagagtttcagtgccatcattcgacacagggatattaagtacataaatgtagaatgtatggcagacagggcagaaaatatactgctctaaggtatagactggatatttttgctgttgctatttttaataccaaatgttatatttgagcatattttaaactttcaaaatctgcttgtgagttaaattgaaagaaaaaaaaagtgcaaaggaagaagtctgagcctatccagctcactgtgagagaaactccccctttgtaagctccaaatgtttattttgtgaacttgaaagattcatacttcaagtagaatagatctgttactaaacctctggttctatgtcttgaaatgtgataatatgggatcttgacaatgcagtataattttcaaatagaggagctggggattaaaaagataggtctgattaaaggactgtgcagttcagataaatagagataatgggatgccgtgcggatagattggttttctccctaggtgagaaggctgaaaatgagaaaggagccaggccttgcttaaagctggttaggacgtgttaaccctggattggtattgggtcatgattcctttttcttaaacatcaaacatgtattttgcattggtgttgatacactacatgttgttcagtcctaaacctaaattgttgaaaggatctaaaggtgagtcaagaatacacaatggtcagatttttggtttataaagattatgcaggtctatttcatagaattataaagttttgcaactaatctgtgcattttcttgcttgcatgtatgtttctatctctgctgcaaatgatttaaaagcagagattgtaaactgccctcttttctttatttgtatactaaggccgaacaaaggcaatcagtgattatttgatgatttttcttttgccaatggaaacctgcactacacattgtaataaatatttgctgttgcataataaagaaccttgttctgtgttccccacctctgtttttctttaaaatttccctaattcatttacaggtcttgctatatagtactacatccattcatcaatgaggtaatatatgatgcttaaaagttgtgtatg

SEQ ID NO: 35729 - DNA, 1125 bp, Mus musculus
tatgcagggagcgactgagcccccctcagtcttccttgaaaggctcatggaggcttataggagatataccccattcgaccccacgtctgagggtcaaagggcctcagtaattatggccttcattggccagccagctcctgacattaggaagaagttacagcgaattgagggcttgcaggattacaccataagggatgtagtaagagaggcagagaaagtgtatcataggagagaaacagaagatgaaaagttagagagagagaaaagagagaaaagagaagaggaggataggagagacaggaggcaagaaaaggttttgactaggatcctggccgcagtaggagaaagaaataatggaagaagaggtagacagtcagggaacctgggagacaaaaggcagcagggaccaaggagacccagagaaggcgggcagcgtctggagaggaaccaatgtgcgtattgcaaggaaatgggccactggaagagcaactgtccgaaaaaaaaaaaaaaaaaacaagaggtaaaggtgctttctcttggggaagatgaagactagggggaacggggctcggctcccctccccgagcctagggtaactttaaaagtggaggggacccctgtggactttctagttgacacgggagctgaattttcagtactcaaaacacctctaggaaaagtaaagaaaaatgaaaaaaccttggtgatcggggccaagggacaaaaatcgtatccatggaccacatcccgagtagtagacatagggtgaaatcgagtaactcattcgtttctagtcattccagagtgtcctatgcctttattggggagagacttactaaccaagttaaaagcacaaataactttcacctctcatcgaccggaggttttctggggaataaaagcgccccagactctagagctgtctttacaactaggggaggaatatcgactttaccaaaataaagtaaagccccctgagggattacaggactggttaaatcgataccctcaggcgtgggcagagacgggaggagtggggatggcaaaactggtcccccctgtggtgattgaacttaagtccggggccacccctataggggtccgacaatatcccatgagcagaga

SEQ ID NO: 35730 - DNA, 1142 bp, Mus musculus
aatttaatgctattttccaatgactctgtttactgactggtttctaattctaattctgattttcagttccctctacttaaaacagagatcaagcttagatatggactatgtttccagtatttatctataaattaatgtcgataaatttaagccaatatactagttgataatcacaaaattaggcttcttcctcggcgctgcctacgaggtggctgccatctgttttgtggaatcatggctgccctccggcctctggtgaagcccaagatcgtcaaaaagaggaccaagaagttcatcagacaccagtcagaccgatatgtgaaaattaagcaaaactggtggaaacccagaggcatctacaacagggttcggagaaggttcaagggcgagatcctgatgcccaacatcagttacaggagcaacaagaaaaccaagcacatgctgcccagcagcttctgcaagttcctggtccacgatgtcaaggagctggaagtgctgctcatgtgtaacaaatcttactgtgctgagattgctcacaatgtgtcctctaagaaccgagaagccattgtagaaagagcagcacagctggctatcagagtctccaatcccaacgccaggctacgcagcgaagaaaatgaatagatggcttgtgtgcatattttatgtttaaataaaatcacaaaacctgaaaaaaatcacaaaatttgtcattttaaatttccctttaacaattatccagactgatcacatgaaagaatgattatgcatcacttaatagcaagtgttatgatttaaaccttcagatgattgttctgcaaaagacaacaattgattaagacaatttggggcattattacttaaacatttttctttgataatttccaacaagaatatattgaattctggtctcattcatcatcctacttttgcttctcctttcccaataccaatcctctcttttcatctattatatattcaactttcatgtttttttgctttgtttttgcttttgatttgtaaaacattcactggtggctacatgactaaagacgacaatgactacttctcttcaagcaattctcaactgccaatagcacgtccacatctatgactgaattctaaagtgttcttttacaatttct

SEQ ID NO: 35731 - DNA, 1145 bp, Mus musculus
agtgcaccatatttcatcaaatctatgatgctttctgttgtaagacaaaacttttttgtgctactaagagatatgatgccaagtatcatctgttatcagttgtaaaatacatcctgatttcagaggtgctaatggggaaaagaaatgtgcatcatagaagatatgaaatatggtgtgttaacatttaccttaacgttattaaataacactcacaaataaacatttcctcagaaactttaaatattaagtagttctttaagataaaagtacatttataagccatgtgtaagtagatacttgatgactatttttgatggatattttatgtcttttcataaaaagaaacacctttaaaagttattttacattgggttatatagtttgttgggctatatagagcattaactgtgagtctaacattgaagtgaatattcatgttaaaaattttaatgcatttacatcctagatttaacattgttgggccatttaaaagtgtgcatattggagcagaacattaaatctgtttccattttagtcacagaaaagaaaagcagagtcagctactgagagctctggaaggaaggatgtcaagaaggtgaaatcctaaagcctagaaataaagttttaaatgggaaactgctattttcttgtccccatcttcaaatgctaattactacttccagtgtattcatggtactctaaggaaaaaaaaaaggaatactctttggttttgatttcttgcatattttatatattttacaatgctttctacctgaaatgtgtagctttctattttatgcattctagtattttctgtactgtattttgtgcatttcatgtcttcatcaaattcctctcagtccttgtttttttgaagcttgtgctgaggttttagcttttctatgttttctatgccgctgctttgaaagagaacctagattctatagctgtattattgttgtttcagactttacatttatatggctgtggacaaaatgaattaaaacgatttgaggagaaagactttctcacttctttgttgctttcttttctatggagtctgggtttgtgtgtgtgtaactgcatactgtgattagcataatcattgtttctttgaggtcatctacatactttttcctaaggaa

SEQ ID NO: 35732 - DNA, 1163 bp, Mus musculus
tgtttaaggaatgaatagaagggaattttagagtcttgcatttcatacttgggagccaaattcattcgtgtctgcataaaaataccagtctaaaatgagaaagcagaggacatgcacacaaagggtatcaagggaacccatgcaggaattgtgctatctcttcagctgctagtattcttttggctggcccaggaatgagtctttttactcatttagtaacttacatgtatgtgtgaaagtagcagcacccttctttggtcaaagacatgaaactgtacatgaaaagctaatgaatgagttgtctgattcattgattcaatgcacaggaatgtctgagatatgccaagctctacactaagcactagaaatactgtaacagaaagatagccacagtcccagccaacaacaagttcccttcggctgtaagttcttcagtctggtgttcatacagggaaggtatgtaacttgcagtacatgctcttaaaactgtgtttaggatatagactattgtacattctttacgtgtgtgaggcagtttgggtgttcaggtactgatcacctttcagcccttgagcaacatctagcaatcatgatgctaagatcgggtggactcgatgcagcaagtctgataaacacagattatatttgtgtagcaagacagcaatgttttgttgctagagattaggcattttggtagctgttcgttgatacattcttctgtgttctaggttaataatccagttgcatggaaaggaacaacatgttcaagatatcattcctataaatagccacttcagatgtgttcaaggtacttgctttaatgacttagctagttttataaggcttctccttagccgttaatgcagtgtataatgtcacacatactcacatttgtcactgcatgtaaagtgaaatatattactcttcacagaaaagttaacacttctaacctgccattgaaaagtgttgtgtttaaaagtgccgaagaattatattttaaaatacagatgtatatatcacctgtttccctgagtagagctggagatttgtgtaagtaatcttctatgctgatttgacatatatgtggatttaaagtactgtcttgggcttaaccaacattatgtctgttatgaaggatttatacacatttggcaccttttttt

SEQ ID NO: 35733 - DNA, 1219 bp, Mus musculus
gcacctcctacagtgggctgagccctcctacattaatcactagttaagaaaatgctctacaggtttgtctgcagcctgaccttttggaagcattgtctcaattgaggtttcctcttctcagattactatagttttttgtcaagttaacatctcataccataaaaccagcgcaatgtgtatgttgtactttgtgctgatttcctctggttgctctggtggaagcacggagagggcaattagttggactattgtgggttggaatttagccaaatcggtgctgtgggagcccagaggtaaggcagcagacaataatgatgacatctgtttgagaaagggggaagtgaaagcaagaagggttccagggatggcaaaagaagggattaatggggccaaggttcctcaaagtcaaaaacaattacagaaaagataaggagcaagtatattgggaggactactagtcacagtgaaatgtttgatttatgttgcatgttaggggatggtacttctgtgatggaaaaatctaggatattcttgaaggagtcactgcagagggtgaggcaatggaggctgaagtggagtgggaaggccactgggtgaagaaggtgaaggtggtaactggattctctgtgccaatttttaagcgagaatgactaatggcaggcatttgagtggaagtagagtcttatgtagtaggcattggattctgaactctgaggtttgtagagagtgatggtcctgtagaggaagaaagagaagatggtatagcccagtgaatgagcctcagaagaaagcagtttcctgacagagatggagagggagtactctataggaggtattgaactgcatcatatttaagccaagcatgatagtacttgtctatagtctcaaatacttgagaaactgaggcagggggatcacttgagaccaggaattaaaatccagtctgcggaagaagtaacctgcttggaaactagtcagtttgcatttgcctctgatttataatgtagttatgttagaatccctaacaagtatttttcttaaattaccagtgaagtcaggtgtagtggcagctgcctataattctatcctttaggagcctgaggcaggaacaaaggtttgaaatgagcctgggctacatagtgagacatttctgggcttcctctccagatagtctttttattgtcgtgaggtggggcacacatattagtatgccctaaaa

SEQ ID NO: 35734 - DNA, 2616 bp, Mus musculus
cagcaaaatccttttagacatatattgccaagccaaagttaccatatttcggtgtttttgtgtttactctttgtaaagcaaagaggtctgtatttacacacctttacctaggggtatgttttctgccctgcttcccagtcctcatgattatctttaataccctaggcctggattgagaggccttcctgttctaagcctacaagtactacttgctatagctcagacttgtctacagttctttgtatgatgcactttggacccaccctctcctcatgtcactactttgcacacttcctccatgctctcactttgaaggaagcctggatgaggctagtgactctgtgggtgtcctgaacagtgaagttcactgtctccatgtgattgttacaagcgtttgtgcagttctactacaatgatatctgtatgtcactgtaatgttggccttcgtggggaaccacacttggtggagcccgattcccttgtctcagaccatggttagttacataattttatggactatagagatggcgtcccactgatgtgagaaacatcacaacagcgaggaaagcactgtgagtatatcagaatgaaaacatccctgcttcccagtccccgtgcccggctactatccacacttgacatgcggagcaatcctgcatgttggtccccatctcccccactagaaacccacttccagagtcatgtttgcatcacagtcaaaagagaagtctgtgcacctcaagtgaggtcccaggagctttcctcgccctccaaaccaagcattgagggtaaccctcagaacccattctcctatctcctaaagtgtcggggaaagttactggcctctctcaacagggctcactctgagctccacatccgcctccttcaagcaaagacttaaaaagactgcccttgactccttgacactatatcaagtgctgtgtaagagagactggtccgtgggaccagccacacacattacctcttccacttgaaatgactctaaggttttcattttattcaagctttgtgggacagacaaactttttaaaaattactttgttgactgacaaaccagctgccagcttctggctgcaaaactgcctggtgaaattgacttgcttggtttcattcaccaaaccaacccaagtcgtgtcattcttgcctattaacatctgatgtaaggcgctcatataggctgtgtgtacaatcttgggcactgattccatcagtagtatcttgtaccatccaaggagagggccaggaaaacatccaccatcaaatggttttccagctccctcatctcttcaaaattgagttcttgggagaacaaaaggtatgtatcctgcagtagttaagcccttaaataattgggagttgggaaatcggaatcaaagtattggtgccagctcactgaagatctgattgggtcaacagttgattagtggaagacggagagcagaagaattttgtcatatctattaggccagaaagtaatcactgaagaagcagatggtaggagctggagcaaggtggtccacaggggaatgcctctcctgtgcccattttataatacctcgccaagcttgggtctttagatgagcaagattatggttagtgggggctctgtggagcatgcacgtagtgcccttccttcatcaggccaaagcaccaagttgcttcactgcctcggccttttgtccagctcagcctgggatgtctatagggttgagggttttagacaatctctaggaaagggatacaaaacagatccgatggaagaaacctacttccctatcctgcctatcctgcccctcaacctcttcattcctaattcctccaaggtactatttcatagttgctctgaattaaggatttcaggtttaactggtagtgaaagactgcacctagcatcttcgggaagaaatgattccagtctattggctgatactacattagtttccctttctgattcttaatctgtagttctttgttatatttcacaaaaaaaaaaaatgtctcggtcactacgcaaagctgctagtggggttctgtattttgtgtcatcttttttattataatttattgcaattttatgaataaatatatgttgtgtgaaaactcattgtgatctgactgagaactgaagaggggagatttaatatcacttggactcacttgacatttttgtaggccccacccaaccatacctgtacctgtcactactgagcctacagagaaataccatttaaaattgttgtgctggggctgtagctccattctagagcgcttacttagcatgcacaaagccttggatttgattctcagcaccaggaccaaaaaaaaaagagtgttttcctgggctggtaagatgattccatgggctagtgtcctgagttcaattcccagaagccacatggtaggagggaaccgactccagaaagttgtcatctaatctacacatgtgttgtgacatggccacataaataaaatggggactagagtgatggctcagcagttaggagcacatattgattagttttggttctcagcacccacatctggcagatcacaactgctataactctatgtccaggggagccaagagcccacaca

SEQ ID NO: 35735 - DNA, 1209 bp, Mus musculus
ttgatcttggggcttttgggggatggagaaaggcaaagaaaggaaggagaggtggaagaaggaaggagagatgggaggatgtgtaggtgggatctatcactccaccaagggggtctcatctctcaccaggagccttttgtagcccttccctgaagggagaccctcatcttctctgcctgagcacatgttcttctcagaggcctctcaggagggagaaaagagaagacagaagctcgatattcacttatatatgtgtagggtagggggagtcaggacccccaagccccataataacctgattgcctattcatcctttcccaaagccttcctatctgctgctgctaatgctgctgctgctgcctctgctgccgtttcaaggcccaccctggggagcagggccaggcatagcgtcctcacctcttgggctagaagtgggagctggctggcgcctcttctactgctggtacccctaccagggaccgggccttctccgtctttgtcgtttctgcacctcctgccttatcagcctgccatggccagccccacagggaaagggaggggggaatattggctgagaaagaggagagatagaagcacaagaggggagtaaacgggcccagtgggctgtcttatttaaagtggttatgtgtatttcttatactaatttatatagagatattaaggccctttgagttagagaaactgtccccttcccataagtgtgttcgctatgtttgtaaaaattgttccatgtaaatatgtctttataataaagagttaaaagttgacagtttgcccttactctttgaggtcatattcaggagggcattctttttctcctagggccaatcttgtccctgtgcccacagattgcacgtgtagggaggtgagtgcttgtatcccaaattggttctaggtcaactggcctcaaactgatttgccacaagctcacaaaaagactcgctatgcttaagggccagttcacataaatttgagccccttttaagtcctttggcatctgttcgaatgtcctcatttttctggcagtgtcacttaaaggattttttttccagaagcaattcatttaaggacacgctgatcaaaggtgggatttgtactaaacgctgttttgtagccctggtgggtgccttctgttttatctgcttttgaatactttcgggactttttagccagtttgcctttcttgac

SEQ ID NO: 35736 - DNA, 1900 bp, Mus musculus
ctaggcctttcttgcctctcttccccttactctaagggcttctgtccttcaccaggaagatccacattgtgccacgctactccttgggagcaaatccttccagcttgtcagccatcccaaagcttctaggactttctagtcagaccagcaagccccaactcagttagggaatctgagactgggattctgagctctgctaccagaaggcataggaagatgtgattccttccccatgctgggccccagtcttctcttttgtaaaatggagatgatttctctgtttcctttatattcctgtgccagacatcaacctcttctccatgaatatcactataacattaagtaaccaccaaggagcagggtctctggcaagccccagaaggtagcagaggtctgaaagtggctggatccctagtccacagtgaagctagaatcctggggactacgtgatggcaagacttcatcttttggcagcttagccccaaccctcttccttttgcagctccagtacctgaaccgctactatcagaccattcgtgagaatgtaggcccagagctgcagcgtcgccagctgctggaggagtttgcatggttggagcagcacacggagcccctgtcagccagggcccctcatatcatctcctggacctctctgtgggtggcctctgcccttgccatcctcagctggagtagctagaggcccctgattctcctgtggactgttcacttgtgtctggggattcatttgcttctgctcagctgtcctctccctatgccatacatgtcccaagggctactgatggctcaccaccttgaagccactggccagatcccagacagtatgttctaccttctcccagatgtacatactttatcatgaactcccacccctgggccctgggatatcagagcctgctacagtgagtccctctctcccaaagtaaaggaccctatagggcaacacccagagggctccatcctatccccacctgctggagaaggccagagcttttgccacccacactgactccagacttttaaaaggtgcctctggccactcttacccacaggcctacagtagcctgtctgctgtatttggagaagaaagctactgggtagtctggtctcaaactcccatttgtagtattggggagaacagataagttgaagtcagctgtggcctggaactgaacacctcagtcaataatgtgtacctacctctccccatctgtgaacccgcagcttctaaactaccgctgtgccccttaacaatgaccacattgggagtgaaggctcaggatttagactatggaatggagggaatggcaaggtgctctggctatcccaggctcccctggtgcttggagcagtttaatcttctaaggtagagccgccatggcagtgctattaaagcctctcatatctttgaaaacctcttaaccttgtgtgggcagactctgattcccccattttatagatgggaaaactgactttcagacagaaggtgtggcctgcctgaagagactctgcacttggttaggggacgaggttgggagatgatggggccagatgggttggcattctagttcctttgcccatcagcaccatgccaagcctcttaccctacatctcagcccctgcctcatttattgaacccactgtcatcagtggtttctctggtctggccctgtctagccgttagccacctgggctcacatcctgctagatgcttaaaacaactttgcaaagatgcctgcctctggttttgcattgtgtctgctatagctgtactgggggaggctgctggtacctgtggcttttgtggtgggggaggaagagaagaggctgaggtgggggcagggatgtgaggctcccagaatctcagtagagagacacgtgg

SEQ ID NO: 35737 - DNA, 1232 bp, Mus musculus
cagaacccccagagccaccacaggaggcatccgaagctgagaagtagcctctctatggaagagacttttgtttgtgtttcattagggctatgagagatttcaggggagacaaccacctgagacagagaacaaatgagctgtcccttattactatttttctttggtctttagtcacccaattaccggcatcttcttgctgcaaactttttttttttaatgtttgaacttaagacagtggcagaagatgccagtcacatctggcaactggacaaatgggtctcttgggacatggcactggttggtttcccattgtctcagccacaaggtatccttggactcccctcctcttccctccagatcctagctcccctgctgggggtcattggtctctttctggggctaaagagtctcaagactgactccagtcctttccagctgctgcatgtcccgagtccagaggcagtcacagagacctctggccagggaattctaactgggctcttgactccttcagaactaaggattggagagggacgctggaggattctcctggctccaaagtgccagcattgccagccaatccttttaggaatagggcaggtaccttccacttgtatttatttctgtagcttctcttttctccccccccatctactctctaacatccaaatcccactctttcccccattagatgctatacgtaagtagtcatggtagagataatacatttctcctacgttctccagaaacttcaatgcctgtgctattctcaataagcattgatgagatgccaacaacacagcccctcacactctctgtctcatctcccctctttgctcatgagtccactttcattttctccttttgactcctgcttcagccgggagcaggactagcagtaataaaagtctgcactttgctggtttcttttcctcaggggaagcctgagtgctcacttaaacactacccctcagacttcttgtgtaaggcctacagaggccgtgaatgcacaaatggggaagccaaggcacagagaggctctcctctcctctcctctcctctcctctcctctcctctcctctcctctcctctcctctcctctcctctcctctcctctcctctcctctcctctcctctcttctccccacctctcccctcccctccctcatcatcccctcaaaacaaaagagagagaaaaaaaagactaatcagtacttccattaagccttggc

SEQ ID NO: 35738 - DNA, 1134 bp, Mus musculus
tatttgagatggggtcttactatgtagcccttgctggcctggaacttgttttatagactgggttggtctgggactcacagagatctacttgcttctgcctcctgagtgctgggattaaaggcatatgaccaacatgtcaaactatgttttaattttattaatgtgattattagtcaaatagacacttcgatttcacattcttgccatttttctttttaaaattttcaaaccaacacccttgaagacacatgtacatcacagagttgtatagcattcagtagatgtgtggcagataccgggtgtggtgtgatgttgaaatcctagtctagaagtgtttgcctggaaaagaagagcccttacctctcatggcctgcatgtttggagactttggactcaaacaaagaatagcagtgaattaaagctgttttactgattacagaagccaccaatggtgccgtgccacagggccagcgaccacctcctcgtattaagaatttccagataaacaaccagattgtgaaactgaaatactgttatacatgcaagatcttccggcctcccagggcctcccattgtagcatctgtgacaactgtgtgggtgagtaaaaccaaggggacattgcctgtgggataggctcagctgaacaaagggtctcacagtggacattggctcttgggaaaattcagtgggaatgagaagggagattcagataggaaacaaggtatatttagataggaaggaatctcctacgcagcagcagatcagctatactcatggagatatggtctcaaccaaaaagtctttgataaatggagaacaatacctgtttgggaaatctcagttttcctgtactggatccaagttgggtgtggcccactttacaaaggaggagaacggcatcatccactggaaggcacttctgagcaatgcctatggcagaagtggccctctttgtgttcccactatgtactaggcattgtgctgagtacttttcctttctctcattcaaggctcatagcaacccccagaaatcagtatcacccccattttacagatgatgtcactgaagtgcctttgtgtaagtttgtgtaattggcataagatgatacttgattcggtctgatgcccaagcc

SEQ ID NO: 35739 - DNA, 1182 bp, Mus musculus
agactgagagaattctggagatggaaatttaggaatttggagggaactacagaggcaagcttcaccaacagaaatgaagagatggctttcgtttagtttgttttattgcattggttaggatatccaggacaatttttcacgactgaaacagtgaaagcttgccttcaattcttttggagaaagcttcagcatttcatcattaaacgtttgctctaaggttggcttgtattctctctctctctctctctctctctctctctctctctctctctctccacacacaaacacacacacacatactcagcatatgtgctcatgtcatggagtaggtgtggagatcagaggacaagtttttaggaatcagttttctctttcctcttagctgggcagggtatctttccacctagcggaggcagggtctttctcctttgttcttttgtccctgtgctgtttactccgggctagctgtctcatgagcttccggccagttctcccatctctctcactgtatgagtgctgggcttataagtgactttttaagtgggggcattctggaaatcatgaactcaggtggtcaggcttgtgcagcaagcacttttacctgttgaggcatctccccggcctgtaatatgttcctagattatttttctgtggcaggatcttagaccaatctggaacttactatgtagatgaaactgtccttgaacttgtgatcctcctgctgcatcttctgctaccacatctgactctttcagggattaaaaaaaaagtttattttattttattttattttattttattttagtgtgtgtgtgtgtgtgtgtgtgtgtgcctgcctgcgtgtatgtttttgtactatgtgcatacatgagccttcatagatcagaagagcttgttggatccccctggaactggacttagaggtggttctgagctatcacatggacactggaaatggagccagggtcctctacaaaagcaacatgtgctcttaactgctaagacatcagtttagctcctcttttagagatccttattattagatgggggaagacttcttttatattctcatcttgtcaaacatttccaaatatcatgaatgggtatgaatttttcaaacatattttctgcatttaataaagccaatatttgaatgtttactaaggtttgttaaagtgatta

SEQ ID NO: 35740 - DNA, 1196 bp, Mus musculus
catgtatgtctgtgtgaggatgtcagaagccctagaactggagttagacatgtataagctgccaagtggttgctgggaattgaactcaggtccactggaagagcagccagtgctcttaaccactgagcatctctccggcctctgtgttttctttcttatcccttagttttattttgtgattatatatattactctttaatgacaacttcagcaagaaactcatgactaagttgacaggaatacataagtacactgtttctatcttcagacacatcagaagagggcatcagatctcattacgggtggttgtgagccaccatgtggttgctgggatttgaactcaggaccttcggaagagcagtcggtgctcttacccactgagccatctcgccagcccagatgagttttaatgtactagctcttctttattatttgacattcttcccattttagtggttgtgaaatctccttacaaatgaaattacattggtagtgaacgatggggttcaagtagaatgccatttacactcttggcaaaattaaatttgatccgtagagtctctaatatttactatatgaacaacttcagaacagccagccgactttcctagtagaccattggtatggagtctctgctagactggtctgtgttcaagaaaaaatagtcaaagcaaacattacctaaaccatagatagatacctaaaccatagatagatagatagatagatagatagatagatagatagatagatagatagatagacagacagacagatagacagaccttcttcatatttctctgttttcttaaaaacaaaaaaaaaacaaaaacaaaaaccaaatccagaaatgataagtgtctttttatgtcaggaagttgagctaatcaaagctagataaaattgcattgcttgcagtataactaaacataatcatttcttaaggatttgagttctgttttctggtggtatttttgaagtcactagcattctttttctaggatccttttctacatgaaaaggagatgggttataaatatgccaaagtagcggtggtggcgcacgcctttaatcccagcacttgggaggcagaggcaggcagatctctgaatttgcggccagcctggtctacagagcgagttccaagacagccagggctccacggagaaaccctgtctcaaacatttacaacaaca

SEQ ID NO: 35741 - DNA, 1113 bp, Mus musculus
caactccagctgaagagaattgagacaacgcaggagaaaagcatttgtaaagtgcaaagtgctgtaaaggacataaggtaacttctacctcatctctccttcctttcggtcaccacctgcatttcctgaggtggtccccattaatcctttgtctcaatatgctcttggagttcattagaaattgctgggtgaagtctacacgtggtgatgcatgtctttaatcccagcacctaggatacagaggcaggtggatcctcttgagttccgggctaaccagggctacacagggctacacagtgagaccctatctcaaagacagaaatgggaaaggggagagagagaataaatgatgagtagtatccctactggagattgaagattcacaatgtacactcactgttttgttttgaagcagcatcttgcatgggctagccttgattctttgcaccaacctctcagggtcctggaattgcaggcatgcaccaccatacctggttcttcttttaaaggctgtgagcaaagaatgaatacatctggtggacctaacctgaaccactaactgatttttataaaaagtgaagtgctaggctgcatatcatagctttttcctgcaatcctagcacttgggaaacaggagtgccctgcgacccatctcagaaaagggatcgtttgcctaggcgtagtgcgcttgccttcaattcctgcacttaggagggtaagacagaggatttctggttcaaggcagattcaaggaacgtagggctgggcaggatagcacaggcctgtaatcctaactgtttgggagagcaaggcaggaagtttgaaaggtccaaccagccagaacaattcagcaacaattctgcctccaactaaaaaaggttaaagttgaagatagaaaaaaagcggggggagtaagttctgttctaagcttttacaaaagtaagcaaatgtcgctgtcacctggtgggggcatgctttgggaagagccgctttctcgctccccccttcctgcagtctctctttgccacactgctgcttgtctccagattccgtactccgaagccctcagagtcctcctcctatttgacaacgcattgacataccacattctta

SEQ ID NO: 35742 - DNA, 1187 bp, Mus musculus
ataactttatttaagtatgaagtgaggctagcatagttgcacaagcctttaatcccagcacttgagaggcaggcaggcagatctctgtgagtgtgaggccagcctggtctacagaatgagttccaggacagcctgggctgttaaacagacaaatcctatctcagaaaaagtagcctctgccctttgtttgtttgtttattgagaacttggggtaatctttccacgtagagtttactatacagggaagtgaagccccgtcctggtcattagcagtaacctgggaaataggaccctgtttgttcgtattagaatgtatttcatggtacccagcactcagtagttgcttgacaaatacttgttaactaagaaacttccaagtttcatctctggcagcttgattctttttctgtccccttccttcagattctaccagccaggaggtattatctgaattgagggcattatctaagaaactcagtaaggaaaaccatctatctaagaaacaaaaaaagagtccagcaaaggctgttgacctggtctgggaagaggaacctgccccagaggaagatgagcctctcttgctgcagaggccagagagaatgcgaactctggaggaactagaagagctaggtaaagaggacagccttccaaataaggagcgccctagaccttcagtagaaggggagcaggtgaggaggaacccacagaatcactccaaggggaagaacaagaaggaacaaatgatcagtctacagaacctcctgactacaagaactccctctgtgacgtcactggcgcttccgacaacagtagaggagttggtgagcaagagccagatctttggcttgtggtggggtagttgacagttgaacagaacgggtccttcttacacacagcacagtcagtacatgttggttttgctggaatgtttttcaggagttaagaggtacagatgaccatggcaccatgctgggcccaagtgtagatatgtggacacagctgagccacacgtgctgcctaaatcctgagccactaaagttctttggggtgactctaaacctgccttcaaaggagaaggcagtcactgaatgctctggttggattccaggcacaacaattcaaagatcagtgattgatctgccaaagctcccttcactaaattccagcacccagtgctcagcactcca

SEQ ID NO: 35743 - DNA, 1233 bp, Mus musculus
ttccccatccagcagcactaacagccagcctgctcccgatggggtccctggacctttggcagatacctccctcaccactgcttctgccaaggtgcttccaacttcacagcttttgctgccagcccccagtgggagctcagtcccaccacacccttccaagatgccaggtggcaccgatcaacaaacagaagggacttctgtcaccttctctcctctcaagtcacctccacagctggagagagagatggcctctccacccgagtgcagtgagatgcctcttgacctctctgccaagtccaaccgccagaagcttccattgccgaaccagcgtaaaacacctcccatgcctgtgttgacccctgtgcacaccagcagcaaggccctcctttccacagtcctgtctaggtctcaacgcacaacccaggctgccggcagcaacgttacttcctgcctaggctccacctcttcaccttttgttatctttcctgagatggtgaggaatggagacccaagcacttgggtaaaaaactcaactgctctgatcagcaccattcctggcacatatgtgggagtggccaacccagtgcctgcatccctgctgttgaacaaggaccctaacctgggccttaaccgagatcctcgtcatctccccaagcaggagcccatctccatcattgatcaaggagagcctaagagcactagtgccacttgtggcaagaaaggcagccaggcgggtgctgaaggacagccaagcacagtgaaatcccgttataccccagcccgcattgcccctgggctgccagggtgccaaaccaaggaactgtctttatggaagcctacaggcctgacaaatatgtacccacggtgttccatcaatggaaagcccactagcacccaggttctacctgttggctggtcaccataccaccaagcatctctgctttctattggcatttctagtgccgggcaactaacccccagtcagggggtgcctatcaggcccaccagcattgtttctgagttttctggtgtgtcacctcttggttccagtgaaactgttcatggacttcctgaggggcagccacggcctgggggcccttttgctccagagcaggatgctgtcacaaagaacaaaaattgccgaattgcagccaagccttatgaagaacaagttaatcctgtcctcttgactctcagccctcagtcagggaccctggcactgtctgttcagcc

SEQ ID NO: 35744 - DNA, 1961 bp, Mus musculus
ggcaggtggcctccagtcagctgctgagccctgctgagaggcctgggagcttggaggacagatctcccccagggtcttctgagactgtggagctggtgcagtatgagccagagctgctgcggctcctagggtctgaggtggaataccagtcttggagcagttgacagaaacagcccctctccccgtcttctttctccttcgagttcacccttcccccaccgctcatgtgtcccccaccgagcaccagactgcagaaagaggcaataatacggaccaacaagaagccgccttatcaatgccagcattagtgactggattcctttcttttttgggggggggagggggttacagttagttctcatctccctgttgttgttgtggttggtgatggggtggaaagttgaactccacttctgaagacaagaggtctggagatggtgggaggtggcaccagggtcccttggactggcttctacacttctgaccaagaccaaacatgggcctgggtggctgtggcctgtcctaaggagaagtgagaaaaacccaaatctcttgagtgcccccttttgtctccctgtgctcttctgtcttccatagtatttattttattagtatttaatttgtattgtttcattggtttctgataagtctgtatcactgtgacgatttgagacaacttgttgtattgagggactttctttacctcctctcccttttctttctacgtgagctctggggatgctcgctccctccctccctccctccctccctccctccaagaaaagtattcccagcttgtctttctccatgtggggagggagcagggtgaggaaggatagggggacatcatcatatgattaaacaacctggctgctgctgacctagagctggggggctgggggcaaatccctggcctttggtgctcccccaccccctgccagttttaccccaccctttgtagcagctcttccatcttgagattggtgtttactagggagcagggttcctgagctgctccgataaaggcaggttgagatgggcctgaggcaagggtgctcctcacactgatctctcagtgcagtttgaacttgttccagcatctttggccctgcacccctcccctacttgcctcaccttacctaccctgggctcctcatctggaaatattgagcctttgccttgccaccactcccacagccttacagcatcctctacccctctctcctccacctgccccccaactctcctttggaatctgtaaagggcccggaactgactaggctccacatcaactcggggaatgagtgagtggctcctaggcctttggatgcctggttagatctggtaccagagggacggaggaggagcttgggttgtttccctggccccacccctccatggcattgtctccccccccccttcttatttttctaccgattgctatttttccgaacaatccttgtagagagtatgtaccatccaaaggcaggagggccttgctggggttggctctggatggagatggtacagttttattgtacaggtgctaaactacaacaaagaagaaaatagaaaaaaaaagacaaaaaaaaggaaaaaaaaagccagtttggggatgggacaatctgtcctctgggggctcctgacccatttaggagagttctttcttttaactgtgtgtgtgtgttttgttcccagaggaatttctgagtccccttctgtaggacagccccatcatcctacccaattggttttgaacaactgttttccctttttaacggcaacaaaattatatatatagatatacatatatatatatatatatataaagttgggggggtggatttcaattttgttttgttggaaattatgatactgtgtggtttgttttctggttttttggtttgcttttgttttgtttttcttttttgttttgcatttcggtgtgtattctggctgcc

SEQ ID NO: 35745 - DNA, 2409 bp, Mus musculus
gaagcattttcatgtggacttaagtaagagtacccacccttctatctcgtggggtgtgagaacatttgattccaagttccccaggcctatttgacatcgctctgaccaaagtgtgcccagttcaagcatctggcaccagaccagggccttcaagagcactagggagtagatgtgctcttggaatgaaaatgagctgacttggtgatggagggaaatccacaagccaggaagcagcttgtggccagatctggtcagcagcttcacaggacgagttaggcctggtcatacttcgttatctgtattccttacacagggaatttaccatccaatatgtgaatatcttcgtatgcatctgtgtgcacttgtgggtctgtatcttcatttctttgggaaggataggatgtagatgtcaggtcttgtctgtgtttgtgtgtgtgtccgtctgtccgtccgtccctccctaggtcagccacagagatgaggcagttttaagagaaagcactctgtaactttttcttgttgttgttggcaagcaacaatgcctttctgagactggaaggaactggtggaatgcccctcctcccagtctatagaggtgtcacagagctggaaaaggtctaggtaggagaacttcaatgggtgcatatgctgagaggacactgctaagggacaagaggccatgtatgttaaaaccatagtgggagagagaaggaacacacttagtcctgggagcacttgcttgtcatagtcaccttgccaccaggctggaacccggagtgctctactgaaggttgtgaggcaaagcacttatctctaggcagccctgattataaagtccctagccaggcctgagtgcattgaatggttgtggccagggcttttggctgtttgtataaaatcagccctatgcttgacaataacagccctttgtgatccagtactcttccttccctatcttgggttccctcttcactctgtctgcgctgagaaattccacctgtcctcagttgctgaggctagtggggtggcaaggctagctccagccatacagtctcactcactctcccaccctctcgctctcacagtggctctttgctttttatttctgcccatcacatctaacccgattctcgcttcactgagatgacaggagcgagcacacatgggttcctacagctcctgtcagcccatgagtctgcttttctcttttctgtttctggaaagagctctcctgatcttagtctctcagcagagggtctccatctcccttttttgaatctgcttgcctctttcctaccaggtttaggaacaatgtgtggagatgtcacacccagaaccaagtctagctagcctctggcgactttggttaatgtgaatcagtgctccaggaccttctctatgtcctctatgccaaaaacacccacttgacctaactacctccctggccggtcatcctcctccctactgttccctctccttccctggaggaaggagccatctgtggctctatgcaggtgtgtttgctacattcccagcaattggcgctgaaatgtctgttctaataaaattggctgatgatgtcaatctctggatggatggatggaaggaaggaaggaaggaaggaagcatctagagaaaaggtcaccattgttggcgttagtgtttgctgttcttgttgtgtttgggttttagttttttggggtttttgaacttgctctgttggttaagatgaccttgaacttccggttctcacccccccccttccttgttctcacatgtggatcaccatgtggttctgtggaccaaagccaggactctgtgcaggcgtgacgagtactcctagcaactgtgctaccttccaagctcaatcatttttttttcaatcagttttaatgagcacaaagggacagtatgagttgccatcagcctgggacctaatctctccatacaccattgtgctttctgttttcgtgcgggctcctcctctctgtgtgtgggtgttctccaagggtctccattttgtcatgggccagttctttcacatgagttctggaacctacttctctaagttcctggctctcgctcagccctagtgatctgcttctgttcatgatgccaccattctgctgaccttctagactggaaatctcagagctgtctggtgggctctgtgcacttgaccctgcccctctccctcatctcctgttatctggcctgtcttcatttccagagcctccagcctagcccatgcctcttaacgtcccacttcccaatgtgacttctcagcacttctctctggcaggctacttgctctggccttcctctgctaaaaagccttcagcgagtcctggcctgcagactaggccagtccttaaactgctgatccccacccactcaggattttctagc

SEQ ID NO: 35746 - DNA, 1190 bp, Mus musculus
gtccaccctggtgttcgtttgagagtgggtcttttgttaccctgaagcccacagtctaggccagctaactagcagatcccaccgatctgcccaacacactgccccagctctgggattctaagtatgcttcattgtgcctggcttttaaaaacaaaacaaaacaaaaacccatgttttctaggcactgaactcaagtgctcacgttttcatagaaagtactttaaagactgagctgtctccccaaacctggattttatagcccaggctaacctcgacaccacagtgatctgtccatcacaactctcaaatactggcattgcaggcttgaatcaccatgccgattgctgctcccccccccctttttgcatttatttcataaaccaaacacaaggcaaggtgtcgatgtcttatcaatgatccacagttatccctacggtcaaggaagccagtgtctgacttgggaggtcaggacaatgcatagaggtttcctaagcaaatagtaccagcagaacttttgaaaatgaaacactggcttaggaagagaaagcaagaagacaaagataccttgaacggaagggccccagtgaatgacctggggcaggagcagatgcagactcttggacctggtgggtttagatgaaagtgatcacctttcatatgactactatgagaatgttccccaagggcagacaccctggctggtgggagagcaggaactatggaatgcttgccttaagggcacttaggctaggggagccagatgcaagtggtcctgcaagattttgcaggccatgagggataaggtcacatgcagggttgggtgaggcaagatgaaaggatggagccagaataaggctgttagccctactgctcctcactccccagcccctgtagttccacaagtgatagacctaaccgcgttctctcttccatctaaagggaaattcaactctggtggataaaacagcctagcaacttctccaggctgtttgatggagtaggtggaaaggtgtgggggtggagactgggcggggctaaccctgtgggctaacggaaaggaagtgggagaggcttgggtgtctcctccagtggaggagagcggtcatcagagaggtcacttgtggcacccttcttttacccctctttaagtctcacccggagttcctcgtttatttcccagccaggataag

SEQ ID NO: 35747 - DNA, 1238 bp, Mus musculus
cctgcagtcccacaggtccctgttgaaggggaggactacggcaaaggtgtcatcttctacctcagggacaaagttgtggtggggattgtgctatggaacgtctttaaccgaatgccaattgcaaggaaggtaggtgtgcttgtcgatgcccttagaggaagatgaaagtgggggttgtgagcattcctgtgacctcactaggtgccctgagatgcattgtccaccaaggtcagattgtccttaggcaaaacaaggtcagattgttcttagtcaaaggcatagccttgcctcagaaacgcttctttttttacttgaaacttggctgggctgccagagggttgtcaagctgctcatttggggttagtagagagctgttcccacaatcccctcccagtgtataactggagactagcccagtttgtgggccaggcagccccattgtgtgggccaggacagggtgcacatggactgagttaagaacctattgttactctatctctcagatcattaaggacggtgagcaacatgaagatctcaatgaagtagctaaactcttcaacattcatgaagattgaatcccaatcgtggaatacacaagcacttttccatccctggcgggatgggtggatagaacattttttttattcagcatacattttctttatgtaggagcaggaatcgaacaagcctctgtgaatattttcatctgtataaatgcacatcacaaattaaaatctgattcttttcagtttggttgttttattttaaagggggtaggtggatgaaggggcatgtatacataccagcaagctaacagcagctactagcaagtgcatgattgttcacagccgtgcagtcagcaattgacactaagttactgtcagctctctaatcttggcccgccatacctctcagcccacagcatggatttgactttatgtatatgggtgttttgtctgatcatatatctgtacaacttatgcgtccagtgtttgtggaagctacaaatggctcccttggactggagttacatcctgttctgagccaccatatgggtgctaggaattgaccactggtcccctacaagagcaaccaatgcttttttttttttttttttttggtagacaggaagtatttaattgctacatgaattcatgtcgtttttgccctttttaaatttttttatttttattttttgtttgctttttttttctttttttcttttttcaagacagggt

SEQ ID NO: 35748 - DNA, 1208 bp, Mus musculus
atgttaagaacgcagcttttgtaagtaagaagtactccatgagcacgtagtgactgactgctgaccagtgaaaaacttctcttaggaaagatttctagacacctgctttccacgtagagaaaagagtattccgggctgaatatggtggtgaaggcttatcccaccgctagggagactgaaacaggagaatcattagtttaaaaccagcttgtgctatatagagaccctgtctccaaaataatgagaagatattcttcaatgctccattagtaagtaacctatgtgctataacaacaaaatagggagaaataggcatacaggaaggaaaggagatataggatagtttgttttctttaaaaatgcaatctcacttgtttacaaatgagtctagcttatagataaaaaatattaacattgcaagatcctttggagcccaaagtttatactctgcctttaacttgtttttggttttttgtgggtttttttgtgtttttgttaatacatggtttccatcatttgttttcgaaggcaggggatgctgcatgcttctatgatataaagttgggtcgaaggcgagtagagcatcatgatcatgctgttgtgagtggaagactggctggagaaaacatgactggagccgctaagccatactggcatcagtcaatgttctggtaaagttttgtgcctcggggacttaactgctgagaactctgtgtcaatgagctcaaaatacagagggttttttaatttggtttgtgatttggtttccttctagcccacttacctttgtacagaagggaaaaagtcccacttcatgtccacaccttctgtccctaaggggttattgaataaaagtaccatgtttgccaggcgtaaaatgagtagaaattgcaccagtgcttctaggaaactaagacgttgaacggtactagttgatacagaagtatagctttaagaataggcagcagtgtattttaattagtctttagtagtatccctaatggtcccagcatacttgggaaaacacagcccattcatgtaagctttaagagcagcaatttgccaggaataatgccatgtgcctttaatcttagcacttgggaaacagaggcaggcagagttagttctgtgagttcaaggccagcctgactaagctgttccaggctagctaggcctacctggtaagactatttcagttttttttttta

SEQ ID NO: 35749 - DNA, 1133 bp, Mus musculus
cagcagatctcagagaattcaaggccatcctagtgtacataggaatctctaagtcagtcacggctatatagttgcccatctcaaaaaagtcaatgttatcccagttacctcttggaacttaagaatttctgttttagaaaaaaagccacctctagttttcctaaaaacccagtgaatataattctaatttgtgtgagttctgtacttggaagcactggtgctctatgtaaattgtggagaaatatttaaaaatttagacaacccaaagatactaccctttctaatattgtgcacttattttgctaaatacatagctttttaccagaattctggtggctaaccaaatgttctcatcaattaaatattcatttgattataacattagatctgtggaaaaatacaggactgaaatgccttttccccactgcatggctgcggttgaaggcctctcctgtagaaaataccaggacttcctgcaatacccatccatctttttgcacacacttctttgtccatgtaccagcggatgacatcacctgctttaaaaatgagtggggggtagggaatacagtttccaaaagaaatgatggtaatgtcattgtaggaatgaatgttttatggctcatttgccagttgcctttaatctgatttcagtttcacataacagcatctgccctatgttttcacagaggtgggtaagagacaaggtctatgtaccactttgccctcttttatcccctcccccaatgctttgccaggttgttagcagtctttcttctttgcttttatttttcttgttttagtaaaccttgaagcctgcattagaacggcgtcatctacgtttctcaccattgtaaagctcatttccatcacacctggctttttgtcttgaaacctcaatacctgctgttcggctttatttggattttctgcctctttctagaaatgattaagggtaactcaatcacaactctgtgcctgcatctattactgggcagcagaaggggttgataataaatattttgtgttctataatattttatttattcaccaaacattatgctgcctattgtgatcaaactgatcacttaactccctgacctaaggttcaaatacttacatttttctttctt

SEQ ID NO: 35750 - DNA, 1151 bp, Mus musculus
tgccggctagctagttgcctaaaacgcacaaaaaaaaaaaaacaaaaaacaaaaaacaaaccagaaagtaaagttctcaggtcagttttggtgaccgttttgctagcagtccccattacctacacagcggctgccccacccgctgcctccgggcaggagtgtcccttgtccaggtttcttaagcggctcaacctactacagggccgctaactctgggaaacttgcaaatgcggaggcggggcccggggctttgcagcgcgcgtgccgccggacgcatgcgccgacctcctcgctgtgggaccaattgcagtgcggtgctgagtcttacgcctgcgcagtgggtctccagcctcagtgcctttccccctggctctagtgggccggttcctctatccaatgtccactcggggctgggaggaggagcctgcgtagtgtgcgtgtgacgggagggggagcggacccgagcccgtggtattcgacccgttcgacggtgcgtggaaggaaaaggaaggagcgggagcttccgaggagtgatcgccgaaatgttccggtgtggaggcctggcgggtgctttcaagcagaaactggtgcccttggtgcggacggtgtacgtccagaggccgaaacagaggaaccggcttccaggtgactagctgacctgtcccaggcaaccccttatcctacttcaaagtccaatggcctaggtgccatgggctccccatccctcgcagagctcccctgtccttcaaaaaaaaagaactttctttcacagtctcaagaatctccaaattggcgggatataaacccaagagtttccaagctgaggaataggcatacttatgccggcctgaccttcaagagatttgaaccccagaaatcagcatgaggccttcttctgggaggctttgcgatttggggataacagaacgcttggctataacagaccatattgcccatcctctgccaccttgccttttttaaagcattgaggtcagatggatgttgtcatttagtggttgggacacagtcacaagtttctcctggaactcagattatctgctttacctcccaaaactccacgtgagagctgtacatttgattgtcctacgacgtggcaatggtgtatcaccagtagaaactgtatgtcagat

SEQ ID NO: 35751 - DNA, 1182 bp, Mus musculus
cttgccaagttgtaatagagaatggtatgtacatgtgtccgttactttgaatttatgatctatgggccagtcgtttttctctatcacagtgtgagctcttgaaaattaaattgatactcagtcttcgtgtatgacatttgtaaacataaagccttctctgatttcagttaccgaaagagccgtaacttctgaatccgcttctgagtaagtctcattttcattcagcacaatgtgatagattttagcactgttgcaatttttcaatagatcaccgatagcaatgaagactactaaagtgtttctgttttttgttttaaagtggcttgttcaaatagattcctgctctatgaagcttgtgcaacctggtgcaagacaaggtggaatttcctaagttcaaagatctgcagtgttttcatgaaggcagttacaattcacaacactagctcgcattatccagctctttccagctttcagatgctgggagattcttattccatcttctctgtgtcaggttaacatgtgttagcatgtgctttgattctccagttgatgctggagaaggcaccttagttgctgtagtctattcttgttttgtttcagataatttgtatttttctttgttgtacttgccttctgaatattttgtgtcaaatggtatagctgctgttttgtctgttttgcctgcttcttaatttcttatcagtcttggtggtcggatagctgttttttccttcattctttgtatgtcattggtctatttgtcagatgcaaaggcaacacagatatttcaaaaaaaatgtccagtgtactccgggacagtgttcccattcaatgaagacaactgatgactagtctctctttccaaggaatatgatttatttcactgggagacctgcttcagtgtgtggccttaggattttatcagttcttaggcagagtcccttcctacctgactggccttccgtaaggctgatagtatctggccaccgatgcctgcaaggtgcaccaaatagatttgagcacaacttccctctgaggactttggttcttaagtgtaagcttatgagtttgtactaattatgaaagcccatcaagtgagtgaagcttacattcatgtttttggaaaaacaaactttgtgaagttatggctccaaagtaacagttatttatgttatcatttaa

SEQ ID NO: 35752 - DNA, 1179 bp, Mus musculus
attaaagtgaagagactatggaaatcagtataacttcacagaaggacactactaatgggtactaggggcagaaggaaaacatgataggctgtgttactgctcaaaattaagtgtgaattctgtgcgattgttaaaaatatgacataaattcccctagtcttagagttataaaaatacaatattacaaatgtcctaacatagaaagaagaacattgcaaacaaatgaattcattaacaagttgtcaaattattgttatgtattacaaatacaattatagccttattggctagccttcttcaagcatattatcctttctgctccagtcctgatgctgggtcctctatatattcaacacaattatatattctatatattcaacacaattagcaatgggatctcaaaaagaacagatggaggaaaagtaaaatttgcttctgaaatggcaaggattggtggaaagacccagcctacacggttaattaatgtatcggtggcctttttgagagaagtcataaatgatatttctattttttaaatataaattaggatctgtcagaaactcactaggcttctcatagacagcacagcttttaaaacgagctctagttagtccttgaactgactgttcaatatacactagcagtgagtataatggttgattttctgcatcatcttggttaggtcacagtgcccagatacttaggcaaacatcactctcaatatgtctgtgaaggaagttttgaatgagattaacgttgacactggtagaatttgagtgaagcacaatgccctctacaatgtggatgtacctcaacattcatttttaaaggctttcagagaaaagaaattcacttccccagaggaagacacaattctgtcttttagttacctttaatttgaggtagcacccaatcgaaactccctagggtttccagcctgctgctctgccctagtcgctagtcagtgaaggtgcaatgaaggcaaatgcagagctagatattgagagatgtgaaataagttatcatatacaaactaaattcataattcaaaatgtaggttaaggaccattgttccctacccagactgggcctaacaaccaacacccattggatggtgttagttctctacatcactattgctggtctttttcctgataatcacaaagtaggactccattt

SEQ ID NO: 35753 - DNA, 1211 bp, Mus musculus
gatggatcccagatatggcagtctctagacttggaggtattcttatggcttcaaactttcattaagaatttctgtcaattttagatcatgcagattttctcagaaattccactagtatctcataaaaaggcttctactacacatctacaatcccacatgaatgctggaagtccttgatatttacgaaaatttcctaagaaaagagaacatactacgtaaggcagacaagttgtagacgatcacagcaaaaagaagaaataaggatactgatgaatgttcagaggggatatactagagccataagttgatttgtgatcaaaaatcaaagccagaaaagttgttttgtttttgttatattagttgtttttcaggaggctagtattttttttccttgtctttggaggaaagaattcacaggttttttttttttgttgttgttgttattattgttttctgttttgatattagaatataatgacatcatttctcccttcccttttctctttgcaatccccgccccccttgtacaccatctctggctctctttccagttcataaagtcttgttcttgaattcttgttaattgttaaactcagcatattgttcagacttcattcagaggtttctgttcctcgggctcctctcatctctctgcccccacttctgcattgaaaccctagttgtatgtgtcacttgggactgggatccacagctctgcgttttaaggaagtaatgtctattatctgcacaggggcatttcatatatgtggggttttccctcaaattcatccatcatcagtatctgacatataaaccactgccctttgtatttataactatttctttctttgtgtctatctctgtctttgccgccaacccccattctcttctcctcccccattatatccagtgatttcttaaacaatgtctactttccattttcccagttctttcattttgcagttgaattgccttctgtttgacaaaggcctgcttttgttagaggactttagtgtgggtgctattctcctggaagatttgttaagtaatgctggaatggacatgcacttgtaggcaattctgaaactgatatccatttccaaatgtagaattcagaatagaatgcttacttcctcatcagtgccattttccagtgtgtgtaaggcctataagaacatgagctttcccttgactgtgctttagtgttcggg

SEQ ID NO: 35754 - DNA, 1155 bp, Mus musculus
ataataattgtgatcctcccagagtacactgttttggcagctggagcttcaaatcggatattggtgtaccatttggagatgggaaagatcacttcacttctcaatccatttcctcttcagaaaaatgagagtgataatatctgcccttatctatcttagtcagaatttgtaaaactaaatgaaacatggggtgaaagaagtttgagcataaattcatgactgtgggattattcctctggacttaattatactgccatctatgttcttaaaagcccctctcttcccattaacacatgtataactcattctgctatcatcataaagtttaaagagacatgcataccttaaagttacctagtatacgacattttaaaaatgggtacattgcattgtatataatttgatttaatgtacttatatctgaccatttatgcatcaagccatgaggtcaataattatttatcaagtttctaccatatgccaggtatggttcaatgctcaggaaaatatacagtaatcaagattaaacagattcttttttcacagtttatgattgaggaaggaaaaataataaaactattgaagaacctgtaagtatggttgtcaaaggtagaatacctagaagggacacaggactggaaatgaaggaaaagtagaacggtagaattgatgttcatgccaaggcttagagaatgagtcattgtaaccaaacaaagagatggaagaaaggacatccaggggggacaatataactgtgtgatatattggtgtgtgggtctgatcacttttagaaaccagcccactcaaagatagctgtggctctggctaaattagaaagaagttcctagctttcaaaccatgtgcactgttcactctttgtgtagattcactgaatgaatgaatgaaacacttctccaataggaatttctcacattcattaactgatttgtctagttctgaaaaatcaagctctcaatcttatggctttcttgcgataattctgaaaagtgtttgtcttatcaaaactacagataatttcacattttcatttaaaaaatttctatgcctttaccatgtttctgcattttacttcagttaattaatctattaatgaagaattgtgtccatgaatacacaaggtgatttttctatata

SEQ ID NO: 35755 - DNA, 1128 bp, Mus musculus
gtaatcatattttgaggttttcctacttgctcctggagtttcaacatgttaagacccccctaagagccaaggaatgcacaacacaattattttaaataatttttgtttgcttgcagaaatatcaagggaaggaacagtatatatgtatgtatgcacatatatgagagcagagttttatgaagatattgtacctggtcctagaggatttctttttcatatcatctttgacagtacagatttttttttttggtaacaaatatatttcatgaaattggaccatgctaattcatattctcaactatcctcaattttttgctttgattgagaagttatcaggaagaaatgtgtgcacagtaaacattgcataaagactctagggttaagggttgcaagaattataaatggagctggagcctcacctaagagtctgaggaagactaattagagatgcacaaaaccagaagccagagaccagtgccttagggattttcaccaaatttatgacatcaggatctgagagacatggagtatcattgtaatgaaagttttcttcattagtgctaataacaactacaggggataagggaagtgaagctgactgaaagaggtcattaaggtttggtatggggatggaaaaaatttcataaacagaaaaaaaaaatattccctcacattgagcccatgagaagctagatagtacagttttttaaaaaaggagttcttaatcaagtacactagcattatgttgcatgattattgcagtttttaataactcaattaagcaatttccattttaaaatgtaagctttgtggcagccagccttattatggttgattcctagtagattccatcatttaagagccatatgtgtggtatatagatagatgggcctagtacacttctgctgaacctatgaatgatctatggagataatcactttggggtttctttcttctaaatgagatgacttcatttactgcactgcctctgtgttccttggctgaggagacaaagataaagaccctaggtctgccgaatagaccaagcaacaacagaggtctgggctcagggcacgtggaatttggagtactttagaggaagttttatttctttcagtttacttggca

SEQ ID NO: 35756 - DNA, 1151 bp, Mus musculus
gtcctttcagcaaaatcttgctagtgtatgcaatggtgtcagcgtttggaagctgattatgggatggatcctggatatggcagtctttagatggtccatcctttcgtcacagtgctaggcatttctgctaaggccacccacattgagtcctggtgtctggaactcagggttttatcgtgggtattttgtactttttggctaatatacacttatcagtgaatacataccatacatgtacttttgggtctgggttacatcactcaagatgatattttctagttccatctatttgcctgaaaaattcatgatgcccttgtgatagactatggtagtttgttcacttttcatttggagaagtgtctcattatttgaattatctacagctagcatattcattggccggctgataaacatttttattgtttccatttttcttgtattatgaattagtctatgatctggtgatcccttaatgctatgcattgtaccctaaacaactctttgtatcatatcacaatttttcatatagtacgtttttattttaacttagactatagtgcctttttcatatactgtgagctttcttctttgacccaagaaccattcatagtttctggatgtttctgttggtgtctaaacaattccattgtgctaaaatatatgtgttctgttgtttgaatttattaaattttatgctatgacgtgaatagaacctgtcatgaacgggctatgatattttaggaactataactttagttccctatggaactgagatctttagatagtagagccaaaatgtcttgggaactgggaaatattgtttaagacacttggagaatagttaaccaagttgctctcattttcacccctaatagttatttacatacccatgaattatggtgttgaataagtatcaaccatatattagatattaactaggagacctggaagacactactagaatacattgcctattaatcggtgctatagcttagtcttcaaaaagacatcttattgttacatcaagtctacctcttcaggatggttggaaacatgaacttactgcatagtctgtaacacgagttccttgaattaatccatgccatgatgataaataatgtaatgtatcccatacatactttgtaataaaa

SEQ ID NO: 35757 - DNA, 1176 bp, Mus musculus
ttattataataaagatatgaattttattatgagggtcttatccctgtgacctcatccaaccttaattaatccccagaggcacctttctaaaacttccttagccaccaatattggtagttaaggcttcaacttgtgagttttgtagtaactcagatgtcaatccatatcattttacttaaaactcccacaaattcatacctttctcatttgtaaattacactttatgaaaaaaccaaaaaacctcttggctcattctaagacaaactgtaaaattttgtttcaataagattgatatttggatgtaatttatcctgaggctcttcagtatgaatccatggaaccaaggagttatggtgaatcctttttgaacactcctattcttttttgttttgttttgttttttgttttttaaattattttttattattttattaaatattttctttatatacatttcaaatttcaagtgctatccctaaagttccctataccctccccctgccctgctcccctacccaccaactcccacttcttggccttggcattcccctgtactggggcatataaagtttgcaagactaaggggcctctcttcccagtgatggccgactaggccatcttctgatacatatgcagctagagacatgagctctgggggttctggttagttcatattgttgttccacctagagggtttcagaccccttcagctccttgggtgctttctctagcttctccattggggaccctgtgttccatcttatagatgactgtgagcatccacttctgtatttggcaggcacttcgtatgagacagctataacagggtcccttcagcaaaatatggcatatgaaatagggtctgggtttggtggctgattatgtgatagattccctgggtggggtagtctctggatattctatcctttcttcttagctcctaactttgtctctgtaactcctttcatgggtattttgttccctattctaaggaagaaagaagtattcactcattggtcttccctcttcttgattttcttgtgttttgcaaattgtatcttgggtgttctatgtttttgggctaatatccacttaccagtgactgcatatcgagtgacttcttttgtgatttggaacactcctactcttaagggagaaaaagaaatgatgatctgt

SEQ ID NO: 35758 - DNA, 1099 bp, Mus musculus
gtttgctttttaaaagatttttaaaaattacttattggggttggagaaatggcttttcgttaagagcactgactgctcttccagaggtcctgagttcagttcccagcaaccacatggtggcttacaaccatctgtaatgggatctagtgtgcctgaagacagctacagtatactcatatacataaaatgaatctttttttaaaaaaacagttacttattttgtacttgttattgtttttatcattttctaatcatatgtatatatctgtgcaagcttaagtacctaccaacccctcttggatgataggaaccatctctggcctcaagagcagtgcataaagcttactcattcctccaaccccaagcacggtctcataacaattattccctctgtagtctcttagcaagctcatccatgaccactgaatttccattggaaatgactgatttactatgactgaagaagctatgaggaactccaaactcccaaagcatagtaattccatcggaaagcttacaaatgtcttccaggggactaagtagtagacaaaggctccccaagagcacgaatttatctccaggaggagctctgtggccttttcatacttgaggatttcaggttgtggtcctaagtagtattatctttgacagaggctaatttaggctacttcttcagggtctagaaggttctaaaccttttaagctcttgtaaccctttaattcagttcatcatgtggtaagccccaaccattaaattcttttccttgctccttcataagggcaattttgctattataaatcataacctaaatattttttggtgttttgctgtctgttacctttctctatatggtacctatactcatacaaaaccaaaggcataggtatgttacatcattctctggaccatatggaatatatataaaaaaatcctttgtgtttcctatgagatttgcctgggagtttacaaggcctcattgttagcaatatacatacagtaatcttaatttattatattatgctattcatatagctcagattcaactatttaataagatgttagttactatgatagtaaggcaggaaataaaggaactta

SEQ ID NO: 35759 - DNA, 1338 bp, Mus musculus
atgaggctattgaataccataggctattgaatacctgtaggtgcttgtgtatcccggcagtgtgcctgccaaggtccaaggacaatctagaggtggtgtttatgtccttcaaagagggtgctggagatggagcagaggtacccaggcgtacatgtaatcccagtaccacaaagggtggttgtcaaccagaggacactgcataaattcatacgtaaagaaatgagtaaaaagcacttggatttgtgattcacgggcttgctttctacttttctcttcacctactgggcaaatatcactgagaacatcaagcctgagcacacaggcttcagagggaatttatctagacaaaagagaggcatcctgatggtgaaggatagtggtttgaggtctttgctttgaattgcgaatataaaagtaaaatggcctcctagtaaaactaattgcctgagtctgcagaggagagaaggcaggcatttttcttgtctttttttttttttttccagaccaaatgggcaggggaataggttgtaagaaggcagtgtagagcttgtctagagctctactgcccccaagaggaattagtttccacaggacaccagcagtttctttcccataggcccttgctaggaggagggctggactttgacctgaagctcattgtcttcccaggcaccaggagatgtcaggaagctggtataaatcctcatgggacttgaagggcgagtggcctgaagtgggtcacaagtgatcagggattctcaaactgctgttcccagcttgcatttaaaaatgggaaataactcaaaagacaattgcaaactctctgcagtcaagatggctcctgcttgtaatctcagtgttcagaaggtaggaaaggactactgtgagcaccaggtcagcctggactagagagaagactttgtgtcaaagaacgaagttttataaagggcagtcttgtggggtagaggcatggcagtatacgaagcacgtgtgcgtgtttctgtgtgtttcttgctcttgtccatgctagaagcagaacttcattgtaccgtcactgctcccacagtactatacctgctggatccagaactgcggcagggtaagaccagccaggacaagccagtgccaggtggcacaggtgtttggaaaaggcctgacgtgtacccaactgtgtgaaggaatgggggacccaaaacacagggcaaagaattatgcttccatccacgagagcaaaggtgtgggggggggggctgggggggatagattccatatgaacattttgaagatgtgtaattggaacaaaattgaatttcatataagacatagtagcaagctcca

SEQ ID NO: 35760 - DNA, 1575 bp, Mus musculus
ctctcctactgtgggcagactggcatcacccgacccttcagagtattaatgcagaccttcgtgacagaggtccagtaccaagtgcgcagctgtgctgaggtccagggacagaaagcagatgggcagattcaacccccctcagctggccatgctaatctactagctggtgtcctagggcagcagggtgcctccctctccaggttctgatgagaaaacactgcagtcccagtttctttcggggcttgaagagaagtcaaggaagccctgcaaggcactcacagctgatcatgctgtctgtaattggctgccatcttctgccattgctaggaatcatgggaaggaggacatgtggtgctgtgacttctgaaactattttcctcatgatggcagttgtgctccacaaaagatcttttgattgtttcccccccctccccgcttcctgtgtgaaaaattatcaaggagaatataggtaccaaggaagattggttcggtgaactttgcctgtcctcgaatcggttcagggatggtttgttttgttttttgtttttgtttttttgttttcttgttttccttctgaagtcattctgagtcctcattctaccctaggttgtaggccatttccttttctacagctgttcatactcaccctttttagctacttaattttgctcttgattgtctagtcttattcattggttacaattttcacacaggaaaggtagtctaggagcttcgaaaggaaagcttttttcatgcagggtgattggtattgctgagggctaacaacccttgcctaccgtatcctagagcctgggtttgctccccaggactgaaatgggcactgtttgtcatacataattatgcagcagggaaattctcagtggtaatattgtaaaaccaaccaaacaaaaaaacccccaaaaccagtcatggcagtaagctgtgatcaggatggaattgtagaaaagcattcatgggcttctctccttccttttagtgttgccccctcctctctgtcactaaaccccactccatgttcctagtgtccctcttttctcctctccttctatgtacacccaaaggcagaaatacagttctacattggctagcctatatgtcctttaaaagtgttctctctcatgaacaatctctgctttatttcatttccaattaaatgcacacatataccaagctgttaatggtgcttgctttgggtaatgatatttacaataaagttttcatttgttcatccttgatgtgaagattggaaaggtaattgaagaagctgagctttgtggttttcgtgatccatccctgtaaccccagcactcagtgtaggatcacggtagccccgaggcctcgaacaacctggccagcctacacattggcctctgatggttttttattttattcattcgcagaaaggctcatggcgtctatgtcgtaaatgagctgtggatttgctatgccccttctcttcagcaacccttatttttcttgcctgtacatctctactgtgggaatcacagggaagctgctgcagcacaacttgaaatagaaagctggatggtatga

SEQ ID NO: 35761 - DNA, 1155 bp, Mus musculus
ccagatgggcgccatgcaggacttgaccatggcctgcacacacttcttcccaggagaaggggaatgaggaaagtggggggcctcaaagcttcctttcctttctgtttgtcttgctatgtttttatattcctttttatccatttaattatttagtacaaaatcaggtccagtctccttagatatggcattgatataaagtgtaaaatggaagctaaattctaggagtacagcattgcatgcttctgacagagacaaggaaggctagaatcacacagttagtggacactgcaactatattgacatttttttttttttagactgtgaaggtggggacagattgctgcactcagaacaccttccctgctctggggaaacaaacactgtcatcatggggaaaatgtttcctgtagacccacacaagcacacacccctcctcctacatccagcttctcctcagccattttgaagcagggaagatcagggggattcatgaatggcgaaatttggccttttttagtgtatttctctccttctgtaggcagactggcatcacctgacccttcagagtattaactcagaccctggtgactgaggtccagtaccaagtgctcagctgggctgcggtgcagggacaggaagcagaagggcagattcaacccccctcagctggccatgctaatctactagctggtgtcctagggcagcaaggcgcctccctctccaggatctgatgagaaaacactgcagttccagtttctttcggggcttgaagagaagtcaaggaagccctgcaaggcactcacagctgatcatgctttctgtaatcgccctccatcttccttcattgctaggaatcattggaaggacaacagcggagctgtgagttttgaaaccgcgtcctcatgggggcagtagaggtccacacaagagcttgtgagtgcttctcccctgcccttcccttctgaaaaaacgccaaagatggctgtcctaacttttatgcagctttgagtattttaaatggtattttttttttgtcatctactccatgtgaagccattctgaggccctagatggttggaccctttttcttcagttatgtaggttatctcctttttctgtctttataattgtgaatttttaccctttccagatagt

SEQ ID NO: 35762 - DNA, 1162 bp, Mus musculus
ctgatttcctactggaaactgttaagcggcctccagttagatgcttcctagtggctcttcacaggaatagaagagtaataagatattgttacctatccaattggaatttataggcagtgcaatctatttgtcccccttggattatgagcattcagaattagtacttatcttctccttatatgatggtagtcaaccgcccactgcacacacaaagcctgttattgtctgtcaggatatggtgcatggtgcccaaggaatgtggctgagaaccagggttctggtgcctagatttgctctaatgcagacactgaggttccatatagcattttccttcttctttctagaactagatcctaagagcagaagacaatcatatgtcctgagaacccattggaggttgaacagcgctgggtggatggagaaaggcagaaatgcagaatttcgtcattgcctggatgctgactttatccaaagagaagatgcatgaggagtgtacatgcctcaggtctcacttggctttctctttccttcttgctttgttctggttttggtcttttgtcctttggagttccaagtcaggaggagttgtagttggtctggcatacatgtaaaatgaaagcagaagggggcctgcaggaaaggcttcctcaactcacttggaaggaggaaggcaaggctgccaccaccattactggactccaattgtagttgcttttttttttttaatcggaaaggcgggagcaggctgctgtgagctggtttttgtttcttctgtagagcaacactgccatcgtgcggaacatattgcatacatacctgaatgcaggtctctttctctatggtggactaacaaataggaaggaaggctatggtctgagaggtattagatttactcatttattttatgtatgtcatcacactgtagctgtcttcagacacaatcagaacacacccgatccccattacagatggttgtgagccaccatggaattgaattcaggacctggaagaacagtcaagtgctcttagccactgaaccactgagcttggtctgagaggtattagttatccatgtttggactctttccccttcttcttttccctggtgcacagagcactatcttaatgcttctagacattatgaagaaggtggagtgtccag

SEQ ID NO: 35763 - DNA, 1140 bp, Mus musculus
ctcctggcctatctaggctctgtctgagattagaagtttgttctatcatgcctcgcccaaatagcctatgcactgcttactctcctaggcaggaggaagtgctttgtggtttcgcattggcctgaggcatcagagaaggaggattgcagcaggcattcccacacctcagtcacttatactgctctactgagcacttaacagtgtctatccgaagtcactctgggttctgtcattttctcccatgagaattcagtacattccaatgtcatgagttatgttccatcacttactgtgatgtttattgggggaatggtgcataggagacattgtttcctaatctttggtagatagagtaccttgttgttgagaaggagtttctctgtggagccctggctgtcctagaactcactctgtagaccaggctggtctcgaattcagaaatcctcctgcctctgcctcccaagtgctgggattaaaggtgtgcaaaaccagtacctggctggtgctgtatcttgtatgatgtctcattactaagttaagaatgacactttcacagcactccgaaagacagcatgctggctgtaaagtagtgccaacatttgtttcaaagcaagtgataatcttgttgagtatgtatgtgcacatcatttcacatatacatgcatgcatatatattttatactaaaattggatgggataggtacattatagtttggatcagatcagtttatatttcacaaagacttgaggaaaatgagattacaggaatgttgtcaattttgcttatcaccatgatgttataaaagcaatgttttaaaaacgctctaaaattactttagaactatagatcgagtgaggtgcttttgtctgagctaggatctctagtactagctggcctgggaatttgcagtgatcttccttcttgggataattatcgatgtgggcaaccagagcaggcctgtgagatattttgtttatttaaccaacctgtggcttaattgctggtattgcataattcctttgtaggaaagactgacacaaagtacgcgttaatactgatgtgagaacaggtgttcagatccagtggactctgactacatgaacgggttaatcactgttggaactatatacgatgttgag

SEQ ID NO: 35764 - DNA, 1192 bp, Mus musculus
tgtattgcctaaaatgatgagagctcttttggcatcttaaggtcttggccaaatggctgccaacaattcagcctataaagtctttttcagaatatggtgagttacttgggtgatgagaagatgaaccaaaaaaggactttacctagagaggtattcctgagctcaagttaccatatcttcccttcctcccctcccctctcctcccttcctctccccctccttcctgtcccttttctttcctttcctcttctgttttcttttcttcccttttcctccctccctccctccctccctccctccctccctttcctcctcctttttcagttttaatttttcttaggcttagatcctttatttgtcttggagctaacaacttgatgacttgggagcctacgaggggtgtgtggagctcagtgaacgagagagcagagctcggagggcaagggcctttgttgtattgttttgcttgtttcttccatagaaaatcttaggttaaggctggtctcctgcatcagctgagactgttagggactctcaacagagctctgcctggactgggactcactctgtagaccaggctggcctggaactcacaaagacctgccttcctctgcctcctgcgatcaaaggagtacccaatctaaaatttagaatattttaatatttttttaaaaatcttttcaaatctttttttttttttttttttttttttcttaatgcttgatgggcacaatgattttctgcctctggttttaggtttagaaaaacagacaagaagttttgttttttaaatgatcctgttagttgtgcttgctggtacctttttctttcttttttgcgagtgcgatgggcgggagaagaaaggcgcgcagcctgaactgtctgtctagatggagcactactgccatcgtgaggatgtaagttcaaatcccagcgcgcagttattagcgaattctcgagagcacttctggtttttccaactccattccgtaaagaagactacccggccctaacatcaaaatggcccaccgtttcccttctaagttagtctaggcgttctgagctgaagtttgatgctgacaggaaaacatttcatccagtgttgaaggcaggagctgcccgccactttccggaagctgggaggcgggactttggctgcggaagccttgagcctagagtcagctagctgcct

SEQ ID NO: 35765 - DNA, 1791 bp, Mus musculus
tctttcaaagtcatcctaactattaaatgtttgtaaatcatcaagcttcaaaaagcattctttttcccccacacaagtatattctaaaaatgactatttgtaatgaggtggaagtaagtaataccttcttaaaacaagtgtttttaagaagctcttgaaaaaaaagaaaaccacctagacctagaaagtattgactttcctagcaagttgttctgaattcaggcagccccatgtctagcaccttggagaaccttgtgtttgaagcacttccatgcaacatgtaacagcagaagtacctcttggtgtatttatcttctctttcagatggaagaagcaattaacccttatttaacatttaaagtaatctcatttagccgagaatggtggagttggtctggcttcagtctttaaatcttcagctcaaatcacatattacatgcttggatttagaaaacttttaacaacctttttgtcttgtgattaaatacctgatcaataggtatgagcgtaactttaaaccagcatttattttgtcgtggcaatgcatttttgtagaaactatttatacatttttgtttataattatccactcataagtatagtgtgttcaattctgaaggggtatttaaatgaacattgtccaactcataggaagataccatagagcaggatcatttcttgtcatataaaagtaagatagactgtgcagttaattttcagttctatttatggtactgttaagtgagttatagccttttttagccatatatatatatatatatatatatatactatgtttgcctaagtgctaaactaggtctaatgtagaattgttggtactgattaattttgacagttatgattttaatgtttgcatcttcacatttgagcttagcacgaaacattttaaaatatctgtgtaactgccaaatgtgaaaaggaaagacattgtacaagtagccaatgcagtttttaattgaaatgtcaattacatcccttcttttaaaaaagaaatacaaacatttgaaaggcagaacattgtatgccaagaaaattcttttcattggtgcctatcctgtacctgttgctttgagttgactgtaccttgaattgatgacttggttagatttttagtttttttgtccatgctgtaaatgacactcaatcgcagtttgttctccatagtgctctaaaaataattgtgtgacttgaataatgggtgacattcatatttttgtgaaagtaaaaacaagttcataaattgattatggaaaactgtaccacacgcctgcatcccaaatacagctggtattgcttactcattatagcgttagttctgtagacctgtttctatgtgaagcatatgtcactgtttgggggattttaaaaataaatatttaaattttatgatcctcgatgtttgttttcttgagggtgggtctgatatgttattctaattaatttataatagttcttttttattattggaacataaccaaggcttccattgaaactaaaagttactaagaattgactgtatttatatagctgaagatatatatcctgatttcttcctcctaccataaaactcttaatagtacttttaaaagtgtcttcagatggctaatttaacgatccccttaattactattttaataaaagatcatatacagatttaaactttatagttcttaaggaaaatatacatttagcaaaagttttcaaatgaaaataagatgagaaatagcatctaactcgcaagattttgagtttctcctggggaaaagatta

SEQ ID NO: 35766 - DNA, 2876 bp, Mus musculus
ttgcagattacaaactcagaggaaatttgcacagatgctgctttggagaactttacaacctgggttgcagaactgagccttggtaaacctgtctctatcacagcatgttgccatacatctaatgaagtgcataaggtctttggccctcaagatccacggaccttcacagtaatgcttagcacgtttaccatacatttaaatctgttctttatcaatccgtccttttatagctttttaagttcttattgatggctaatatgaaagggttaattttaatgttagttgatttcgttaatcagtttctcaacttgtatttattactcaaactcagtattacctactcaatgccttttaaaagaaagatataatggagaaaaaaaattgagccttaaacaaatggttacttctgtatattacctcgtaccaatgcttcatcctatttgtaaaatctttctcctttaaatggttggttaatactttgagactttgtttacgtgtggcagtgttgtaaaaagaaactaaagatcacattttacctgtatcgatggactatcccttttcttcaagtgcagttttggtaattaacgagttgtgaacgttacaggtgatattggaggttggctgtacaacatttacttgaagttgaagagttaagtatttgattccattaggccttcacatgtgttaatctcatttacagcattaaattgcagcagtaacatttttctttctgtgaagttctaaacttagttatgacctacttagcaatgcctttgaaaagggatattgtgtccatggtaaattaattgtatacctaaacagagatagctcagctttgcccatcaggcttgtcattgacatctggtagacttctgcacatgtaaaactgaattcagataaaaccatgtacaatttctagttcttaatatttgtctttctgactaatagtttaaagcaatatttgttaatgttttcttgcactatcacaactgctttttagttctttttcaagaagcatgttcgtagtagagacagatctgtgtaacaggagggaaagcagcgccgagcctctggctggctgtgttttatttttgcaaatgtgctttctaatagccattgccttccatgttgtttacctaatcagcacattttgtctgaatacttgaacattttaccaataacgcaggtatagaaaaagaaaaaatacttacaatgagtaatctttttgttcacttttaacatcatgatgacgaatccttttttctagcaattatttttcaattgtgaaagtttgacagtattttgtttggggttttatttggttttatttgtgtgcttttaatttgcagaagttagtaactgcagctcacctactgcaccaaagctctcgattttaggagcccagctttagtcatttgaacatgcttctaaataaaacaaaaccaaaactatgcttttgatctataataatagctcaataactttgtcaaaaaaagctctattatatgcagtgatggtttgtggaagggtgtggcaagtttaaatttgtattgtgtgtggtgttcaaataaagtgaaatctacattcatgtgacttattggtcagcatggccattaattaatgagtagaaactgattaaactttgatttcctttttttaaatcgtgttgcatttgattcctgatcagattccctcaaagcgagctcgtgttcttacatttgggatttgacggtgagaggcaactgaaatgtttgttccttatttacaaactgtgtgaaataaatacttaatttgagtttgcactttaaaacccaacgctccttcagagtagcttaagtgcttgtggctcatcattattagccctgtgaaattctaaaggaatcaaataattcatgatggcttcaattttctgcagattgatttttatacagttttttccccatggctatccttctgtccttcccttcttcgccttctgtcacctcgctctctatcacagcgttcattgtcattgacctcagcagcaaatttcactcggattcacttaggatcacaggaatcaggggaaagggatttgaaaggtggtttctccagcacattttaagaaaagggaccaaaagttattttagcttcctcaatagattgcatgttgcttattaggataagaaatgaatattaaatgcaatatatgtcttgtctttattatggcatctgtttaggagttgttcaaatcactgcagtagggctctgcaaataaagtcatgtaacctattatgatggatctaatgtactgtaactttatcagtgaacagtaaaatctcgaataacaagtacaaacattgaacaattacctatgaagatttgtaaaagtaaattttttccaatagatttcattcttgtcattttgtaagacgaccctgcagtccacctgtttgtaacttttttaataaaatagatatctgtattatggaggcttgtctctttaattatttcattattggcatattacatcttgttctagatttgctaacttaaatttttaagcaggaagtcattaaacacatgattatatattatagtacataaacagaaattaaagattcatttacttgattccttagttgctatttcgacattgtatgaggaatactaaaatatgccctaaattaaaatgcttagtcgattagactaactcagaaatgaatactaattagtttaaaatgcatatacttagtccatatgcagaaaatggccaaaatacaaatttgttgactggaaactatgtaataataaatttggacaatattaacatttaattaaatgttgatatatcaaattaagaaaattcaaaccagttatcatttggcttttggggt

SEQ ID NO: 35767 - DNA, 1189 bp, Mus musculus
taaatttgtcatttaagaagagcttagtttcagtttttgcaaaaaaccatgagaccgtaatgagtaggaactagaatgaaattgaatggattcgtacaactgctatttaaatacagtgtttacttttgaaattggagcatgaatccacacctagctattgcttttcatttgacttttctagataaattttcagttttcatctattcatgaaagcagtctgcttgctattccatcagtcttgctctgccgttcatctctgagcatcctaaaacactgtgatcttgccataagtgttgtcctatgccactcgactgtgtccactcatgggaccctcaactctcctgctctcaactctcagcaggaaccaaattaacttagtattttgtgcttgggttcactttaacagcataaggagtgagacagtgctgtttggaggacgaacagcagctacagtacattgtaggaagggaaagaggcagctgaggcgctcatgagctcctcggaatgccaggtgattctcttccttgtctttggtgagtgttggtaaggaggcccctagacaaaatgcagccaaggttgtcgaagatctggcggtctgtgggataggctgtggcatgcagaaggcttactaacaaagttctcgctccacctttaaaaaaaaaaaagaaagctcttctacatttcactgaaatggaaatgagtaaaattggggggaggggtgtctgattcggtttgattcatttgatggatttgattccaagttttgatttgtagatttaataagatagtggcctaattttaccggagtctgttagagatagtagaataaaatagcaaataagagagtttagcttttttttttgaaagtttagtagatagtctaatcaaactataaactgtaaatgtgattataaatacaggctctgagtaccaagttactaattggtgccatgttttcgtttttcttattgttagtttttaaagttttaattgtactacatttttatatctaagtatccaatgagtttaattttgaaggagagttggagaaggtttaaggttttaccacttctattcagaccatctctgtaggctctaaactgagaccatagcgtaattcagcatagatacagtccagaactaccctctacaatccacagttcaagaacaaatttagcgttgtacacaa

SEQ ID NO: 35768 - DNA, 1157 bp, Mus musculus
gacacgttgttcaatagcccttcagtatttcttactgactcttgttttgttttctatttcagttgaaatattgagcagcagagttacagagtatcagaatctctcaacaagaaactccgtgtggcctttctatatgtattctcgtatgtcttcttgtaccaacacgacaataagcatggtgcagtcaatatactaaagcgcatatacctgttgacaaattcaaattttaaaaatctgtggagatgttaaagcaaatagaaaattaaccagtatgtgttaccttatacggattcattgtatatgaattagcatacaatatacaaccatacaggtttgtcatgtatatgaattatcagatccatattacatgaattttccatatgatatgaattaccatattgaatataactgtaaaatgttgtgactgctttccagtaatggtttataataaatgaacttccacagtgtactgtaggcttactgtatactcttggtggataaattctgttttggaagtgttaccttactgttttgtttacaagatagtctataggattgatgtagaatgtaactgatatttcccacaccattttcctccattggtatattgtattaaattgggttctgcttagctctttcatgctatagtgttttcttgtttatacgtgatatttgatttcaattaaagcatcataagtggtgaacagaactatatgtgactgaaaaatgtgacaggttcatggtaatatgccctctttaaaacatttctgcaagtttccggaggcctcacttctgagtgtgcacaaaatctcttcatatatagaattttacctgtagatctgaccttgcatagtcaataatatactaaatttttaaaagagaaaaaaacttccctacatgtgataggaaagttcaaatgttaacctcaaaccattcctcttaaataatttgagaatcaagtgttcacattccaataaatttcttagcatgtataaaaattacggagagtagccattacatttattgtgttacaggaatcctatctctcagcttgagtgtctaaatttgagccatttgtcatcttcagctgagaaactggtactaactactttaaaggtatactaatcacaggctgaaaatcaagcagagagatgtgg

SEQ ID NO: 35769 - DNA, 1183 bp, Mus musculus
gtttggctggctatttctggcccatggttcttttcttgtattgacagatttgtacacaataataagagcaaaaaattttctcaaagacaacagtagactaatcattaagatagccagagttgctcaataacaccaaaagctgcctcttgataattgaggggaacacttctaccaggattttgtttgtgaaagatcaaaaataaagaatgttttgcagcgaagctaagtgtcagggacgtgcaagtagaggagaatagtttgatagtctgcatctgtgaagagtattttgatggtttcaattacaaatggaacaaaggaagaattatatacacactgtgttgtgaaatatcatactgcttggcagtttacacctcatggttgttgctacacttctataagagcttacattaatcccttggctttcaatcaaaacaaggtgaccagaagtggtattcatgctttcaagagggacatgcttagaaatatgatcataaagtcacatctgtcatagtctgcccaagtgcatgacctggtttcatctgtaataatatggccacaagtttggcaagaagttgagtatctggctctaaagagattttcttgactctgagctctgtgacaatatttgcagcttttgttttgtggtatttgcagtgttgagaatgatgatacctaaaaaaaaatcaaaaaacaaaaacaaaaaaatgaagaaaaaacaaaaacaaacaaaaaaaaactggaaggaatttttaaaagcacatcttgaagtcaaagtatttggtgtacattgtgttcttgaaaacttctgtagatcactatggtatttcagtaattttagttttaattgaaaatgattgttcttaaaactgacagtgttggaaagcaggacgaagtctgagccagtggaaaagctcattacagaaaaaaaaaagtgttattgctgtggtgtgcatggtttgcagagattaagtgcattttctctgtctctactgattattgtatatagagaatgttataaatatacatttttgtcatcatcatgtaaatcccacgatttcaaactgtaaacatctgttcagtggtgtagctttacaaactgttcactgattttgtgtaatttatcaatagatgtgaaataaagtttcaattgcaggctgtgagtaatctcatgatttcaaggttt

SEQ ID NO: 35770 - DNA, 1190 bp, Mus musculus
cctttaagtacacccacttttccatataattggctcaacactgctatttgcataattgtcatatttttctgcttcccaagaggtctgttaagcataaaggtgagccacaaagtggtttgacaaagtgcacatttatatgtgatgtgcaattctcaagtcatgaagaaaattatatcttttctattgaggctatcttacatatggaaaccaagtattcaaaactcattgcccccagagatgagtttaacctgctttgcctgaacttggccaaagactaatttcctgagcctcaggtcttcaaataatgaggttgcccaggggccttgatcttatcagggacatacaacacaaacattttctttaagctttgctataacaataagatcatttagtctgaatcttaatcttggatttcctcatagctggcgcatgttttgctgcaaggtgtcaatcatttagccactcaaagcttccctttgtctagttgttaaatggtgatacatttaactcccagagcaattacatagtcatttctaagcaggtccgttacccaggacatgctacatagtagatatgctgataaacatgtgcaactccatgatttcttcttcgtttatagtgagtggagggcattcagaaaacagatgattagtttccatcatcggcataggaaagacctggactctcatgccttcctcttacaagaatagtagtacaaagagctatgggatactgggtagatttttcaaaaagcattacaaccatttctcctttatctggtaatggaaatagatgcaaaaatatggacctttaagtttgtattgaagaggattaaataaggtgaatagaaaagatttaaatgctcagtgcttctgtaacctggaattactaatgacatccttaatgggtttggacatattacctggtttgaaaaatctgacagatgagggtgggaaaactgaagtccacttcatatttgctgcgttgtcttgtaagttttcaacactgggtcgggtggaatggcatcttctcttgtaagtgatctgacccaggaaggctttcacctacttcctttccaggggaactagattctcccaggtttcctgagggctgtgtgtgcttctggctgcagactaatggcatcagattgcagggctgagtgcaggaacagtattcatggtacgatagtg

SEQ ID NO: 35771 - DNA, 1897 bp, Mus musculus
ccttttcctcagaggtaaaggtactgggtatcctcagaccttgatcttaaggatgggaaagctgatttatgctcacggaactggcatgtctttctgcttgtcagctaacaagtatcatgttggcccttgatgatctgagcccacttcaccggtttgatcttctccaagagtcacttgagtaacattaaaggacttttatatactaggacttaatctgcaaaactgaatggtttcatgcactcaacattataagaagagttatggattgtttttcatctttgtagaatggcattctgtttctttaacgagtacacaatacctgcttttaatatggactagtaagacctaaaaaaatctaacttgagtaataagctttgatattatgtgaaagatgtctgtggggatgatctgccatgtggggaaagctatgtgcatcttaggcatgcttttctgtaaacactgagcaatcagacttagcactcgtaatgctaagcctgtgctttctggaatgtcttctcttgcctttgaagcaatgtgtctataatactgtatacctgcattggagtaaatgattgtgctaatatgttatcttacgtgcacacaggaatgggttttcaatcctatcttggccaatatgtgtttatctcctagtgtatggggtagttccagttccaatatagtggcataggtgtttcttttctttaccctttatttttctttttaagatggggtttttcttgccattgtaggccaaaactggccttgaaatctactccccaagtggtatgattaaaggtagaggccactatgtctggctttgatagcattatttctggtggccttttgaggagtgaattagaatttagtgctttcttgggaggcagaggcaggcggatttctgagttcgaggccagcctggtttacagagtgagttccaggacagccagggttacacagagaaaccctgtcttgaaaaacaaaaaacaaaaaataaaaaaaaacaaaaaaagaaagaaaaacaaacaaaaaaatttagtgcttttagcgaagtcagttaatgcccttttgtttctgtattttttataaatgagtgtactatgtatggccgaatatcaggagagagccttgaatctcattataggtgctctggagccatctcttcagctctaaataatgccctttaagaggaaaccaaatgtaaacacttgaggttctcttctttcgaggtagagtgtagaatgtagtagacaattgaaggaagacctgagattgctgaagcatgtggatgataagagtcttttcaattgaaatactcttatgtataaacctattatggacagaatgagggatttttctgtctctctaatactgagacaattaaggatgttgggagttttatgtagagagggaaactcccaacacttgggcttctaaattccagtcttcaggcatctttaattctgagcccatgtacataagtagactttagaacaggaaagacaggagagtagaagagaaagagttggatatgggggttgggggtgattattgaggcaatctcacaatgcagccttaggtggcctggaattcatagagatccatctgcttctgtctcccatgtcctgggattagacatgcatcctaacacctggccccaaaattgtaaggtacaaaaagttaacatcttttattttgagattgcaagaccattttgatggggagtttttatactggaaatgttctttagcatgtagcacttctaaatacagggcagctaaaggaggaagtttgggttgtatactgcctatgtgttgtttcaaataaaatattaaaaattataccattgactcaatagttgttatttattgtagattgattaatcacatttctaggtaat

SEQ ID NO: 35772 - DNA, 1534 bp, Mus musculus
acgtttgttccaaccctgaccacatcagtcttataattacagctcatgctaatgagtgttctcttatacaagtttggaactgtaacttttgtatagtattttgtcataaattttattattgacagtaaggtttttcagtattttggtggaagttatataatccaaagttgcctttataccgattaaaatgacttattttgcttccagtaaaaggtatgttttctctcatttctgctttctttcttgcatggcagcataataagttctaatgaaaaagcttttatatatcagaaggaaaaccacacatgcccagacacagcacagttcagacgagtctatccagcgctgttaccccagcctgctgctctcttgctctttctacatttggaatggttcggtgtcatcctcccctcctggctttctcacagtggatgccaattaatggtgatgcttaagtgaagagagaagagaacattttatggctgcacatgttggaaaaaatacaaaaatggggagagggctgcatttagcttttgttgatttttaggagttttcattaacactgaacaatgttcttactgttctctgatttaggccttggttttataaactgttttcaaaatagtttgattttgttaagtctgttttccagtgtctgtctttagttgtcttgtctttaatggggttattttcttattaggaaaaaaacaatttccacttctagaattaacgttgaaggagctctgcatgtgctcgggacctactgtgtgctcctttctccagaattctctgtttgggatggttgacaccgtacttgtattaactggacagaatagatcagttgagagccttctgataacactggaggatcctggtctacagatgtagccaatctggatgcttgaactttttcacctcttcagtggctttctgatatgtctcagtcataagtttgtagaaatcgagcttctctcccgtctggccttcagctctttgatagagcatcctgcggttccttatcacctggcctttcattccagctgccaaaccagatgctttgcctttgagtgttcctcctcagtggatatcctttcccaaatgacaactctggttaactgctcattgactgcagccctctcgttctaggttcctcacttgcttatggcatcaacagttttttgattacttctaggttccaatggcagcttctcagctgcttttcaactcatcatcaaaaatggaagcactgtacatgctacaataccattgagatcttgagacagtgagatttcttgttctggtcaaatatcttctggaagccagattcccttcaccacagaatctctttctggtcaatcttgaaggtgcttctacttctgttcccacagagtctgagaatggactcacaagtacatcagggaccaagtagaagcctggactctactcttgccaaataagagcaaagccatgaccacacccctaccgtctgtattctgatgcagtggttttaagagcggcctaatcagtaccatca

SEQ ID NO: 35773 - DNA, 2605 bp, Mus musculus
gggtttttcttttccaattatggtctcaccttgtttctcacaagaaaaccagggtcctttcttggcatgtaacatgtacgtatttctgaaatattaaatagctgtacagaagcaggtttatttatcatgttatcttattaaaagaaaaagcccaaacaagctggaaaatttccatttatccctgttattttagctgccttattgggagagaagtggagttgactttgggttttcttcctttctttctttctttctttctttctttctttctttctttctttctttctttctttctttctttctttctttctttctttccttccttccttccttccttccttccttcctttcctttcttccctttctttttgctttttttgtttctttcttccttccttccttccttccttccttcctttctctctctctctctctctctctctctctctctctctctctctctctttctttctttctttctttctttctttctttctttcatttatattaagttaggacagaatgtgaaggcacaagcagggttctgagccaattgccagactgtgttcaaacaccaggacaagaacagaatgagacttcattcatagttggagattggaagagactgcagatcaccccttttttttttattgagttgaatcacatgtaacttgatttcttgaacccacccaaacttaaagtggaccccatccagcaaagtaaagattcttgatgtagtctcccttgaaagaagaacggcactcaggacgtcccacttaacccatggacacgtaggcttggggatgtttattaaacaccagataagttaggaagtcacagtgtaccaattttttgttttagtgctgacactttctgttttttttttttttatcccgatggcagtagcaagtgaccagcgatctcatttgttcccctgtgttagagtgatgcagatttctgaccttctgaccactctgggcagagtgccataaaagggagctgtctgggctccgtgaatagctgttaacactcttttgagcagtttttgtctagtgtgtacatatttgcagggtttttttttgggggggggtatgtttgtttgttttatattccagtttttaaaatagtataaggctatctactttgatttttgtttttttttgcctgctccttttgatcagttaaatgaaggacttagagtggtctgcatccatttgctacatatcccaggcaaggagcccacagggaagagagctgagtgctgagctcctgcatcttatcttttgtgggagagatgagaataagtaaaactgggaagagcacatcttctcagtgactcttagccacatggatggagtggcgaagttgtcccaggccaaagactgtccactgccttgtccccttggaagccctttccttgtgtacaaataaccagtcagaaaatctggaaaacatagcagatcatttcaaaatgagttctcaggtcttcagaaagactacaatcatgcaagtctcttcctgctctaaaagtcatttagatcccagaattctactgaactgaaagcccacaaagaggcggtttcatgttactattcaatcttcagctgtaagaggaaatctctatttttatattgaaacacaattacttgatagctcagggtctacatttcactcaactttttacaccaaattctgaagaatggtcaaaataaaatattgggggctgttgtaaacagaggcttaattttattagaagtagccagttatttattaaagcacgatgttaataaaataggcatattctagctggtgtgtataagtgtttgttttttttttcttaaagcaaatcacagagaacataactccatttatataagagggaaactagattgtaaatagctgggctgccttgagagaacttggaaaatgtgctgatagttagaaagtacctcagttgtgaggaatttcctttttagcttagactgctattacttttacttggtagaaacgaatctggtctccaaaatatggctcaaagagttgtccctgtagaccttgttagattgtttttaatttaaaaccttgaactctgcccagctgttttctttcagtcaagtcctccaaactaataacattttccgaattaaatattcttgaaggtttctctggacgctcgctgatttgttttctttctttgcatttttttccctctgttgcccttttattatttaaattgtcttttgcttttgaacttgaactatgaaataaacaaatcatagatttttccattcaggtctgactggacaacttttggcttctcaccagctggcaggcttaccctcccccccccacacacacatactacccctcccctcaatagagaagaaaggcaagttgaatatttgaaagcctttagagtttagagcaggaggcagaagaaaagccttaggagtggggcctgacttccacaaagttagctgcatgtgaagggtctgagttttaccaagttatttatgaagtactttgctttcaaacacttcacatactctgcatttaagacaaacatcatagaagagattgccaggaggggaatgtaaggcaaaac

SEQ ID NO: 35774 - DNA, 1369 bp, Mus musculus
gttggctgtgagcatctgcctctatatttgtcaggctctgggagagcctctatctatgagatagaaccatatcagactccagtcagcatgcattttggcatccacaatagtgtctgggtttggtgactgtatatgggattgatccccaggtggggcagtctctggatgatctttcctttagtctctgctccacactttgcctccatatttcctcctatattttttctcccttctaagaagcactgaagcctccacacgttgatcttccttcttcttgggcttcatacggtctagagagatgactcattaaaggctaggctcacaaccaaaaatagaagaaagggcagtcttagaatcagtatttcagaagttgtaccaatgttgtagcctgacattgaagaaagtagtggttgtagcaggccatgcacagggtcttgagttccagctgcactagaaatagcaaatgaatgaagaaaaacaaacctcatgtgatactcaccccaacattaactctagctttccagcatctgtcttcttctacttgtctgatctgactcttagttgatttccattggaggcaagcttcctaattgggaacagcatctgctcatccatccttaagttcatggttgatgctccagtgtcagttgtgtctatttaaattcaaacatgattttcttgtttttttccctgtcacccattaggtgaaccccacagctcagtgcacccatgcactgctgaagatgatctactgctcccactgccggggcctggtgactgtgaagccctgttacaactattgctcaaacatcatgcgaggctgtttggccaaccaaggagaccttgattttgagtggaacaatttcataggtaagcaagtgattgatgttctgtgttttactagagatgactccacttctggccacaaggactgttgtcattgccaggtatgaaattttcaattcatgttagtgttagacgttctccagactcttggctctgctacactaagtactttgaggttagtaaaatcagtacttcaagtcagtgtcctctttcagaagacagttagatacaccaacttttaatgttgcagaggtacctttttgatattttctgagaaactcaggtttagtcctcatcctaggtctttctttcttcatgttccctctgatgtacagtcttcacagagccaggaaagtagctttgaagagtctctcttgggctgggcaggtggctcagtgggcaaagcgcttgttttgcaagaataagggtctatgtttgatcccaagaaccagaaacaaagctaggtatggtggtatatgtgtaatcccaggatttggttggtagagacagtcagcccagcctt

SEQ ID NO: 35775 - DNA, 1196 bp, Mus musculus
gaggtagccatctatgaaagtgtaacttcgtgatagagatttcttttcattgacaaatgatttgagatggaaattcctcagaagtacactttatatgcaaatgtgctttccagtttaatctcacaattgtttttcattttttttctaatttatctcattcagttatttaattactagaaaactgcctttctcatttttcctctccttttttgggggttttctttttagaattcttcaaagaacttcttgaaaatgcagagaaatccctgaatgatatgttcgtgaagacatatggccacttatacatgcaaaattcagagctatttaaagatctcttcgttgagttgaagcgctactatgtggcgggaaatgtgaacctggaagaaatgttaaatgacttctgggctcgccttctggagcgcatgtttcgcctggtgaactcccagtaccattttacagatgagtacttggaatgtgtgagcaaatatacagagcagctgaagccttttggagatgtccctcggaaactgaagctccaggttacccgcgcatttgttgcagccaggaccttcgctcaaggcttagcagttgcaagggatgtagtaagcaaagtgtccgtggtaagttctctgcacgtactctgtgtgttgacattttgactggtttgctttcaaaagaaaggttgaagaatggtgcaaaaccaaatcattagtgttccattggctcaataacgatcttttcttggtctctcacctcccacacgttgtccgcaggcatgtgttgtttagaattatttaccagtgctaggaggagcatctttatatatcattcttcttttctgtagtttccgtggtagccattcttaagtaggatgtacattgactctaaaatcttaattttaaaaatgatcttaacaaattagcctccatctgtttttagttatttttctcttcttgcaagaatatctctctctcccaatctctctctctctctctctctctctctctctcacacacacacacacacacacacacacacacacaccacaccacacacacaggctccatgcttactatgagctcactagttgtagactaggaaatgatatgtacctaagagcacttgtttccttatcacaaagtgtgctcagagatttcataaaaatactgtgcactagtcaaggttttgatcatgac

SEQ ID NO: 35776 - DNA, 1169 bp, Mus musculus
cacacacacacacatggcccaagacactaaataaataagggtaaaacttcttttttaaaagagccttattgctctagtgagttctccaagattcctattggaacgcatctataattcaaatgcacaagactgtgctgtggcccttttccaccttgttcttctcagcagcattaactgctctgtcccttaatcctcagtagtctcagtatgtcttagggtttaatttacaagtatgttttagattatacatttcttagagcttttggccaaaatgttaacttaaattttcaaggagtgctttttataaatggagacagagtgttgtgcagaaggctatataccccaaagagttagtattctaagaatgagatctctcagaggaagatgacattggcaatgaacatgtccatgattctaccttgttgctcttctttacacaaggtgcaagcctttcttactagttagctgagtcttcctggaaagatcgaacatgaaggtacacgaattgactttattaggcattgcccaaactaatgtgttctccactgttcaagtataagcaggccctcataaggtcctgttgaaggtcttggtggatgtgaggagggtggagtgtgtggggttttatacttctctttgtaaacattcagcaaggctactggtaaagctggaagggtgtgttctgtcctcagtgtaaaaaaactcctgtaggcaagtttgaatttcccaatgtctagtgttttcattggagaagaaggttccttcccaatttctcactatgctctgccttcaagatgcacgtgtttgtgtgtgtgtgagagagagaggagggggaactcccacacacatgtcaattgctgaagaaaggggtcttttgctttggtaagttttcatagcactcagtaattcaatagattatccattttacttgtgtgaacctgctaagattggatagacaattggacatgacggtgtcttcaatcccaacattttggatgcaaagataggcagatgagtttgaggctagcatgatgatttccagttcatccagagccacgtgattaccctgtcttaaaaaatggattggatagatatggctatttttccagactcctgataatttatttttgccttgaaaattttatacatgcccaatggaatatttgtaa

SEQ ID NO: 35777 - DNA, 1184 bp, Mus musculus
ttcatgactttgtccaagtatcatcacaggcctcaagagttggaataccatcagggacacagttccaagttcttggctcccttgagtgacaactgttgtctgttgagcaacatcagacacttaaagtggaattctgctactgagaaatgtatgaccttgaaacctgtcagtggagcttcggaaaagaggccgctgagacttcaaatacaccttcctgaacaagacacaagcaactttgcaccttccatgtatgtgtcccagatccctgatgcacgggactgggaatatactgactgggagcagaaaatgtaactacaagagagctgtgggtgccaatataataaaaccgtggatttgaatcagctgtggccagccaagaacaacaggaccaaaacaagaaagggggattgctatggctgggaatatagcagaacaaaagactttcctaggaagctgaagtcaagccacagggccctagtttggctctgtcccattgttggaaaggggataacagaactctttgagtgaagaaagcagttgcctaggtattgggtatgttgagctaccttaggccagtactgtgttcttggtgggaaagtggggggtggaactaggagtgcagcaaggctggaaggggctgggggaaagcaagcaaggcaaggaagagagcccaggaagtgttgagggttgagttacagtttcatggcattcccctctgctgaggtaagatgcctccttcctgttagaagcagatgagtagctctgggcatgtttatacagctagtgatgttgtcatctaggaaagtttctgtgtgtcaaatcaatatattttattgagactttgagccttttgaaaataaatatctgatataatgtcacagcctatggagaatctattaaatcccacttcttatagattttcttataataaaaccacagcctcaaacctattactgtctttggtggccaggactgcagagatactgaatttttgactgtcaccatttcttctcctgaaacaggaggctgggaaacttgtaattcagcagtgtgcacggtaatagtaggtagctcagttggtagagtacttgcctagcatacatgaaaccctaggttcaattcctagcattgcataaaaccaggtgtagtggtaaatgccttgaattctaggactcagaaggtag

SEQ ID NO: 35778 - DNA, 1276 bp, Mus musculus
aacacaccctctccttcccacctctgggaatcctggctttccaaacaaaaggaaagtcgaactgggagttcctcaccaggccagacaggccagaagctgtgaatggtatagacctgatgtgagagaaaggtcctgcaactcaaatcctctttctcttttgacagaactggcctatgatctggatgtggacgatgctccggggaacaagcagcatggaaatcagaaggacaacgagatcaccacctctcacagcgtggggaacatgccgtccccactgaagatcctcatcagtgtggccatctatgtggcgtgcttttttttcctggtgcactgacttgccagcgtccagtgcctgtgctgccctgcagcacctgtggtccctacagaaagggagccaccttcttttttttttctttttttttttttttttatcttttatgcctcctcccaccaccattaagtaggagactaaccgcgtgttatgttttcgaaaatcaaatggtatctttatgaggatggtaaattttagtggtaggatagattgtctttttgcaaagaaaaaaaaaaccttcaagttgtgccaaattattttcttacatttgactgttggaacatggttgtcatgtttccctcttttctctttctctgcatggatttctttgacaaaaaaaaataaataaacattcaaataaatggtgttggtccttttttaaaaatatatatatatatatatatataaagggtcatatacttcttcctttatccaaattttgctcttattatctggccttctattcagtataatcccattacaatccaaaaacaaaaacaaacaaacaaacaaaaaccctgcaaaccacttctttacctatgccttctgaatgagtatcaatgctggctttgcatcctgattaaactgcccattcttaaggtatatcacatgcccagtctcttccattgagaatccttaggttggattgtcctgtgtatgagatcaaaggtgtcacaaaagagttccaccatgacctctctttacaaacttcccttttgaaatgaagagatgcctccattgctaatgtgcttgcttgccttgaaagcttgaagacttgagttcaaaccccaggacccatacaaagagagcaaagcctagtggcatgtgtctctaatcccagctttgtaaaaacagagacaggagaaaccctgagtttgctagccagccagcctattcagtgagctccagaccagagagagagagagagaaagagagagactgtct

SEQ ID NO: 35779 - DNA, 1246 bp, Mus musculus
aaatggatcttaatcccaaaaacaacagagacatatcaaattcatttacaccctggatttcatggtttaattttggggcatgtctttttctcttattttacagaggcctttgaaattgttgttcgccatgccaagaactacaccaacgccatgttcaagaataactaccccagcctgactccacaagcttttgagtttgtcggtgaatttttcacagatgtgtctctctacatcttgggttctgatatcaacgtggatgatatggtcaatgaattgttcgacagcctctttccagtcatctacacccagatgatgaacccaggcctgcctgagtcagtcttagacatcaacgagtgcctccgaggagcaagacgtgacctgaaagtatttggcagtttccccaagcttattatgacccaggtttccaagtcactgcaagtcactcgaatcttccttcaagccctgaatctcggaattgaagtcatcaacactaccgaccacctcaagtttagtaaggactgtggccgtatgctcacccgaatgtggtattgctcttactgccagggactgatgatggttaagccttgcggtggttattgcaatgtggtcatgcaaggctgtatggctggtgtggtggagatcgacaagtactggagagaatacattctgtctcttgaagagctcgtgaatggcatgtacagaatctacgacatggagaatgtgctgctcggcctcttttctaccatccatgattccatccagtatgtgcagaagaacggaggcaagctgaccaccaccgtaagtatcagtcttcaggtttcaaaagaactgtccttcattgtggtggtgggtggggtgatctctccagcaacagatactgatagaaaaatagagaaaggaaaaacgacgagcaagtgagaatgcagatgggctgaatgtactctccgagatagacagaatgttaaaactacagggtatagagttgtaatactagatctagctccacatacttctttgctgccgagtattgggaacaaattttatctttatgagttttatgttttgagttcatgaaagaagaatagcttgtatttgagacatatagcatctgcgtggtatatggtaagtctttattaaacattagctgttattgttgttatcaggatccttatgggaatatttcctctctctcttataaacaaggaaactgaagcttagtggactgtatgttgcacaggggcatcca

SEQ ID NO: 35780 - DNA, 1162 bp, Mus musculus
ttacatacagttttagaaaaaaaaaataggagaaagaacaatttacagcctcttcggtgctcctaagagacaagaagaattccagaggtaaaaagtatctctggttccaagggtcagaggcccaagagcttgaatgggaggatcaaaaggtcaaggcatttgatagggctgttacattcttatgacatctaaaggcaaaatctagctgtaacacttgtggtgtatacctgaaggaaattagtcagcacacacagagatatctacagacccatgtttattgctgcagtattcatgagagccaagccaaagaagcagcctacatgctcatcagcagatgaatggataaagaaaatatgttaaactgcaacttcattcagtcacaaaaaaaagtttgcagggaaactagtggagctggagatcattttattcataatataaatgagattaaacatgaaacacgttcattttaaacatgaaacaagtttatgttttttctaatatgagaaaacttgtgtttatcactgtctacatctatctatctatctatctatctatctatctatctatctatctatctatctatctatagattaatcaacctgtttatccatctgacatgaaattatgagataagaggaagctgtctaaagggagggagaattagagaggataatggggtaagaaaatataaaataccatgctacatttatatgtagaatctaagtttaaatacatacacatatgtgacctgacagaaaaatgagggctatgtccagggtaagatcaatgggctgagatataggggaagtacgggggaaggcagtatataagcaaggcacactatatttgtatgcaaaagttattatggacattattttgtctattaactaaacatttaaattaaaaaagaaaaatataaagaacttcaagttttttttttaaaatagaagggggaggtggctgcttacttcctgatatatgtgtacacacacacacacacactggcatggcaggattgtgagtattgattagattctcaaaccttggggattaactcatttgtccagtgaaacttcttccgtacaaggatgccactatgtaggagttggaaaccttcctctatatcactatattggttaattttagaacagtttgtttttga

SEQ ID NO: 35781 - DNA, 1099 bp, Mus musculus
cattatcttgaagccatggagatttaagaaacaagcaagtttggcctctctttgttgagcttatgaaagccatatttagtcttctgaggaatgtgtttttcccttgggaggcccctctatacctgcagccatcagaaattccatagtaaaagcccacatttaagtctttacggctgaagtctgttcttgtgtgtctggaccaggtccagctgtcagacccagatattattgactttttcttttctagtgagtggtttacatctgctggctccatttctttaccactaattctgaaacaccttgtaagctgactcctactgcctctgtattaaaattgtaccctcgaagggttacaataactgactttttggctgtagtcagtgggggattatttttcttcacttctttcttaccccttactgttacttttcccctgttttttgacacgacatgaatttccctttctctcttcccctgactttgcttctctcctttgggacagcagatcttttgggctctttctcactcatggaaatgtgactactctcctctaaaggatgcattcagtggtgcgctcatggctttttacgcttcattcaatctcatgcttctagctggtccctccatgcaactaggtcttcagttcctacttcttctgacccatgctccagggctgcatttccattgcacaaaatcaactgggatggctttttatgagccacacattgtattatgttcttcctgcttatgaatgttgataacttagtattagtaacagctgacataaggcatattcacagctgatctacacatacacatgttaagacaatgactttgaaaaccactttaacagattattagggaaaattcaaatgtccattggtggggacagtgtttcatctgtgagccttatttgcataatgctacaacacttacaagttgatgctataaaagatctgagagctgacaaactccatgtctttcctgtgcacgtgacagaaccaccaggccacatcagttcattacgaattctccacattccaaactgaatgctttacttcgggtatttttatgctgctagcacctctgtgaccatttt

SEQ ID NO: 35782 - DNA, 1159 bp, Mus musculus
gcttggaaaataagttctgaagcccgttcactcatctttctgctcaaatagtcagagaggaataaaaccaattgcctcagctcgtattttgagacttctagatgggttctcatttatatgattaaagaaaagatgtacgaagatgttaacaatctccaaccctagttgcaaatctgagcattggatgaaattgcaggcattaaaacgtgagaattttgcctgacaagtttactttcacactcatacatgcgcgcacacacaccacatctttctaaatgtacttcagggtgggctttagagacagggccagactattcagtgttggctgacctgaaactcactatgtagacaagcctgacctcaaattctgctgggattaaaagtatatgccaccatggccagtaaggggaggcggttttagtgtcctgtgtttggggtttggcattttagctcttcttaaatggaacgagagcacatggttattcatatttactaccaccgcagttttcaggttgatttttgggaagctgtgagttgtagaaggctaaatcagcagtatttgaaagagggctgggaaaggagtaaaggaaggcttgggggctttggactgttcttattatgagtttcctttggaactcctttccccctttctctaggataaacatgacactgcttttgggaaaaaccaatggcagtaataaaatgcacatgacagatcctttgttttaggccctcattagtgcagtagagggtaggtctgttctcataaacacaaacagcaaacaagagcaaataattaacattggccatggagccttttcttctgttatgaactcaatggggtttcctttaaccctcccacaaggctattaatcatacttgtaaatgcatttgcccccgaagcttaaatcagttgtgtgcctctggcaactgtggctgcattaacactagaccatttaaacttgagatttaaactccaaattctcttctattttttttaagtcatggtggcagagatcatggcttatctactctattaatttacacccagttcataatttagtatttccatttacacatgatggaaaaaccatatgctactcagactctttgctatcgttactgcttcaggtattcctgttttccatggcatctttcc

SEQ ID NO: 35783 - DNA, 1121 bp, Mus musculus
actcttcctagacttgctggctgaccttgtcatctgccactcatccttttctcttagagtggggacagggctagtgtgccaaggatgtgctctgacttaagcaggcagcagtggaagtgcagctctgttagaactctttgtgtccaagggaaagttcctgccctttgagccattaaataagaagggctgtgaggtgaaaggtatgagggaaggtataggaaaggtctatgctgccctttgctacaaagcctagtgattacaaccaactcagactcagtttagctggctttcaatgagactgatgatagttattgttttcttactctatcttgtacattgacatttgtaaatgcagttctatatggaacacctactttcactatattgaatggaatatatctgtcacatacacattttttagtgcttttaaagctttgatataattaaaatgaatataagattatagattggtattttagagcattttatgttcatttaaagatggtttcttctgaaactgtacctctctctctctccttatccctctctagtgtgtttttgtgagtttctctctctctctctgtatgcgtgtgtgtgtgtgtgtgagagagagtgtgtgaatgtattcatgtatttctttaagactacaattttcaaaatggttccctagtggtctgaacgagtctcacatagtctctcaatctaacctgtaagaggaataactactctgatttctattgggttgtattagtcgcattagtagcatgacttcctactctcatgtcacaaatcactctgaacaaacttcatgctacagggatgataatctgtgaggtgggtgacatgtcagctcatccaaatatgctcttgtgtgttctaccacataagggaaaagaaagtcgcctttcttaaatgtctcttgtggatccaccttctcagcctcccttcacaaaggtgctcttagttccaggaagaaaagagacccagtgtgtggtcacttaggcaagtaactttatgttgaatggtaagttttcagttatcgccctaccttacagtgtgcttcctcactctcaactaggttagtagttcttctaatttgaggaccatgaccatgcatgtga

SEQ ID NO: 35784 - DNA, 1194 bp, Mus musculus
gtaatttacacgtatcatttcatttaatcctcacaatccacctatgggtgggtctttgttatccccattttatagatgaaggtgcaagaccagaatggttaggtgatttgtcaaggctacccacctaaaattaatagtgaaggcaagatttgaatccagctcacctggtgtttagaggtgatgattttatcccctaacttaggctacctcttgccactaggaagattacttgtggatatggagcttctcttccatcccttccttatagttgtattgggaggttgctgtggacggctatatacttggtaatgtgggtgtgtgcacatgtatgtacatgtgcggaggtcagatgtcaatgcatgtgcatcttcctctctcccgctctaccttttatttttttttttttgaaagaggctctctcacttaatgtgaaccttacctattcagctaggctaactgaccactaagctttagcaatcctccttggttgctctccatctccagtgatggggttacaggcccacactgctacacctgactttttctgtgggtgctgggtctccgaactccttacttgaccagctgaactctccccctaacctgcgtttctcccttctaaactaagaatactgaatcaactgccacttgcctttaatgttggcttggggtcagagctaacactttggactatttgacattcttaagtttcagattaatgacacctttacaagaattaacctatgaattataaggtgggtcaattataccttattttaggtatttaaagtgaaattcttagcattagctaaaatgttgttcaaattagctaataaaacatacattgccaatggtttcttgtgtcaaaagccccagggaatattgatgttaggttcattatatgaagtataatacaaaagcgtgaaatctttgttaacctatttatgcagtgaggctcccgtgaagcatttgttgagactaacaatttagtgatagaatgaataattcagaccagtttaaaaaatacatgcaccattcatgtacttcttagattggttttggagttgatacactggctggaagtggggtgataagtaatgttacaagaggattgggaaaaaaaacccaagaggattgggttgaagtggacagatgaaacagtcaaggcatggaggtacttgatgagaatggaacatt

SEQ ID NO: 35785 - DNA, 1150 bp, Mus musculus
atgccagagcgcccagtgtagagcagcggcgagcgagtgtcagggcaggattgccgggagccaccgcacacgctccttatcctcttcccgcgcctctcccaccaaggcttgcccgccaccttggtaaacccaatctcccagctaagctccttgccacgccccgcatcccgcaggccagcagctacacgaccccacgccgtcctccaggcagcgcggctcgccttgcctcgccccgccccgtccctcctcgccacgcccacaaggctccgccccgggccgccccgcaccgccaagctgttcccgccctcgcccagcgcccaggtagctgcgaggaaacttttgcggcggctgggtagcggctcctctcttgctctgtcgggctactgccagacttgctgagtctcgggaccgctccggctcttattgccactctctcgtgctctcctcgctcccccaagaagcaggatggccgggaccgtgcgcaccgcgtgcttgctggtggcgatgctgctaggcttgggctgcctgggacaggcgcagcccccgccgcctccagacgccacctgtcaccaggtccgttctttcttccagagactgcagcccggactcaaatgggttccagaaacccctgtaccaggtgagtaggggtcccttgagcattccccgcgcacagtggaaagccaaggcgcgcgtggtggctcttcccagagcgcgctagcctggtggggccgcagcggccgtgctctctgctgcaggatacctgggaatggttgctgtgcctggggcctggaccatctaccaagggagggaagcacagtatgggactctgtccacatgccccgggctcacgctgctgtcaggaactgtgcaagccagagcgaggaacagcagagatcgcctttctagcgcccattttttttgggggggggagggcgggaaggtgggagctggctcccctctgctcttagcaaaccggcttcacaacgtgaagactgtgactcgggaatttatctcccttactagcacgtctgccttagctggacccgtagttctggccacactttatccaccgtgtgtccccccatgctttccgttccccagtctgggttcccgaggctggccgggcccaagtgcaggcaaagttgagcac

SEQ ID NO: 35786 - DNA, 1182 bp, Mus musculus
acaaagggggaaaaaaaagaactgtaccttctttgtcatagcaatagcaagcagagactattcagtttctaaggaactgacaagcttttgcagcccaaggcaggtttccaaaaggaacacctcttgctgatgatatagatgcctgtggatagtcagtccccacagttcagttgtggtgctggggatgaaagtcaaggaatcgtcaaacatgttagacaaatacttcaccactgagtaccaactccaggccataatgaccaggactgaaataagatattgttaaaactaatacctcgctctttgaccgagacccgccaacatgggccgcgttcgcaccaagaccgtgaagaaggctgcccgggtcatcatctagaagtactacacgcgtctgggtaatgacttccacaccaacaagcgcgtgtgcgaggagatcgccatcatccccagcaagaagcttcggaacaagatagccggctatgtcacgcatctgatgaagcggattcagagagggcctgtgagaggcatctctatcaagttgcaggaagaagagagagagaggagagataactacgttcctgaggtctcagccctagatcaggagatcattgaggtggatcccgacaccaaggagatgctgaagctcctggactttggcagtctctctaaccttcaggtcactcagcctacagttggcatgaatttcaaaacaccacgtggagctgtttaatctgttatgccatattttcaataaacctgaaaacaagaaaaaaaaaaaaaaactaatacctcgtgctgcaaagagaaaccgtgtctcgaatccccccccaaaccaatgacaaaaagcaaataaacaaacaaataataaaaacaactcatacttagcaatctaacaaacaaatgcatgtctttcaataattatatctgaatttactaaaattacaaatgatattatcatatcttaatatacatcaacaaatcatattatcaataggcatattaaatgtgttgatgaaaataacacaaccaggccagcaaagtggttcatgcttttaattccggcaatcagaaggcagaggcaggtgaatctctatgagtttgaaaccaacatggtctacatatagtgagttctagagttccaggacagctacagatatataacaagaccctggtgggtttttcttg

SEQ ID NO: 35787 - DNA, 1220 bp, Mus musculus
attgtaatcaaaggcaacaaaggcgtttttgctttgctacagttaaacttcatttacaagaacaaaaagcaggccatgttgctctcccaggacatttgccatagagtatttggggaggaaaaagaggtaaaatttccctgtgaagaactttttcttcatctttgtaactgtgtacacgtgcattaggaatgtattcatgcaagtgggaattctttttaaaagccagttgtggcatgcaggttaattttaatgtctgtaggtattttatcagaaatttctattaaagtgaactttgcattcgtggtgattaagtagactaagcagtgctggagaaaactgtctggctattatggaaatgcatttatttaaatgcaatcttttttctttgccttcctgtagtcgttttgcaattgggagcactaactttatgtcatagaattctcatttgtgtttgcgaatggaggagaactaaaaccagtaatgtaaaggcagagctccgctcaggaggtgcagctcactgcaggattgtttgtacagtatggtcaagaacctgagttcaatcctcagaaccgcaaaaaccactggccagtaatggcaaatgggctctgtgtggcttgggggactctcttggtgcttacttgagtgtgcctgtgttttgggccttcttcacagattaaatatagcaagcatcctggcagttcacaatattcacagctgcaacgacccatagctgagaaaaatctaaacaaatatgtttgcacttgcaaaatgcctgaaattttcagctgaagaaaatgggaaagaagcaaacttgacgtgctccagtgggagactgtttttcttatcagacatggtttgggtaattggatcgagttggaatagttgagtactcagcggaaggtcagaggggatagattaggcaagaacttcccagtctaagtttactgtccttcaggttccaagtctccctcaactacttcatttcctctgttactctggtaaaaaaaatatatgacaagtgcttttcattggctctattgtttttttagagatacctagaatttgaagtccaaatctgtcttctaagcaacttgtcactacttttcaaggatgtgagtgttcagattttattgaggggttttagcttccttttagacttcctaagcctgttttgatttgtgatccccttcgaaaagactggttttgaaaacacgagtaga

SEQ ID NO: 35788 - DNA, 1126 bp, Mus musculus
tgagtgaaacactgttagtggtagaattattttcttatttatgggaaaaatcattgtatttctatgagtttaatgaaaatgtttacagctaactcacaaaatggctttttcttgccatttcttcttgttagagcttctttttgtacttgggacatgtttcattacttgatgagttagctcaatcatagatggctttgaagctgaagctgtccattcataatggaagaactgtctatatcagtgctgtgcagtcgaagtgcagtgacggaaggaaggaagcaggtcaggctgacactgttgcctctggcctggtatggctaattcgtttttgagatctggtcagtgtgactgaaaagtgagattcttttattataactgacctaatcgtgtttaaaagccaaacaacctgtatcacagaacccatttttacggaattacagaatcaaagcaaatgaggttataatggttccaatcaaaaggtctgtattcagttatttgaaacactggattgagcccctttgagtagaacatagaccaggtaggtatcctcgtttctaggggccatttcatgctagcgaaaagtgtagttcctgcagactcatggacctactgctgattgttaaaactgacccatataaatatagcttttgtttctttttgagcagctgatttagaagaaagttttaatgagcatgaactggagccctcatctccaaagactaagaagaaaagtcgcaaaggaagaccgagaaaaactaaccttaaaggcttgccagaagacagcaggtccacatcctcccatggaacagatgaaatggaaagtagctcctacgtaagtcaaacctggtgggctcccaccattgccggcaccctgaagactttcacttgaactgtgtctacagggaacttatactgtttgaagaattaaataagccttgaatccatttataagtggtttcctccttttatatttacagcgagataggtctccacacaggagcagtcctaatgataccaggcctaaatgtggattttgccatgtaggggaggaagaaaatgaagcaagagggaaattgcatatatttaatgccaagaaggcagccgcacattacaagtgcatggtagg

SEQ ID NO: 35789 - DNA, 3343 bp, Mus musculus
cagagagagttagaaaactgagaaaaaacaactataactcctgtgcttcttttccacttttttctaaaataaagggtttgtaactttttactgcccgactcttagatccttcattgaactgcctaaatcaccttgttagttttctgagccttcagtagacggccgaatttgacatattgatattacgtagctgtagtttgcagtttctgggaagcagtcaaaacactattagccctgtgtatactgtcagcagttaaaacagacattgaatgaagtaaactgtatttctggacagaacaaagttgtactgtttagagtatgtaagtttgtgtagtagatccacgctcaaaggaaaccagaagcaagttgtactccaccttgcaaacatgcctctggtagcaacacctggcaatttgggcaatggaaacgacaaatgaagagactcttctttttgtcttggctttgacagcacatgctctaaccatttctttcacgaagcgtgctgaagcctacctgtggtcctttttagagttattctcactgagcagcatggactctgggcgactggtgatgataagctctgagctccagtgcttctgccaaaactctggacagtacacctttctgtgctgtacagagagcttctggcaaaataatggaatcgtatcaagatcaaaataatgtttggcaacatcagattaaacctctttgaaattcaagaggtcagcaatgcgctaaaggactttggacatcatgtctgaaaccagcttctctcaagtgccctgttgtgtggaacacttcacatattggcccagcatatataaggaggtcttatatgctaacattttttttaaaggaaccatctttgtgcaaaacagtatttctttttgactctgtgaccactattttagaaacattatttaatgctttcagtcatcagtttgcttacagattgaataagcttttgtgccctgtttttcttcgagggctcggaagtgttttctcaatcaccagatttttagaaaggctttctttccactggcatttctcactcgtgacacacatccacttacctgctgaagcacatttacatatttctttatggcaaaaccaaaaaagttagttgtggtctgcctaatattaccatagcacctcagtatgaaaggtaaggattctgagttccacatcattagttaacctcccatagtgaatcagatttgcaaataagaaataacgtactaacttgactgtacatccatctattctgtagctggtagaacagcgttttgaaatgtaacaggtggaaaattacactgtgcttattgactgaatttttaaactgcttgtcccttaagatcatgtttgttaaggtgtgtatttacacatttacttaaatcaagggactcaatgcttgctttcttttaaccatcttttattgttattttagaaggaaactagctttagtggattgccttgtgcgtcttctcctttcgctcttaatatgccatgatgtgtatgtgattaattttcaaggttcatcatgacttgaagtgcaaggacagatctcagtttgtttaccaagcgatgcgacttttcccaaaggatctgtactttatttccttataacagcttgaaaaccattcttttttaaatctttaaatcactgtgtctaggtaatttttccattgtgtgccatagaacttacccatggagaaatggagccccttcatttttggacaactactgtaatgattttttttaagaaaaatggaaggtgccaggggtaattatggccagtcaataattatataaaggacttcaaatactatagccgtcagttgatggatttgatatgtagtacatgtatgattttgtatgggtttcttcagccctttctctgccactagcaaccagaaaagcactttaccttttggttggttagataagtggctaactacctgtttttctcactgtggtgtgattggctagataaccttcatttaaagttgaaatgtaaactgaagtcacattaaacactcacgtttggctgtaaacttccaatagtttgattctttgttcctgttttcattctatgctgagtaaaagtgccttacaatgtaaaaattgtacagtacttacgttcccaagtagcagcttcaccatctggctaggcgtcacattgtggtaggagtattagatcaatagacctcagcagtgtatttactgtacaactcttaagtccttaactgtagttttaataagcatgacattatttggcaaatatatggcatttacatcatttccaaaaatactgccattgctgtctactgcgtatttttagcctgaaattttgatgcgtctttttttcttgtttttttttctttatttcttttgttcccttttgtcattattaatattaaaccgtgtaatctttgcaagcgtatattgaagattattctggagcatttattgccttaccagaaatgttagtaagaaatgttctttagagtagaagggtagacttgagtttctatactttaataagacctctttgttcctggggggaggggggagttttgctttcatctcattgttttaaagcccacacaagaaattaatttcatgtcaaggatcagcagttttcaaacttgaggtggttcttagtacacacgactcaagatactaacagagtaacatgatctacagatctgctattgaatcgaatctatgtacttgaacaaatgtgtgaatctcaaatatctcaaagcaaaagtgttgtagaatgttgttgctttttgaaaaagcactgaagttagaccaaggcacagttttgttttagcagacatttaagttaattgtaaagataaggaatgcatcatgggtcaaaaatcaaacattcctcaatgttatgtatattttgttcctgttatattggctttattttcaaaattgtagtttgtagtattagtttccttttaatggtattcttgcatatactattcattcaataaatgagttctggatttcaggtctgtgtctgctttgtaaaagtgtgtatcgggttatttgtaccagcaatagtgccatgtttctttcactcttcctttacttcaaggggaaatacaaatgcctaggatgtttaataatagctcgacagcaaacagatatgagagggggactagcgagtagttccagcatactcttagccttgacttcagtcccctggtatggtagataaagcacataactcaaaatgcggatggactggaggggtgtggttaaacaaaaatgaatatgatctgcccagagtttcacaatataaagatgtcatcatggaaagaat

SEQ ID NO: 35790 - DNA, 1388 bp, Mus musculus
tctggaggcaggaaggagtcttctgggtgagtttataagcatggtccaggagcagttagaaagtctccatgggcaatattacctaaagcgtattttttatttcacttacctgttttgatttcagctttatgtttctcaaagttacgtactaagacaaagaaaaagcaaactaatggactatagttctgctttgttttcaaattatgtcctcttcaagttgctggtccaaaataccttgtttggtagaaacccagacaacgtaggaggaccctttaatgctgttattacctctttagaatccgcttttctaacgagaatgtcttttattttatagcacgtttgtgtcattagtgaaactggaaaagccaaatacaaagcctaagatgagcgcaagttgaatctgcaaatacgaggagtcctgttgatgttgccagtaaaattagcaggtgttctagtcctgtggccatctgcctagtaaagctttttgcatgaaccttctatgaatgttactgttttatttttagaaatgtcagttgctgcgtccccagacttttgatttgcactatgagcctataggccagcctaccctctggtagattgtcgcttatcttgtaagaaaaacaaatctcttaaattaccacttttaaataataatactgagattgtatctgtaagaaggatttaaagagaagctatattagttttttaattggtattttaatttttatatattcaggagagaaagatgtgattgatattgttaatttagacgagtctgaagctctcgatttcctatcagtaacagcatctaagaggttttgctcagtggaataaacatgtttcagcagtgttggctgtattttcccactttcagtaaatcgttgtcaacagttccttttaaatgcaaataaataaattctaaaaattcgccactttttgaattctttcgtgtaaaagtccttaaaactaaggactgtctctttaaagaaattctccatgtctgtcatttctctacagattaattcagtacagttttccatgggttcccctttgcttacgttttatagctaatttaatggtactcctcagcaagtattgcaggtcatggttatctggtggaatgggttggtagagcgagggaagcgtctacctactggaaacagtaaattacagacactcagcaccatttcctaacctgtcttctattaaaaagaacatgttttctcctcgttttctgtgaggttgttcagactacaatctgacctatagtttgttttcaggtatgtcctgttacccttttggtttggataaagctttattgaccagagaacagtaacagtaaaacattgttttgtcttttgggagtaagaaatatttgggaccaaaag

SEQ ID NO: 35791 - DNA, 1129 bp, Mus musculus
gggggaagggaactttttggcccgcctccccccgcccccaactatgtctctggtcactacagactgtaacagatacggggataattctcaaaaaaatgttatgcgtcgcgctgggtggggtgtgggggtggaaagcgtgtccgggggtcgtggtggggggaggacagatctttaaaatgtctagcaagtgagtgtggccagggaacttctcagaaagtggactgagaagagtaaacggggaggggtggggagagagaaatgagtgaggggcgggcagcctcaggctgtcagccttgccagggtggggagcaactagttttgacagactgtaaatgggactttgggccactcatttgtaagcagtaaagaatgtcctggaaagaaccgtaaaattcgttttccattgtctctcgctaattaaaacttttcaaggttgtttagttgttttttttttttttccagtattggaaaagtttggctggaaggtgcggaggacctgtgcatcatgttttgggtgtgggggcgcatggcatctgcaacattaaaagacaaaacgttctcaactgggaagagaggaagaggcttagtctttggctcttaaatcatttggccaaacccttcgcagttctgaagtgggtggggccattttgacccgtcgtggttctgaagtgggtggggccatggtaaccctaaagtattgattctttgtctattgtatcagcgaatgaccctctctagaagtgaccagacatctctttgtgctctcttttcgtaagtaaagttaagcccaaggggaaatacacaaacccagggagtgagatggctttttaaggatataagtcgttgtagagtgatgggaagaaaagaaatggatgaaggataatctagagatgaatttgattccagtgtattcgttaacaaaattatctagtaagaccttcgtttttgatgatgttatctcgaatgaattttgtttttatgagtagtcaactaaggaaatgttaaattaagaggaattgcaatctctgatgtgacatttgtgtgggacataaagttaaattgggagaaaaatacgtatctttaaagtataattgtatctttactaaacacggcttttctctctcctctt

SEQ ID NO: 35792 - DNA, 3510 bp, Mus musculus
aatacctgggaatcgaaccaagaaaggcagcttgatgtcaagcagagggttttggttccatggaaagtatgaagaagccaggttttgaaggcaggccaacgttgatttgtgggcatctgagctggttggaaagcatgtccctgggattgcttatggaagcccttggtgtccaaatcagtttcagggggaagatgagagcagaggccagttgtttggattaaagagacgtgatggagactgtgagaagagagcatttcagaagctcaggtggagaggaactgagaggtggaaaaaaaggaggctcttatggctagcaggggatatttgggtctgtaaagaaacaggaaaacggattcataaaatgaaaagaatagcaaagacatgtacttagaggggaaaatcattcaaaatattttccttgaagcctcttgggagtgggcaaggaaaatggtcagtttcaggcagttgaaagactttcctcaaaaatagaagtaatatttctgaaggcacactcggcaagtttgagaacaaatagcttactaactattaataacagaggttattcttgctctgagactcttgaaaggtaagaagataaatatgaagatagaaatatttcagacagaggacaggaacccccctcacaataaacctggcatggtaagagggacagttaccatatgttagatagtcaggcgcctccatagggataatcaaagtatatgagacagtgtggcaagtttcactttgggtttctgtggctttatgaatttcacaagtctctcaacatggtgtagtatgcatttcagtgctgtggcctttatgcttcttattatttaccgatgctgtactgatgcgtgtgtccgtgaaatcatgtcattgcatgttatgttgaccctgatacatgcattcgcttataattctttttgctttgtcctcagttcagatattttggatggcagtagtatcagcagtggcttgtcctcagactcactggctacaggcagcgctcccgcagagtctccagtagcatgctccaattcatgctctccgttcatcttgatggatgatctctcacccaagtgacttaaccatttctgattgagtgttttaactgtttcccacataaaacattcagtgaggaatgcggagaactttgatccacaatggggattaaagtttggcagattgcaaccattccgatgatgctcctatttctgggcatctctctctaaagttcaattttgcaagcagagtcaccttactaacatctgtttgggctgatctcattttgcgtttgatgactaaatctcaaatacacatttctgattgcttggaggactttttccctagtgcctcaaagagcacctactttcaaacatttaaggggagcattcatgcatattctctataattgttcttttccctagcagtggcaaaacagagttaatcagaaattctcttgcttgagagatttataaaaattctctgttgactacatactttcccatctctttatttcatggtaatattcaaattgtttttgattatatcaaattttcattttgtctgcatcagctttaaagaacattgttttgtttcccttgcctgtttgacctgctccttgccatttctcaccaaggggaagaaacccatagttgcttccatcaccaccattcttgcttctttgctattggaatgtatgcagtaacgtctgattttacaatgtagaatgaactagacttacaggatgcctgcattagtcacctcagggtcttaggactttgctatcacagttgctatttttctccccaaacctggtgccttaagggatatataaaatattgttgatatttctaggtggtgttatcaaggagaagaaattcctgccttgaccagatgtgtggagcatctacaaatgaacgaatagttatttacacaaaccactgtacaaaagcaagcaagcgtccatgaagctgtcagtgtcttgggtagtattatgaggccttaggtgccttggggtacattgccgtcctgtagggaatatgtgtcgtagggtcttgtggaaatggaagctttctgtatgtgcgtgctattctgtttgatttttttttcctgattccctgttgtccttgagtttgttctgtcatgtggtgaccgggtgttgttggtttttgtgctgtgctagagtcagaaccctcttcttgtccttgttgccctatagaggtcagtttaatatcttaatatcagttaaggaagctttgaggagctaaaaaggtcagtactgctgtgccctctgcttccagaagtgttttgagctctaagcagtgtatatgcagtgtgacgtaacatatactctgtaatttttacaaaagaaaactcctgactaaaatatttaagaaatccacgtgtgatctattgtggcagtatttattatgtattacactagaaatggtgtaatagtgcgatgtctgtgcggttaggtttcttttaatgttcaacctggtggatggactatttgtttaatattcccactagaatcgtgttattaagtgaatgtaaaaaaaaaaacaaacagaaaatgattaagcataagtcttttgaaatctaaagtccttggaggtggtttgaaggtatttacagactagaaattagtgagcttgaagcaaaacctctcttctaattatcagagaccatcacttagcttgctgcagttccattatagaatcaggtcttaagtttacattgtaatcactgtcataaaagctattactggcctgagttcccatgtttctttagcctgtgaaaagctcctaatcctccaaacctaacataaatgtgctgttagaagactcgcccactcctgtgctattttaaagaaacaattctttgatagcactcggtgtatccactctgttaatgaaccgtattcaaaggctcttgccttcgtaatgataagagatgagtttttctttcaggagatttgtctgccttcactcttctgtcttatttgccttaaagggacactttgcagttcaaatttagagtccagatttaggattcttaaaaaataatctttgaaatgtgatgatacctaaatttgtgtttaaaactcaatggtaaggtaaaaccagagcagaaaactgaaactgtcccaatggtatgatgagatcaaagaggcaggattccctttactgtttgagaccaactcttttactaatgtttctaattgagtgttttcaatttgttctttctcaattccatactcatttaaaattcattctgattactcttgccccctaccctcctgcatctctgtcccaaccatcagtcaccacttcttcttacagattcccttatcacattcttgtctttttcgttgtaaagtaaccttttattattgttgtcttctatattgtttaaatggactagaaagctaagtttgtgcagggattgttttgaaataaataaaactggtaatatgctaatccacagagcagctttgttgac

SEQ ID NO: 35793 - DNA, 1447 bp, Mus musculus
ggtttatagggtcatgatgtcactggaaggttgaggagatgtgggctgagacccatgctaaggccctgtttctctgttcccaggcttgcaggcctgtccctggcatcacatgggaaacctcatccagataagctggggacagcctgtccaggaggccctctgtaggctagaagttgtgatctctaaatgaccaaggacagctcaagggatacttttacttcttatcccacagtcccccagctcctctggcactggtatctcaaggtctatgcactccatccctgatatggaaaccttcagcatgccagccagccccagggacagagtggcccaactgcccactccgagtcagggacccagatgaagatctcagtttgtctcccccaaagggcacaagctgaaaggtggctgccacatggcctctgctactcaccatagggcaggactgatggcttccttctcccaagtttcactagtagtccacgtatgtatagtggaatgtgtgtgcgcatgggcttgtatgtaaatgtgtgtgatgggggtggatccattgggtagggagagaagctcctgagaatcccctgtgttccaagtacaggaaggatcacatggcctactgggagaaatgagtgtgaggtccgaggccccttcctcttagacctcacactacagggaagcccatccctggccatgctcaggcatgggctatggtgtgagatcagagacactgatattaggtagactttggggccagtggtgtcagccaggacagggcagagctaggactcaccagtgagttcatgtcccattctggccctgattagtctgtgagattctgctttcccatcccctcggctacttttggtcttccgtagtgccctcgctgtatgatatcatggtgcactttatttgcagtctgtactgcaggcaggcagaggagcttcaacaaattcagacttaacctggatgacctgacatcctcatgtttacatttccatgtgcgatgggactctgcatggccagcgctgtccggtcagagatgtggtttttgaagttgtcacatgttgtctcccaaaggtaaaagaaaatctgtacaccgaacacatcctggctgcctcctgtttctgttgggtgccataccttatcctgggtggggaagtgggtggagcataggacagcaagctccaagccaagagggaagtccagagctgagcagggaaactccttcagaacctccttccagatcacccttgacaggaccaccctctgctccctccacccccatgggccaaatgggtaacattggagctaggcccagaatgttctaattgatcaagaagtatagatcttctctttgcttctagagactaatgtttaaaaaaatgattaactgaagttgaactttgagggcaaaaggaaatgtaactggtcttctgcagaagctgct

SEQ ID NO: 35794 - DNA, 1134 bp, Mus musculus
tttgtttgttttttggagggggtatgatttttgtttacttgttattagacaattttatagatgacgaaaggacaactgtcatcgaggataaacatgtggtatattcatggccagtttgtaaataaatctatgcttttcagtgtggatgagaggccaggataggcatggctttggtttactcccactattgggatactaacttcctttcgttgactcagctagggatgaaagtcatttatgagaaaagagtgataattctgggtcacaatatattttaaagactcacacctgtattccccctagcactggggaggcagaggcagagagatctcttgaatttgaggccagcttgatctacagagtgagttccaggacagccagggatacacagagaaaccctatctgaaaataccaaaaaaagacaaaaagaaaaagtaaagaatgcgaaagcctttcagtgccttaggctaggtgtaggtctctctctttcttataccaacagaatagtaaattgaactcatgactttcctaaaactatctcctcactattcgtggccaaagttaaatctggtctcctagtctctgtggacagagagcctgatccttcccttcttgtaagacttgcaaagggtttctaaattttttagtttgatgcattaaaatgacttattttgagcatttactttggattcttttgaatacatataatggcaatatgtattcatatttctttctctcttttttcttttttttttttttgttggtttttcgagacagagtttttctgtatagctctggttgtcctggaactcacgctgtagaccaggtaggctggcctcaaactcagagatccacctgcctctgcctcccaatgctgggatgtgccactactgcccgacacaagcagtaatgttctttttttaatatttttcaagcagtatgtttttaaaaagaggaaatggggtgttcttttccatcattaataaatgggaactaatttcaaaccagggtgtcagcttgaagttgttcaatagacaagtctagctcattccatcctccaccctctgtctgacacatggtgagaatgcatgtcatcacttaggaactctagctgatcccgtaagagaaccagga

SEQ ID NO: 35795 - DNA, 1133 bp, Mus musculus
tgaagcatacaggttgacattaagccctgagcaccaaggatctatgaatgtgtattagtatattggtttctgcattcatactgggaagagggaagaaggtcttgtgttacattcctacgcttgatttgaatagtctcagacctctgtctgttctacggttttcatcaatgaaaatcagtcatttccttgaaactgaggagcacagagatgtacttgtgggatcaacatgatgtacccacttgtgggttaaaatggtagcccgcgtctggcctgccacaggcctacggccactcatggaggtggaggcgggaagtttgaccgtgtgcatctcacactgctgccatgcaggtgtcaggctgtgaaaagctgcagaaccctgctccaggggtgggggtgggggtgcagtctggggactccgcagactaccagagttggctcggggtcctggcctgcacggaggcccggatggcaggatctcattcttgggtaacacggccgccactggatgtcatggaagagctgagaacagggtgaggctcccgtggctggctctggcctggggcagaagtgaaaagagggagaggagagagctccatggggacaagagtgttgtaggcttgttcggttggcttggcttggtggaaactggctggaagtgctgagaggccttctgcggaagattagatgcagctctttagtggaagacctgctccattgcttcccacggcagatccgatgagaagaggcagtccatggttttaaggtgtttattgtcatggtggagagttgtgatgagtgaaaccgtaccccactttctcagggcgggcaaaagggttaagtaccttttgcagggaggagtgtctgggaaggggagctaaaagggtagtagaagcagagaaaggcatagagaggaggagagtagagaagtagggggaaagggaatgtggagagaaggagagcaagagggcaagagagaggcaggagtaaaggagtaaaagagtaagagaggatggggcaagcagcaccttttatagtgggccaaacctacctggctattgccaggtaattgtgcagagaaccatacttggctgttgccaggtaactgtgggggtggagtccagacagaacaccag

SEQ ID NO: 35796 - DNA, 3278 bp, Mus musculus
ttaatggtttctctccggactccactccctgatactgtctaacataagctgtcttgtttcatcatttctaggattctgtgtgcagtgagcaatttttgtgtcagaaattctatcataacatatatatttaacaagctcatcttgctgtaaaactactcatgttcttttgttgtaaaattttcactgattgtataatgtaagactagttgaaagtagaccaaaaagacaacttgtgacttcattatcttgcctgagtagaatagtattgattgaggaaaactgatcgtcattagccagtctcactcattataagtctgttggtttatgttgtactaaactagtgaattagtgaaagtaaaggaaatggctcattttatctaaaggcacatgtgcaaagaaactgggccaaatatgttctaaatatttggagttcatctatttgaattctcttagaaaattcaggtcatttaggaagttggttctcagcttctgactgagagctggcctggagcttcccatcttcactctgcggtgctgagggggaggatgacatgccattggatgcttttcagaaacagtagtttactctgacaacattggagtagctttttcagctagaaagctaagaagctcaacattactgtagagattattgcttcccacgagcatgaacacattacttgtgttaaactctataggtgtaaagggaatcactgcggattttgataggaaccccgcctgatgctttttggtttgtttcaggcagggtcttcatatcgagaagctcttttacttggtagcattttttgattaggaatgaacctcagcctttctgcccagtcatacagagcctcaaaggccaaggttattttgtcatttctttgttggttttggtttttgtttgtaaacaggattccgtataacctgagctagcctcaaatgtactatgtagccgaggatgatcctcatgcctccaccgtgtcagtgctaagattataggtgctgtcactacacctggttttttgagatcctgggcactgaacccagggcctcatgcatgctaggcaagcactataccagctgaactacatcccaggcccttgacattgaattatgattcttgagctctgttttgctaactaagtctatggagcattgactgttctctaatgagaacaaacttggaaatctgctgattacctacaataatttagacataggctaaaagtgtgaagtcaagccaggtgtggtggcatgtgcttgtaatcctagcacttacaaggctgaaacaggatcacaagtttagggcagaactgggctatcttaatgaacccctgtcttaaccccaacccccaaaaagcgaacccaaggactaatgcgatagctaaatcaaaatggcgtgcaggacgcatgctgtacatcaggcttttctgccatactcctcgactattacttgactgaagagcctcttgttttcttctccttggagactgttttcccttcttaatgtgttttcataacaatgttactgagaatctgcgtgttttgtacttccattctttaaaggatgtataattgccagatgtggctcatgcctataatactaacactcaggaggctaaggcaggaaagttttcacacaggttcaagaccagaattagatacacagtgagaccttatctttaaagaagttatacaaattttaaagggtacaattaagtaactttaaatatactcacaaaattatgcaaccacttgataaatctaggccatttcactcctctccaagaagccctgtattctttagtagtcacctctgatttcctcccagtttgtcccacgtaggtcctaggaaaccaatagtttattatatgcataatctgatcatttactataaatgagttaatgcaatatttagtcacttagtttcataaatatggtttcctacgtgggataaatgctcattctgagaactcagaacccagtacagtgacagaaagtgtctgggtttgtaaatctggtaggaagcttgcctagcacgtgcgagaccctaggctcactcacagtatcccaggaaaaaaaaaagctagttgataaatcaatggatttaaagagggaaagccagatacctggcagactctagagttaatcttattaaatagagtacttttcctcctagccaaacattcattctatactactgcttctaacttacattctagttcctcccagctctgctttggttttgccaagacagggtttctctgtgtagccctggctattctggaactcactttgtagaccaggctagactccaactcacagagatccacctgcctctgccttccaagtgttgggattaaaggcgtgcaccatcagtgcccagcccattctcgtttctacaatggatattaaaatgtcttcttgtcttctcagccaagaaaatcctgcttaaaaaaatgctaaaacatttggccgataactgacatggtaaatttatttagacgtgtccacctttggacagcttgcatacctcagaccaggtaaatagccccaggtttttaaatcgacttcattgaatttctgctatcttcttgaaatatggtactatacgactaagtcagatttgggtgtgttgtaacagtgctaagtgtgctcagtagaattttatttacagtactgtgtgatagtccattactgcctagggtagttgaaaaccagtgatctgagctagtgctaggtaaacctatagctgacatgatttcagtcacactcaaaaataggagacatgtacccagcaaagttctccagaatgcaggaacacacttcataaccagggaactagccaaatcctatgggctaatagctcagctgcagggaataaagattgtgaattggtggcaagtatgcacaataactccctaataattgcttcctaagcacttgtggcatacttttgagtgacataacagcattttcttggctgtacatgaccggtttccatgatgtattgaatactgttgtttgtgagccttgatgcctgtaacaccaataaacccattgttgaatatattttctctctttaaatgaccttgccttgtccaataaataagcgattgtctcaccttgtgtttggtagtgggtttttgttcatttgcttttactttcaatctcatttcttcattttctctgcccccagaaaaaaaaaggagctgattttatcatgttatatatgttgtatgatgatgtactttttctagtatgatgctgatttttaa

SEQ ID NO: 35797 - DNA, 3278 bp, Mus musculus; identical to SEQ ID NO: 35796

SEQ ID NO: 35798 - DNA, 1582 bp, Mus musculus
ctagcagggaggcattttaaccaggtgtcctcagatgatctccttttgggaatggttttctgaagagctcgccttactttactaccttgcatggcttggcttctttcattgcttaactgctctgaaaccttttcttgtttgtacttagaaccaggagcagttgaaagatgatgactctgatctcattctcaatgatggtgatatcagtctgacatatggggattctactgtgaacaccgagtccgcaacagccagcgccccaaggagatttatgggcaacagttctgaagatgccttggaccgggagcttacatttggggaccacgaactagtcattcgtggcacacgcctggttcttccgatggatgattctgaacctgcgttaaattcattagatgatacgagacacagtccggcctaagcgctctgatgctcagttagtggtttgtaaactttgcacatgtgattgtgaagaaatgtgtactacctacaagtcctagtgcatgtctctgaatgtgtaagctatataaatgccgtttatatggcataggaagaatataaataccctgtacaaggcagattgtgaaaaaactgttctcttaagtttttctggctttactacatattggccagatctgttttagaaacttactttcacagtgatgttctgtgttctgttacttttatgtttcagttaaagcataaaaagtgacggattgactctttcttatatttatctgagtaccgagttcttgtgctgtgagttaatttgtgtgtggcagggaaggggagggaagggggagctgttattccctcgggaacccgggaggagaggttcctttgttggaaaaacttttgttgattgctgctgcctttgtcgtgactttttctttcccttttctctggtggccctttgtggtgcaaggagctgatggcattttgatctcaccccattcaggttggggactgaagtgtgggggccgttttcccccattgatgtgaaagaacagatttcttgactacagtacattgatgctctgagaaagaaggctacaaatgacctccaagaccttatttcttttctttcacaccaagaccataggaattgcatccagctggcttagctaaaatacaggtgtatatcgttcagggcacttgttacagatttgagggcgctggagcaagtggacatggggatagtggtgttggaggtctctcttcccaaatatgtaaatagtctataccagataagttgaaataggaaatgtacttgctgcttcatttttgattatgttcattgtgtgtatagcaagccttgtcaccagaagttttttttatatcaacttaaatcgctgctctttagcagccaaacaggagcaaaatgtaaaatttttaaactcgttatgtttaaaggtcacttgttagttgatagttaatgttaaaagttaatttatgaacccacacctgttctgtactgcaccagaggcggccgtgagagggatgcagtgttctgcattctttgaagggattctcctggtgtaaagtgggtgcgcttgttgtcttcattgtcgtgttacttttt

SEQ ID NO: 35799 - DNA, 1411 bp, Mus musculus
ttttccactgaaaaatacccttccaaacaaagcacgcacttactctcaaaagggttctgtgccattgccaacactccttgagactttacaggaattctcatggtgtacccttcgtggcagccttgactgttggcatagccatttgttatgtagtggtagtgactttcctgctatgcaggaacaactcctgtgaagtgtacgttttatatgatgcgtggctcttcatgcagtaaataatttctttgttaatgtatgtttgaggggttttgaatgtcagcatcattgacccacaaagttattcaagttgtaaaagggtatacagtgatttaactactatcttttttattctgtcaggttactgagctcaccttatgaaaatggctataaatacttagcatgacaaattatatgtaacctgtctctttttagcatgcataagatttctcattaaggaaactgataacgcttgagtccactaaatctgccttcagtactttatcaaaggagaacgaagcttgttgtacttatgtattcatctggaagcctttttttccccctctcttgtctgtgtacagcatccccatgcatagagcaaagcatctctgttgagacagtcattagaattaagcacctcaatgaactttgatgaagtacagtgtgagttaccatcatgcatgagtgaacgcttgtggacctgtttttctgttgtttgtggaacctatgtgtttgattgacttgaacactgcatctctcagagttgtttttaaggtctcttggcatttatcctagtctgtgtttggcagcgtgctgttaaagtactagacttctaatctgtacgtgctttctgttttcccttggagtactgggaaagatgttctagtggtttcttttaggaaaatctgtcattaaaaaaattatagccttgcaaataaccattcactgttatttgagtcacagtttattctagagagacataaagaatgctgacttcatttatttttctacctatatacatactggaaaaggggaagggctggtgttgtaaaaagaaacatgacagaaaacttatgaggtggcagagttggggtgcttaggtataagggtggatgtatttgcttatggtcacaattgtaccatttaagaaatactggtcaaagccatcaagttccattacattgatttgtagcttgttagcacaatagcagaaaatgtcgtgaaaatagttgtattgtacagcaggcaggatggctgtgaactgggttaagtagaaaggcagttccaggtttgcctgtaaagtatgaccattaaatctttcatgttaaaggtatgtctctctttgtacatgagatgttttctgggttagagtttatattactcagggttctctagaggaatgaaacttacagaattt

SEQ ID NO: 35800 - DNA, 2387 bp, Mus musculus
ggcaggcatccgggtggagagaggacttgtccctcgtgggtggtggttctttatagaaaaaatcgaagcttagcagctcctcgaggcccggtaagtgtacaccctacaaacagcccaaggttgcctcctggtggccactttgatgtcatggccctgacttataaagacttgttatgctgggaggtcggtgttcgtcacagagctatagtggtggtggtatgggaacaggggttctttaaatcaaggaagccattagctgagctctggcatcttttcaggtccttgacagccatagaagggttgcggcggcgcgggggacagtggcggcgcgggggacaatgcgcggtcgagtagaggggagcagagagcccggcagacactgactgtgtgcctgtcggctctatgaacgggcaagttgtcattttatctctgactcctggcttcctcatcggtcttcattcagctgtctttctgttttcttgtgttttcccacagggtttggtaaaggctccagtgtggtggcctatgaaggacaatcctggcacgactactgcttccactgcaaaaaatgctccgtgaatctggccaacaagcgctttgtatttcataatgagcaggtgtattgccctgactgtgccaaaaagctgtaacttgacaggggctcctgtcctgtaaaatggcattggaaccattctttgtgtcctttgctccctccctccctctgtaccatccatagggcaagagtgggctttcacctctttaaagttgctctttccgtcttttctcccattttacagtattaatcaacgaaggacacacagtgatcatattaagatttagcaaagagcaaccttgcagcaaaaataatttctctgttgctgcactggaaaaacaaaaccttagactgactcttctgcatgtttctcatagagcagaaaagtgctaaccatgtagccacttcacgatgtaaacgagaagcataggcgataaagctcccactgagacacctttggggctcagtctggatgcgctgtgcggtcacgtgactgcggtgtaagagttgcagcggctgctccaactcccttctcgccttctctgggcagttaagaacttgccagaatgcatggtttaacttccttatcaaaactctgaccttccttctgttcttttgtgctttcacacgactaacacagatttccagagaattaacattttgaactttgttgtaattctcaagtgacttttcccccatactaacatttgactcccttacgtggcgtgttctctgagcgttcctactttaaagcatggaacacacaggtgatttgaagcatctaagcagatctgagaaaacgagcctgtttcagaacaaactcaccacagtgactacttcggaagcttaacaagactaactctcctgtcctttttaatttttttttttaaattttgttttaatgagtagtaaaatagtttatgggtttggaaacttgcatgacaatatttgagcctcctcaaacgttcctgcagttttgagattcatcctgtagacatgacaaaaactctagagccgcagctgagcaggcacagggctgtcatcaaagtagggacaaggtgaagtccttgtaacataaccgttgtctgctctttgtctgcatccaggaagagtgcaaagtccctttgcttgtgattcttagaactttccctccagaattgcagttagactctggggctgtcggaggtggtcgtcatccttcacaggcaggactgggttttcacccccttctctgaaacgcaggattgcctccttaactgtactctccattttattacatatataacgagccaatatcaaagtaaagatgtaatgaaaacacacactcatatattactgtaggagtggttatagatgccaacacctcatttccatatttgtcattagctgtttccatctactgtttgattgtatccttacaaaaataaagcagcatagaaagagcacgcctcctgtctttttattctgcccaaggaagcatgagaatgtaatagactgctactccagaaacttggggaccttgctcctgacttcaaggaaatagttaactgcaatgtacaaagctgtaggaccactctggtccagttttcaaaacaaaaaccgcttcagggtgtttcctggattttcatgtcctacaaaaggcaagaacttacaattcttgcttgagcaggatgggtaggaagggaatcccaaatagggccgcttgaggaggcattatgattcttcttccctctattccgttcccattggctctctggagcccaggactcctgtgttgtatcatcaccccgtcctccctaccttgacctggcttgtgctttgagcccaagtctta

SEQ ID NO: 35801 - DNA, 1151 bp, Mus musculus
ctttaatgccagcacttgggaggcagaggcaggtggatcactgagtttgaggccagcctggtctacagagtgagttccaggacagccagagatacacagagaaaccctgtctcggaaaaccaaaaaaaaaaaaaaaaaaaggttacagtgtaaatggaaatatatcaggataaaagggaaaaggcaagtatctggtgggactacataaaaagtaatagaaacatgctgtttttgttggatagcagcaattttcttcctagttcatacttttatcttttcatttttggttttggggccgtctttctctatagccctggcttccctcaaacttgctatgtagactagactggcattgaactcacagagatcaatctgcttttgccttctagttctttcgtgtcatgaggttaaatgttcctagttgaaagcaagcttcatatgtaaggcggatgtcgtgattccatgaagctggaagtggcaaaactccatgcagaataggcttctttatgcttgcatagcaaaggtcaggcacagtcatttggttttctatttcattgtaggagagtaaagctactgagtggtcctcggaaggggattatgatttggacagtaccgccgagaccagccttcagtggattaggtaagcactttaagaaatatgctcaaagtagcttgaggcttgataactgtctgtgatttttagctggggataggacacactggagattgagcctgggatcttgtacacacagggcaggggctctactacttggttgtctcctcctctaaataccctttagttcttattgcttcgggactgtctcatgtaccccagctttgccttgaagttgctgtatagccaagggtacttttaaattctggatcctcctgtttgtttcccccagggttaagatacttactttgaagttaagatattttatcactactggtgatactgagtgatatttcttttgggccagtttcccctctcattctcctcttcagcttctaaacatatctgatgaaaagaaaatatgttttacatatactatttatgctgaagggaaaggagccagtgatgtcatacatactgtctctccttgtggacagcatcatgtagacaacatggagggtggtggtgggcatgatat

SEQ ID NO: 35802 - DNA, 1165 bp, Mus musculus
aagataaattcttaggtaaattggagataagttttaaacatgcctatttaatatttatatagtcacaagtaaatcttgtcaaataagtcctttgaaatgtattcagaaaggcaaattctcagcattgcagatgtagatcagttgatagagtacttggctaccatgaggaagtcctgggatcaatccctggcaaaaatgggctttggtggcatgtgcctgtgtataaacacaccccccaattgtattgtctgttactttttatgcttttatgtaactactaaaatcttaaaaattatatatgtaaataaggtactacacttctgtttacattataattttattgcatgaggtaatctagttttaactcccaagacatgcatgttctgttcaaattcaagattttggactgtattgcaattatgactgtgaactgatttgtttcattcactcttatttttatttttaaacagtttgagtttccagtttatgcaccaaaacatgagcatgggagtccccaaaggactttctttccaaaatcaactattaccattatacttggtagtcttttaccctttggctgtatttttctgcaactttcttatattctaaaccgtatttggtgagtattgcatctcaataaactcaagtttagtttaatacctaacaatagtgcatatttatagggtaatggaataatacttcagtacttgtatgtaatgtgcaaaaataaaatcaacgaagatggatagtgtgtaccaaaataaaatgaagagtaagttctaatgttcaaaagcctgtcagtttcctgtaagtctagctcagtggatataagtctcttttggtctgaatgcatgcatgcacatggacatgtgcacacatgtgcgcgtgcacacacacaatctattttaaaagtttagctttaaaaaggaattaaaatgcagttgctgtattgttttttataatacctttatatcatactctttcaaacaaatctgtcctggtgtctgtaggtgtttgctacgaggcctggctcaaacaaatctttttttttttttttttttttttattagggatttagctcatttacatttccaatgctataccaaaagtcccccttacccacccacccccactcccctacccacccactccccccctttggccc

SEQ ID NO: 35803 - DNA, 1145 bp, Mus musculus
ccctggacttcctcccaattttaacgaatggtacgtctgaggacaaccaaaatgcatttaaaaaagaaaactgagacaaatcagatggaaatggagttttaaagcaagaggccatatatatagggctacatcttggtaactgcaattgttcaggaaggtttggggcaagatccaaaagtagctatgcccttttctcaggattagaaaatatgttttggcatttgaaggaattttttacaaaatcttttcactgcttttcctgcccccctcctcttgctctctgtacaccccgttctggaactccttcaaatcattttaattaacactgtcctgtttcttgaggaagttatcgatggcttggtggtggtgatgttaaactgatgaaaagtcttcttcgccttagtggtgattgtttcttaaaccatgccaaagtcctgttatgtcttgaacttttcttcaaagcattacacttgtgaatgtatcttcgtctaatggggtcgaaacttgttgttcagtattttttcaggctgaggatatgatgttactctacacagattgtaacgtttagtatacagttgccttttgtaataacttttctttttgtaaatacatatccgttgatgccatatttatcgtttgtaatttaattattgctgcaagtgccgggaactgaacaatatttatggataaatgttttctaacaaattctgtacagcttttgattataactgcttttagcattaaacaattattgttttgagaaaaggaacacaatttacaatttttgaaccatactgactttttgttttgttttgtaacagcctcctacaaataggagatgtgagtaaattgaattttgtttgttggtatttataactcactcagatcccttttttaattgttaaattatttttctattgcagtctagattccttacaatgtcagtttccatctggggaggaccctcctgtctttatctctagctcagatggttgtttaactgggagtttaaatgtgtttgtcctggattttcggcatgcaaatcaaataatactgatcaattcacttagtggccatgacatctcaatcttgtacttcaaagactgagaggctgggtttaatcattcctgccctatatatatata

SEQ ID NO: 35804 - DNA, 1133 bp, Mus musculus
taacaaagcaaaacaacaaaacaaagttaactgcttaaatgttttgtaggggcaaacaaattctgtgaactgtgctgttttcttggcttcgtgttttctatctctgcttgattcaaatgtactctttactttcatatagtgcaactttatgatttttgaaaattaatggttctattgactctgtcacttaatccatattaaccaaaggcagggttgaatctgaattggcatctgaggttcaaggtaaccgtgttcttatgggttttcctctctcgcaccctctcctttccaccctccctctttctctctctctctctctctttctctctctctctctctctttctctctctctctctctctctctctctctctctctctctctctctctctctctctccttttttgttgtcaattagaactgtagcattctggtcaagttcttgtgctgtactttgtgcgtagaaattgagttgtatcgtcaatcccagtcagtaagataagttgaaacaagattatcctcaagtgtagatttctcttaattccattcgtgtatcatgttaatctattgtggcttcttgtgtaaagacaggaactgtggaacagtggcattgtctttcgtgttgttcaaataagaagtgtctcacctgtacatgtacaagtcctcctgtcattggatttggcacgtgaacattgtgaacaaggcaatgttaagaatggttccccctaaacaacatatattatacctgctactggaaaagtgtttaagacttagctaggtttccatttagatcttcatatctgttgcatggaagaaagttggaatcttggcatagagttgcatgatatgtaagattttgtgcattaataattgttaaaacctgtgttccaaaagtggacatagcatgtacaggcagttttctgccctgtgcacaaaaagttaaaaaaaaagttgtttaatatttgttgttgtatacccaaatacgcaccgaataaactctttatattcattcaaagaaaaggaaaacttcaatgtgtgtttattatccattatgtgctatcaactatattagaaactggacttaatactaaagttcatgtataaggccactgacttcagacaagctccagtgtc

SEQ ID NO: 35805 - DNA, 1484 bp, Mus musculus
ccagttgtggtggtgtgtgctgtaacaccagcgctgggaaggctgaagcaagagaatagagagtttgaggccactgggctgtagagctagttccaggccatacatatatatgtacatacatatatgcatacacacacacacacacacatacacacacacacaccccaaactgaccatagaaataatggattacatttctattgcagagacacatgtcggaggtgacattctagttgtaaagaagccacagtgtcatctggcaagttgctctgcctgcctgcttctcagcccatgtggaaaaaaaaaaacacccctcaaaggaatttcagcccaaatgatgggatttccgcgccccccccccaggttaatatatttaaacatgcacaaaaccaacggcatatacttctttctttcactttttattccttaaattgcatacgtgtgtaagtcattgtgccggataaaatcaatctcatctcagaatatttttgacttgaaaattgtttcttctctgtctactttgcaaccaaatgcaatcagtgtgccttgaattatttagcttattattaattaagttaaactagggctgtagaatagttaaggccaagtgaagcacaacgctatgatttaaagcgctttttagacccagcgctcctttaacccatgcaagacaatggtggagttcagaagtcctgggggtgggggtccttagtaaattctattcagggctattgccttttctatgtgccaagatgaacttttcctgagagtagtttacaaattgcatttaaaatgtaatattttcatgcttgtttctttttctggatttatgcttataattcatgtagcaaattagttgtgctctattatcttctgtacatttcatgctgtaatcattttttttccaaataaaaatgaaaacttcaggttccacaaattgatactctggtgttcgtgtatttgtttcccttcacaaaccaatctcgtttatttgctcctgcagaggttagatgctaaagctatcacatttgctattgaaatttgctattgagctaattcttcctgttccagtaagcaggtatctaggcaaattaggtcaccatcaagcttgtaatatgttttttttttattacaactttatagtctgagtgaaataaggacctaacagatcgaaggtttcagaatcacctctaaggaagattccccatgaagttcttagagtaaatggtatttatttatttatttatttatttatttatttatttatttatttatttttttattcaatgttcgtggtgacttccagctggtgcgcacgagtagtgagtcaacatttctgcagtgtctgggccatacagtctccagcagcagcgatcacagggatgcctttcgttttcattgctactgcagggcttccagagcccagcgaaaaaactggctaactttggctgagtaaaacagtctgtgaaacactcaggctgtac

SEQ ID NO: 35806 - DNA, 1119 bp, Mus musculus
ggtcttcctgtggagttctcatctacttcaaggccttcaatccttaccccaactctttcttaagtgtccccaacatccatctatagtttgtctgtcggtatctgcttctgtttcagtcagctgctgggtggagcctcttagaagacatttatgctattctccagtctgcaagcataacagagtatcattaataatgtcaggaactggtacttgcttgtgggatgggtttcgagttggattggttattagttggccttttcttcagtatctgctccatcactgcacttcttttagatggaacaaattttgggtggagagttttgtggggggatttgtgttcctatccttccactgggggttctgctggctacagaaggttgtttctccaggttccatgtcaccactggtaggtatcttggctaaggtctcttacattgactcgtggaagcctcacctaccttacttcctagagattctcctctcactgcacccctgggagctgcagattctcttgaccctctggcactctctgctgtctttccccatacctgatccagcctccatgttcctctctacttacccattttacctagttctctccctccctctgcctcgtatgacaatgttgtttccacttctaattgtgattcaagcatcattgcttgtggctttcttctcatttaacttctttgggtctttggggattatcatgtgtattttgtactttacggctaatatctacctatcagtgagtacttaccatgtctgtacttgtgggcatgggttacctcgctcaggatgatattttctagttttgtccaattacctgtaaaatccactatgtctttgtttttaatagctgagtagtactccattgtgtaaatgtaccacattttctgtatccattcttcagttgagggacatttgggttgtttccagcatttggctattcggaagaaagccactatgaacatagtggagcacgtgtccttggagtatggtggaacaaattttgcgtttaggtagaactattttcaattttctgaaaaacaagcagattgagttccagagtggttgtccactttttcagtcccatcaccaatagaggagtgttctcct

SEQ ID NO: 35807 - DNA, 1132 bp, Mus musculus
tatttcataacagtaattttttcaactattataaattacattgtaaatatatgtgttttccaatggtcttaggcaactcgtgtaatagtgtcatttggccccaaagtggtcatgacccacgggttaaaaactactactttaaagtatacaattcagtagtttaactatattcatcaggttgtatggttatcaacacaatttaagatcacttttaccattaaaaattcccatcttgaggtcagtcatgatggcacacacttgtcattgtagcactgacaggcctgaggaagacgggtcttgagtttgagtcatgcctgggctacagagtgacatcctgcctttgaaaacaaatacagaaaagcaagcaactaatggaacaagccaaaaataaaaaataaaaaataaaaaagagagatttacaggaccttgtaccttttaatagtcacctcttatgctgatttccccaatacattcaattaacgtttagccagtactctgatttctgtgtttgtagctttgcctattctgagtatttcataaaacaaaaacttaaactatatgatatttttatgtggcttcttttagttaatacagtggttctctgttgtggtaaatctccaactcatataagcccgggcaatgaaaacacgactcaattaatatgattatatgctgtgtgcctagattgggcagatctaccgctacactaccatcttccccatataagagaccccttagaactgtggtcttttcaggccatgtgcttctgttccactttccttcttcctcctcctccatagtcctctctccctctctctttctctccccaaaccttcagctccaccttcccctcattccccacccaatcaccggctctagcctttatttataaattaaagtgggaagcaggtttacagtaaatcacctgagtgctgattcattccttggtgtcagcccctcacagcagaacagaattaacatcaaatatattaaccccagggctatctgcatcagttctcactcttctgaatgctgagaccctttaatacaggtcttcatgttgtggtgatccccagccatacaaatattttattgatactttataactgtcattttgctattgttataaatt

SEQ ID NO: 35808 - DNA, 1130 bp, Mus musculus
ctggcgtgttgaggccagaaatcaacctttagtgttattccttgggtggaattcaccttggttttttgagacagggtctctccttagcttggaacaagataagttgggtaggctaactggccactaggtatcagagatctgcccagtgttgggattataagtgtataagtgctgtaagccaccatgcgtatctttgttgttttgtttgtttgctttggccttttcaagacagggtgtcttagttagggttttactgctgtgaacagacaccatgaccaaggcttctcgtataatgtcaacatttcattgaggctggctacaggttcagaggtttagtccattatcatcaaggtaggagcatggcagtgtcgaggcaggcatggctcaggaggagctgagagttacacatcttcatctgactgcagccaggagaaaaatgactcttctgcactgggcagagcttcaaagctcactcccataatgagacacttcctccaaaaggccaaacctctcaacagtaccactccctatgggacaaacatgttcaaaccaccacacaaggtatcaatatgtagtcctggctgtctggactcgacttgtagatcaaacatgctttgaactaacaagagatccaccttcctctacctccagagtgctgagattaaaggcatgtaccaccaccaccctatgtatctttgtttttaaatatttttttgtctttttaaaaaatattttttatgggctggagagatggctcagcggttaagagcactgactgctcttctggaggtcctgagttcaaatcccagcaaccacatggtggctcacaaccatctgtaatgagatctcatgtccttttctggtgtgtctgaagacagctacagtgttcttagattataataataaataaatctttaaaaatatttttataactttatttattaattggatattttatttatttacatttaaaatgttatcccctttcccagcttctcttctgtaaaccccctataccatcccctcttaccctgtttctgtgagggtgctcccctatgcaccaacttactcctgcctccccgccctagcatccctctacactggggcatcaagccttcacaggaccaagc

SEQ ID NO: 35809 - DNA, 1124 bp, Mus musculus
acataactctaagaggcactgcagtatagtacagtagtacaaactgtaattttaatgccagactctgactaattgatggtatagtctttggtatattctctgaacttcagacattaaataactggggataataggacatatgaagttagtataaaaaagaaataacatttataatgctcctgagtttcctatgtctggcatatagtgatgctctaagttgtttctactatcattgctgtagactagaaagtggcttttgttgatgtaaacagaagtatacaaaataaatcccagttagtactttatatctgcacccttagggaactcaaaacatttattttactagtatacatccaagtaatttttagaaaatgtagcactgtatattaatttatcttcaaagataggattgacattaatttaatatccatgtatttgagaaagtactgtacctacatagacatgattgaacttttattttcattatttcaggttgaagccgttgaggatagccaagagaagaattctgatcagtctcccaaattggacaatagcttggatattttaaagaagtattctttcctttttaatctacattcatatatgtatctcaccacaggaggctctggttcagtgtacaaggctcatgtgattagagttttcagtttgcaaaatacggtcctagtgagtgcattaaaagagtactagtgagtgtcacaagtcctgtatttagacgtgagcagctgtgatctttcttatgcgtcttgagaatttttctttggtaatattgtgtattgtaaggcaactgctctgctactcagctacatacagtccctcttatgatttctgtacctttcattttcagattgttttatttttgtgtttcccagtttaaatcatatatgtttgtgtgtgtgtgtgtgtgtgtgtgtatacacacacacatatatatgcacatatattaatcacatagatatataggtataggtctatgtgtaggaattgattttatacacacacacatacacacactctatatgagtgttttgccttcatgtctgtgcatcatgtccatgcttagtgcccagggaggcagaagtggcggtcaaagttcctgaacctgc

SEQ ID NO: 35810 - DNA, 2174 bp, Mus musculus
agagaaagcatgaaggaacaactacaaaagatattaactcaggatactcaatatgaaacaaagaccactctcatgtgtagggttcacaataaatgttcattaaagtaccaaataactctcttaaccatttacagttattgtaagtagccattatggcccaagtgagaattagatgaaagtttaaagtaagcatacttagcattctggatttagatagactaatgtaactacaaaatgggtgctcttttaacccgctgactttgtgaatggatttcaataatagtataaagtagaaggcatgcaatggggatgagcaggtttggctaaccagtgtttccttccgcctggcagaagtcgtagactgcttgtctcacctctctcattcctgctcaatgattatcttttttcccacacacaaaaggaatacttgaaaatacaagactaaatgatattactgcatcagacaaaatacatcatcatcttttcagtcataggctaattgtcttggtctaatatcctttccaaaaagtaccttgcatacttgtgtgatactgttaattctgggtattattgtagaaacaagggtggaaaggttatttggtgtgttttcttctgaattacacaccacttatgtatttaagactactaaacttgaaaatacaatatttcagtctcttggtagtagcccctcaaaacagttaagtagaaagatttccatccaatgttagttttgctgggtaacgtggtaaggtgtgttaaatatttacataaaaatgaatgccattcttaacactggcattttataattctatgtggcaaagatgggaagaatagcctattttcaactactaacggtttttatttgaaagagagtgtttttgtgcatatttacagcactttttttttaaaaaaagttaccaatttggaaagaggagatctattccaaagccctgtagagccacaactctttggacatgaatgttggttcctatagctaagtgggccaaggaaatggtctatttctaaattatgtgatggaccttggtaagatcctcaaactgctggaccagaaagaggttttagcccctaatacgttctcttaaaacatgaaagaagtatgaaatgtctttacttgaaagaaggaccacgtttgacagataggctaaaatgatatttagaaaatatttttctatcagtttccatttttttgtctgacatgcctgtactatttaatgtttatattgtactttgatttaagaacatactagactcattgtcttccagtatatttatatgtccatatggcacattttgattcttccatgtatttgtgtggatgtttatttgggtgtattttttcttaaattctaaaaaggccataatttcagttatcagaaattattccataattacttaatttaatttgttctcatctatcagtattacttttgagtattttgttaggtgtcaatcacagcttaagtgtgtgctcttgtagcctgtatttgaggaaatctgctgaaagcaaagtctttctattctttgcctattccaaagagctaaaacatctaacccaggaaagctttgctgctttgttattgttgtcattgttgttgctgctgtattattattttacatcagaactgtaaggactgtgaataaatataagagccaagtagagaggcttagttaatgcagaatgattgaggagatgataaaatcaaaatatttaaggtagtagaaataaaactgattatgtatgacttgttgcagcagaaagaaatctagatgaacaaatgagaatttagagtcatgcctcagttaaccattacattgtacactgcacttcaaatcagaggaacctgggtttgctttttgaaaaatttttattagtgatctaaaacatggctagcatgggcttagcagatgaagttatttgaaatgagccatccgatattcctagcactatattttaactattcttatttcagaagagggcaagaaatctaacagtaggtccatattgccataattttaataataatttttgagctatcaaaatgtctatgtaattttccaaattgttgtctattgtttgaaggtgttgcctattaaacaaaaaatatccattccatatctactacatatacaccagcaacagtataaatgtaagc

SEQ ID NO: 35811 - DNA, 1162 bp, Mus musculus
gaagaatgtaagctctctgactgaagttcccagagaatgcattttggaaaatatagcatcattttaataataaatggtaataatcttgtaatacttacagtgtcatagatggccatggattcagagggtggtactcctgaaaaatatattagtgaaaataaaatttttatgctattataagaaaaactcctagtgtcctggttgttgggacgagactttctctgatgcctctgtggcatattgccacttgagctggtctcagaactctagagatgactgtaaaggagcatggacatttcacactgttttagctcagcatctcctgtcctccctcacctaccactaacagttgctagctctgctttgttttattgttttgaacactcttttcatgtcatgctttcaactgctttctgtatgttcatatttctttttttctctttataaagtctccaaatacctaatctattagcccctaaaatttctacttcctatactacttttatctctggtggctaaatacacatttttgaacacaacaaaatgtgaatatagttgcagactcaaagtagataggcttgcatactaaacttaagtgtggacacagtatcatgttcatcttgtagcccacataacagaagatggaatcagatttttctctcagaatctgaaatagttctctagttatatcacttagtaacttgcatgctgacaacatgtctctaacttcttcatttaaagtaaaatataaatgggaagtgtggttatttcaaaacacaaaagtggaagtatttgtagtaaaggttcagttattaagctctgttggatatggacatcgcttgagctgctttctttttcctatacctattttctttagtggaacaaaaaaagatagggccattcttctgtttgggtgagtggatgtttgtttttgtttctgtttttgagacagtgaaattcacagtgatcatcctgccccagccccctaagtgctaggactacagtgtgtaccaccatagctgactatttaacatggctaatctttcttagtagagttgttgagttcatcctgacccatagttagcctcccaacttctgtcttgcatgggcaatgccaaagccaactctgaaaattatgtcattatttcagacatgggaaaag

SEQ ID NO: 35812 - DNA, 1229 bp, Mus musculus
cccctcccccgcctctgcgttttagcggaaacccggcgccccgggtggcctgggtggggaggcaggtggggctctcgggcgtcccacccctgccccgggacatttcagctgaggttccccgaggctctgaggaactctgcctccagcctggggaatcgcctcggagtgacagacgcgcggaactcggggcggggggctccccggggcggggggctcagtttcccaattagtggaagatggcgttgaattatcggggaggaagctttcttttgtttcctctgccacgagcacgtggaggtaaacctagacctgtcactgtggcccaaaagaagagctagggggctgagagaagcggaggctaaaccagggctcagcctcgcccgggccatggccgatgaccagagactgggcaaactttgaggactcagcctccaagctcaccttgagggtgacagaaagagcgagggctgtgggcacgatgggctggggccagcagcgacggcgggagcctgttccagctttacagaccctggggctcaagcctcgcagagcagcaccctctgctccaggcttggaatccacccggcagctgaactcctccgaccaccttctccacgcctctaaagccccccagaaaagggaattgtatttctgtggggagtgtggcacgggattgggagggagcgatttctggctgctattgactttttggattaacctgtttactcagagggtatgttaagaactgagtaaagtagagcagtttacttaaaggatgtttgtagcaactcccctaatttccagaagaggtgtcagggaataggattttatttctgccacggatattaaagaaagccatcatcctaaaatttttatttttttccctgtagttaagggggagaatgcagaatgcttccccattccgtcttaggatagacttaaggacttgacaatttggtaactttgtggagtcatttctaattaaatcattgctgacatatttttcataggtcagaacaatttgctgtcatttcccaccccccatatctgaaactttcacaaatgtcccctgcttaatcacacttaaggcatccccttttaggatatcagtatactaatactttttaggttttgccagatgtctgtttcactcagaaacatgcaaagggaggtggaggtaattattacctgtggcactgagcaggaaacggtgtgtacatgcaggatct

SEQ ID NO: 35813 - DNA, 1896 bp, Mus musculus
tgggttgaggttcatggaaaactctattctccaagtcagatgggagcatttgtgttgatgaagatgaaagagactgcagaaaattacttgggccacacagaaaaaaaaaaatgctgtaatcacagtctctgcttatttcaatgattcacagtgacaggccactaaggatgctggtcagatatctgagctaaatgtgctttgagtaatcaatgagcctacagctgctgctctagcttaaggtctggacaaatctgaagataaagtcattgctgtgtatgatttaggtggtggaacctttgacatttctaccctggagattgagaaaggagtgtttgaggtgaaatctaccaatggggaccctttcttaggaggggaagactttgaccaagctttgttacagcacactgtcaaggagttcaagagagagacacggatggatttgaccaaagacaacatggcacttcagacggtttgggaagctgctgagaaggcgaaatgtgaactttcctcatctgtgcaaactgacatcaacttgccataccaaaccaaggatgcttctggacaaaagcatttgaatatgaagctgactcgagctcagtttgaaggccttgtcacagatctaatcaagggaactattgctccgtgtcagaaagctatgcaggatgcagaagtcagcaagagtgacatagaagtgattctggttggtggcatgacaaggacacccaaggttcagcagactgtacaagatctttttggcagagccccgagtaaagctgttaatcctgatgaggctgtagccatcggacctcccattcagggaggtgttttggctgatgatgttacagatgtgctactcctggatgtcactcccctctctctgggtattgagactctgggaggtgtctttaccaaacttacttacaggaacaccagtattcctaccaaaaagagccaggtgttttttactgctgctgatggacaaactcaagtagaggttaaagtgtgtcagggagaacgagagatggctgaagacaacaaacttctaggacagttcactttgattggaattcccccagcccctcgtggagtgctccagactgaagttacatttgacattgatgccaatgggattgtgcacgtttcttccaaagataacggaactggtcgtgagcaacagattgtaatccagtcttctggtggattaagcaaagatgatattgaaaatatagtttaaaatgcagagaaatatgctgaggaggcagttaatatggctgaaggaattattcatgacacagaaaccaagatggaagaatttaaggaccggttgactgctgatgagtgcaacaagctaaaggaagagatttccaaaatgagagaactcctttctcgaaaggacagtgaaactggaaaaacattaggcaggtaggatcttcccttcagcaaactcttcgaaatggcgtataaaaaggtggcatctgaacgggaaggttctggaagttctggcactgtggaacagaaggaagatcagaaggaagagaaacagtaatcgtggcagtgcattgtgaagccagaaggacatactatgaaacatgggagtaaagggacttcctgagcagaaaaggggcagacttcagtctttttactgtatttttgcagtattctatatataatttccttcatatataaatttagtgacaattgctaactcatttaatgggtaataaagtcagcaatagcaggttcatactgttctgtcactagcctgttattttcagctgcatgtaaaagggtgggatggggctgtgcaccaatcattaaggtagatttggtttgtgctgaaatggctgtgatttcaaggtgggaagcccatttcatatgcagtggaggtagtctgtc

SEQ ID NO: 35814 - DNA, 1114 bp, Mus musculus
gaacttactttagtctatcatgtaaagatatcagtgcttacctttcctacctcaacagatgggaaaggaataaaatatggcaatatgaaggctagggctttgggaaagcaaaaaacctgaaataaatatgaagcgtaattattctctgtgcttttgccttattgcctacaatgacatttctaaacccattaaaagcaagaataaagtctatgccttaccttttgggaacttaagaatgtgaatctttcagctccaatgagcttttgcagagagagaggggccagctttgtgcctctggcagcttctttattaggccttagcagctgggtttttttttctttcatattattataatttcattttgtctaatttctggagagtgctttgcctcccttctattgagaacagtggctcttggttgttgtcagaattcttacatagtgagaagcaaagtccccaagcaggcttgagcagagtcctttttcttgtgtgggcaaaggcactaaggacgagtaattgacaggggtggcgagaggctttgcaaactgaggacaagtgtacaattcatggtacacaggctgacctcctcacctgggcagcgtctgaggacacctgcctgggatcattaaggcttcttgcccaattgacatagtgtgactgcctccgctcatggagatgaacaaagccaagcatttactgactggagtgcagagatgaatacaatttgcctcttcggccaggccaggcacagacagctgctcatgcagaggggtttcaaataaacgtgtttctatttagaatgtgtatgttttgattgaatttgaagaaaagcatgaggtggctccccctcggaaaacaaattaattatgtactcctgtgtgtctgatggttggaagccagacatggctacaacagcacttcatggaaagaattttcttccctgatgaacgtgagactcttctgtaggacaacagctggtgtttttgcaaagtcacatggctgctgcctccaaaagggtctttgagggaaacttagaacaatataagtaatcttttctatttgatgcagctaccccatgattttgttgttttcctcactttggatggtgtattca

SEQ ID NO: 35815 - DNA, 1199 bp, Mus musculus
cttgaagtgttactccctatacttttaagaatctcttgaagaatgacactgttgcaagaattttaatctttcattatttattatgattataattaacatgaatactaatcatatattttataaacacagactgaacatttattttgtatcaggcaggtctgggcactagacataagcaccactgaacaatttcaggattttattctgcttagaaaaatgtcatctcaatatttgtggcacatatacaaaatcccatgtgttctatatcatttattcttctcaatgttttgtagatataaataatcatgaacttatttggtgatatggtataaaagaggacaaaacacagtgcgatcagatcgatctaagatggcgactgtggaaccggaaaccacccctaccactaatcccccacctgcagaagaggaaaaaacagagtctaatcaggaggttgctaacccagagcactatattaaacaccctctacagaacaggtgggcactctggttttttaaaaatgataaaagcaaaactaggcaagcaaaccttcgattgatctctaagtttgatactgttgaagacttttgggctctatacaaccatatccagttgtctagtaatttaatgcctggctgtgactactcacttttaaaggatggtattgagcctatgtgggaagatgagaaaaacaaacgaggaggacggtggctgatcacactgaacaagcagcagagacggagtgacctcgatcgcttctggctagacactgctgtgccttattggagaatctttcgatgactacagtgatgatgtgtgtggagctgttgttaatgttagagctaaaggtgatgagatagcaatatggactactgagtgtgaaaacagagatgcagtcacacacatagggagggtatacaaggaaaggttaggacttccttcgaagatagtggttggttatcagtcccacgcagacacagctacaaagagcggctccaccactaaaaataggtttgttgtttaagaagacaccttctgagtattctcacaggagactgcgtcatgcaatcgagattgggagctgaaccaaagcctcatcaaagcagagtggactgcactgaagttgattccatccaagtgttgccaagatataagagaagtctcattcgcctttgtcttgtacttctgtgttcattctcctc

SEQ ID NO: 35816 - DNA, 1176 bp, Mus musculus
ccacatttcagaaaaatttagatgacgataataaccacagtgaagaagaggaaaatccaggcattatccagtcttcaaaagatacaccatctttgttgaatagcctactaaaggaaaaaaaaaacaaaaacaactgatttggtatatgctatgatcttcaagtatcaagtgaaggaaccaatcacaaaggtagaaatattagagattgtcagcaaagaatacaagaaacaatttcacatgatctttatggatgcctctaagtgcctgcacatgttttttggcattgatataaaggaagactgtgctataagcaactcctatacacttgtcagttcattgaacctcacctatgaagaaaagctgagtggagagcagcgaatgcctagaaatggcttcctcattgttattcttggctttatattcatagaaggaaactgtgcttctgaagaaagtgttgggaattcctgaatatgatggggagaatcatcccatctacggtgagcccagagcatttctgaccagagatttggtgcaagaaaattatttggcatgtcaataggtgtctaagagtcatcctccacacttgaggttttacggggtctgagagctcatgctgaaatgaccaagatgaaagttctagaaattttggcaagaatcaatgagcgtaacccactgtttttcttatttttatatgaaggggctttaagagaagaggaagagaaggcctgagtcagaagtatttctccaagtagaagcccagtcacaatgatgacagagcatgagcttccagcttgtacccagagtgatgcatttgttttggaatgtgttcattctgagtttgaaaaaagcaataaaaattctaagtaatggaaggtcgaaattagcttgagtagaaaacagtggaatgcaacactatcatatatgctgtttgggaggtaactatttttgcatttgggatagattatcaaatgatattccttttagtaaaaaatactatctttataatctgtttatgaaaaaagctttaatcacaaatttattgctgtttgttatatatttagaaaaagaaaacaaattatgcgatgttttattttttaaatcaatgtaatcctctattctgtaaaaataaatgctgtgtttcaatatttgtgtggcttactaaaaattaaaccagta

SEQ ID NO: 35817 - DNA, 1099 bp, Mus musculus
gctaggccttatcctaagctcctttcaggggcttacctcaagaagtccctgttcaaggtactgtaatggcctaggtcagcaccagagtgggttcttctttcttgttgcttcatcttgaggcagaggagggggaagaggttcagtgaacctgtcacagattatataataatctgaagcaggacatctcaatacgattacctgttagttattagcttgtgaaagacctccatttccagggagaccctcgctcaagtcccaggatgagccaataacccagtaactcgagagaaaccattcttgatgcaatatcgcatgaggtttattcgggaatcagcatgctgaggctgagctcataaggggcagcggagatcaaccctcagcagttgcaatcaactgcaaattgaggggaggataagtccacaaaaatggagaagctgagtaaacatcataagaatggggatggtgaatttacagctcatctctcaggctgaaggtgaaagaacaaagaactccatgctgggcttcatttctaggggtctaagaaacacattgagttggggtcttacacttgtaccattatggctcctgacactgggtcttcaattctatttcattgatctacttgcctatttctgtaccagtaccatgcagttccattgcttgagaacagggatggtgattctcccagaagttctttatcgttaagaatagtttttgctatcctaggtttttgttttgttttgttttgttgttgttattccaaatgaatttgagaatttctatttctaactctatgaagaattgagttggaatactgatggggattgctgtgaaactatagattgcttttggcaagatggatatttttactatattagtccagccaatccatgaatttgggagatttttccatcttcagagatcttctttgatttctttcttcagagacttgacgttcttgtcatacagacatttcacttgtttgtttagagtcacaccaagatatttatattgttggtgactgttgtgaagggtttcatttctctaatttcattctcatcccttttgtttgagtagaggaaggctaatgatttgtttt

SEQ ID NO: 35818 - DNA, 1950 bp, Mus musculus
gaaattcttggcacatggattgaagtagaaaatattatcctgggccaatgatgacgaggtttcaggattataagtcacggacgatgactacgtcactagaggtctgaggtccatagcagaagatgcctcatgtgaccctctcatgcaggggttgcatgtcaggcatgtgcatacagtagatattagccatgcactctcaccatttcatagtagatcacagaatcaagatacaaatctccatgcacggaaaggatttaaggcattgatcaatcctgaacataaatatttggccatcaatggtatttacgcacacactgaaaaatctattcagaatgacttacacaaaggtttatataacctttatccaaggtgatttatatagtaagattcatggcttatgtcttcatgatggtcaaggccttaatttttaaaattatcaatttttttcttttcttttttttaacttgaattttttttatgaaaactatcatgacaatttgtctcttaaatgaaaggagaaatgtaaaactaaatggacaaatatcaacctttttattatctttgctgttgtgccctccctggatgggtgctggcacatgatgtcttgcctgctggtccgtggttgcactctcaccatgtggatggagctcggcagctgaaaatgcattcttccaccaagatgatttacacagcctagctggatcaggagccctctaataagctgcttcatattgtaatatagacacagtaatgtatgcctgcaggctgattcccaccttcttcgttagtcttgaggtttgagattccgtttgtgtctgcaggattcagatagtaatggatatcctgcaagtcggcttcgtagagtctcccttgaaagtggacctcgtgatctagcctttatgtccgtggattgacactgtgatggattccccccaagttcatttagatattctctcttattcataaatgtcacggtcagctctgttcttatagataccagaatggatacccctaagctgatgtatatacacccttcctcggttgcgagattcctgctctggtggttgtagtcataagatatacatcgttgcgtacaccttggttgtgggcacgcacactactgttgagttaccaccttgtccaagtggatggatgccctcaatgggattggcactttctccattgctcctgcgctctgttatcagcacttcggcttcataatgtacacacagcatgccttcctcactggtcaccaggttcaaggtccctcatatgtgtcaggtgcatagtcaccaacaaaggccaacttcacatcaatgggtggatcgtacctcggcctaagctccaggattgattgtgctgttagagtcacagctacaaccggctcagggaacccagtggaagaggaggtggaatgtgagagccaattggaatggaagacagtgaggaaacaaggccttcgagatacaagaggactgagctcacagagaatgaggcagcaccctcaggacctgcacaggtctaagcttgatgcaatctgagcactgagagggcaactggacacaattctatattgataacccagaagctttctccagttgataaactctttcaaaggaaaaacttgttttctaccatggagtgactctggacatagaaactacccttaacagcagactccatggctcagacttccaatacaatatgaactcagttgcaatttttgcaaggtttttcgactcatagtgctttgtctgggtactttttcaccctacagagaatttctgtatatattatcgtttctgattgtagtgttttgaattttctctgggtctaaatatctctgtctcagtgtcagtatgtgtttctcatgatttttctttgcttctctttttcctattctttgcttgtattccctggtttgtgtttgagtgtctgggaactctgagg

SEQ ID NO: 35819 - DNA, 1184 bp, Mus musculus
atatgttttatatgtcttggttatagattagtggctcataagttattggttatgattaaaaatttgtaacattggtaacaaaaagttgacttaaaactggtaactctgggttagagtaatttagaactacaacatgcagcatgagaaaacccatgggaacaggtctctaaagatacgcctgaattgggtaatattctgtgtaattcttatcctagaaatctgatttataaaagataagatttagggtagtgtctttgagatatattggcggctacaccttcttgtgtttgtgtgcaggaacggacagccaaactttgtagcaagtaatgtttttagagttcatttttaaagaaaatagattgtttacactgttaaaattgggttttgcttctcaaaattgtggttgtgctctcatgttacaagagaaattgaaggcttctcctaaattggagccaccagctaaatcggctcctctaaaatctataaagcctcctgagtggcctagtccacaaccttccctttatccacagcctcgaccccagccgccgagggaaccccaaacccctcggggcgttgagaggcggaccgctgtgagtacatggagccacagcgacccacagagcagagtccgggcggactctggtggacccgcccaaactttaaacccttcagtactggtcattttcctctgctggtatttataactggaaaactaaccaccccctttctcaggatccccaacgcctcacagggttggcggagttccttatgttctctcatcagcctacttgggattactgtcaacagcggttacagatgcttttaacaaccgaagagcaagagagaattctgttagaggctagaaaaatagcctgggagccaacgggcggtctacacagctacaaaatgagatcgacatgggattccctttgactcgccccagttgaaactgcaacatggctaaaggtagggagagcttaaaaatctatcaccaggctccggtctccaaggtgcctcaaaacgggcccactaatttggctaaggtaagaggtaatgcaggggccgatcgaaccttcctctgtgttccttgaaaggcttatggaagccttcaggcggttcactccctttgatcttacctcggaagcccaaaaggcctcagtggccatggcctttcataaggcagt

SEQ ID NO: 35820 - DNA, 1984 bp, Mus musculus
ttagctgcccagttgtaccccctaaccaaggaagggaggtgtttgtgtggaccccagatcaccagaaagcctttaaagagattaaaaaggccctactgatggccagcctatgcctgacctaaccaagcctttcactctttatgtaaaagagagagcaggggtcaccaaaggagtccttactcagactttgtgactttgaaaaaggccagtgacttacctatccaagaagttacaccctgttgccagcgggtggttttcttgcctgaaagctattgctgccataatctgcttgtcaaggatgctgatgagctcactctgggacagcaaataactgtagtggcatcccacactcttgaaagcattaccaacgctcctgtgacacatcagagctttttgttgtctaaatgagtgatcttcgcttcattccacctgctgtcccactgcgtgagactgcacctactcatcactgcgctgacattctggcagaagaaatgatctgaaggatcagatcagccttggcctaaagacagtagcctcgaggttaaaggtaagcagaaggcagggacagcagtatggtggtgaacagaaagcaagtgatctaggccagcagccttcctgagggacgtcggcccagaaagctgaacttatgactttaagacaagctctataaatggcaaagaaaagtctacactgacaacaggtatgcttttgccactgtacggggcaatatacaaagagggctgttgacatctgcagaaaaagacctaagatgctgtggctaaaaaaaatcaggtggcagatctaaccgccaatcaggtggcccaaggagcaatgatcctggcagtcaaggagcctaaagattattatgacatcagagagaccagctttagatacaccgctgagcactatcaagttatggacagtatttgacttggcctgggggccaagaaattcaaaggtgtggttaggtcctttgactactatgttacaggactctctgacttggcagaagaaatagtcaaaagctgcaaggactgtgctatgacgaggtagaatttctaaaagaaactttcccaaggtaattggatccaataaaggacctgtctttgttgcccaggtaaatcagggactggccaagatattagagatcggttagaagttacattgtgcacgcaggccccaaagctcaggacagatagagagaacgaatagaaccattagagacccttaccaaattgacagcggagactggcgctaatgattggatagctctcctaccctttgtgctcttcagggatagaaacacccctggacagtttagactgacccccctccactggtaaaaatagcctctgtacatagtgctgacatgctgctttcccagcctttgttctctaggctcaaggtgctccagtgagtgagacagcgagcaaaaagcagctccagaaggcctactcaagaaaagaagacctgctacattagacgtctccacgcaaaaaaccttgagactctggtggaaaggcccttatcttgtactcttaaccaccctactttctacctttatgggaccccttttgattttgcttctgcttttaattataggtccatgtgtgttaaataggcaagtcacccttattagaacaaaaattagtgcagtgcggcttttagttttgagacaacagtaccatgccataaaggatcaagtatgtcaggaaaaagatagtatctagttctaagattagaactactaacaagaagaaggggggaatgaaagagtagtaaactcagtgctccaaggtatgctaatcataaaacagatagtgacattcctccacccacccacttcctgagttcaaggagtattcattcaaagaaagtcaccctggccattaccggaagctgcaatgcaaatgtgctattgttaggggctcttagaaactgtcttgagagttaacaattaccaggtattccttgtgacacctgt

SEQ ID NO: 35821 - DNA, 1452 bp, Mus musculus
aagatcactgataatggttttcaggatgatcacaaagccttactatacaattgtgtgtatctttttaatcactttcatgggacagcattcaagcatctatgttaggtaaggaaaaggagaacaaggtgctaaaattaagaattatgctttcataaaaagaaaatgaggtacactgtgttaatgaaagactaaacacagaaacggtttgagtctttgttgccccatatccttactttttcaacatagtgtagactatccatgtttcacctcatgggtactttcaaaatagagaatgtaaagaaagaagataatctaaagaaaaaaaaaataatttccttcccagtaattaaataaagttaaaggacttttatctctctgatccagaagtggtagagatagaaagtgaaggagagtatatatattccctaagaacttgagttaaggactcctgaaacttcttggtaatgcaagagtcagatgagatgatatgtctccattcattttggtgtgtgcattgtgatataggacagataccagtcactttctactaacctctctcaatataaggatacagaaaaaagtaaaacttgatgaagatgatgaggacgatgatgaggatgatgaggatgatgatgatgatgattttgatgaagaggaaactgaagaaaaggtcccagtgaagaaatctgtacgagataccccagccaaaaatgcacaaaaatcaaaccaaaatggaaaagacttaaaaccgtcaacaccgagatcaaagggtcaagagtccttcaaaaaacaggaaaagactcctaaaacaccaaaaggacctagttctgtagaagacattaaggcaaaaatgcaagcaagtatagaaaaaggcggttctcttcccaaagtggaagccaagttcattaattatgtgaagaattgtttccggatgactgaccaggaggctattcaagatctctggcagtggaggaagtctctttaagaaaagggtttaaacagtttaaacagtttggggtatctctctcaatataaggatactcataaagtactgtcattgtaaatgtaagaacatagatgcacatgcaagagtattttctgattctaagatcgattgtagctaccttcacaggacattgtttaggtgaagatatagggggaacctttcatctaattcctatttctcataggtgaaaatatttaaaattagggacatagcactatggaaaataagtttagtttcattttaatttttaagtgctttttaaattaaaatattttataattctcccctttcgtttcttcccttcagccactctaatcaactaacccctttgttctctctctcattcatgccctgcttagtccatattttgaaagttttatgtatgttatttcagtgctgaccatggaaaagcagttggtgggctcttctctgctgagtactatttc

SEQ ID NO: 35822 - DNA, 2473 bp, Mus musculus
aacaagtataacttgttttagatcacagttaactgcaataatgaaaagactgtccatactaaaccattacagagtgcctccagtgaagggagccggctgcgcacgggtaaagatcgtaaccagaagaaggaaaagccagacagcgtagatgggctgcaaccgctggtgaatggagtaccctaaataagctacataattccgaagttatatttcctctaccatttccgtaattcttactccattttagaaaactttgttaggccaaagacaaatagtaggcaagatggcacagggcatgaagtgaacacaaattctgcaaagaatttttttgatattggcaataatcaacaatcttccagatttgcacaaaaagatcttgaaatttgatgcataacttttaagtacacttaacacttcagggcaggattttacttttattttttaaaaatactaagcagtgatctttattaactaggaccattttcctgaattggactatataactcagcagtatgtttcagtctttcggagtaaatcacatttgtgataatcatactagatctctgtcttcagtctcatttaaagtcttcatgaaatgctgtgccatttcatgtcctgtgtcagtttatgttttggtccacttttccagtattttagtggaccctgaaatgtgtgtgatgtgacatttgttattttcattagcaaaaaaaagagttgtatgatctgtgccttttttatatcttggcaggtaggaatattatatttggatgcagagttcagggaagataagttggaaacactaaatgttaaagatgtagcaaaccctgtcaaacattagtactttttagaagaatgcatgctttccatatttttttccttacataaacatcagcttaggcagtataaaaaataggacttgttttttgtttttgttttgttgcactgaagtatgacaaatagtgttattggaagggatgtgtaatttttctgtatagacaggagaagaaataactatcttttcatttgggagaggctaaagatgttttcagctacttgcaaatcttcctggtcgaaagttagtaggatatgcctgctctttggcctgatgacgaatttcaactttgaaacattttcttttgtcctccccaaattttgtcaagttttttcattcatattttacattaaagcttattttggggagatatgaaggtcatcttcataaatacataacaaccctcaaaagtatataggtactttgtctgagaaacattgaaagcaggttaaatgttttgtaactttgaaatacaaagtctaatgcataagcagaaccgaaaagcagaccgacaattggttaacaaataattctttttttttcttttttgatgtgttgagtcttatttttgtggggtttttttctctctttttttttaaatgactgaaattcactgaagaaaaatatgtgaaggaccttcactctgagatgttatatttttttttaaaaataactctgagtaggggtaccactgaatctgtacagagccgtacaaaccgaagttctgcctctgatgtactttgtgaatttgtttctttgaattttcatttttcatttagttttccttgcatacaaataagcatataaaatggcaacaaactgcacatgatttcacaaatattaaaatgtcttttaaaaagtattgccaaacagtaatgttgatttctagttatttattctgggaatgtatagtatttgaaaacagaaattggtaccttgcacacatcatctgtaaactgttcagtttaaaatactgtagataattaaccaaggtagaatgaccttgtaatgtaactgctcttgggcaatattctctgtacatattagcgacaacagattggattttatgttgacatttgtttggttatagtgcaatatattttgtatgcaaacagtttcaataaagtttgatcttcctctgctaaattgatgttgatgcaatccttacaatgattgcttttaaaattttaagataggaaagaaatctatagaaagtgttctgttacaaaatgtaactgttaccattggaaatttcacatgtcaaaggaggttagccgttatttaccaactttcaagaacgtaatcttgttcaataaggtgaaatatcaatgattggtacacagtcacaatgtaccgttaaaatatgcactaagtctcttttttttacaaaggctgaattcagcaaggcgctaacttgcttaaatgtgaattactaacttctaaaactgtaatttgattcacatcttttcaaatggagttggagttgattcatattacaatatttgtgtgcaaaatgtgtatgtttttcagtttaaagtcatgtttttaaaatcttattaaagtttcaaaaatctgaagattgtttatcttatctagatgtaaatttttattaaaaagttgcacttatgaaaaagcaaaata

SEQ ID NO: 35823 - DNA, 1177 bp, Mus musculus
aagctcatcgaggtggatgacgagcgcaagctccgcaccttctatgagaagcgcatggccacggaagtagccgctgatgctcttggtgaagagtggaagggttatgtggtccggatcagcggtgggaatgacaagcaaggttttcccatgaagcaaggtgttctgacccatggcagagtgcgcctgctgttgagtaaggggcattcctgttacaggccaaggagaactggagagaggaagcgcaagtctgttcgcggatgcattgtggacgctaatctcagtgttctcaacttggtcattgtaaagaaaggagagaaggatattcctggactgacagatactactgtgcctcgtcggttgggacctaaaagggctagtagaatccgaaagctttttaatctctccaaagaagatgatgtccgccagtacgttgtcaggaagcccttaaacaaagaaggtaagaagcccaggaccaaagcacccaagattcagcgacttgttactcctcgtgtcctgcaacacaaacgccgacgtaatgctctgaagaagcaacgtactaagaagaacaaggaggaggctgcagaatacgctaaacttttggccaagagaatgaaggaagccaaagaaaagcgccaggaacagattgccaagagacgtaggctgtcctcactgagagcttctacttctaagtctgagtccagtcaaaaatgagtctttaagagcaacaaataaataatgaccttgaatctttcattggctttcattaatagtgtaactagataaatgatgggaaagatgagacagaaggaatacatctataggactgctagaatatggggagagtgattattttcaaattactatgtattgagcttctaccccaaggtaaataaataacatttggagaccattaaaatgtaggatggcatagaagaggccttaaattactaagattaataattaaagaaacacagcctttaaagtaaaaaacactgtgcctttgaaacttgttaaaaagattaacttctgtcccaaaaggtatcagccatgcgctaccagcctccctgcccctacagtggcagtggctgcattcttggtgaatggtagtggaagggattaaacctaggcctcagtcatgcttcccagtcactggtactgatttgtatgcacccgctta

SEQ ID NO: 35824 - DNA, 3073 bp, Mus musculus
ataatactgtacttaagaaatcatttgcttgttgaatttagtgcatttcagatagtaaccatatgtcttacgtagcccagagtgtcaagcatgttaacatgggatttatttctttctcaaatgtgaaattcaagttgcttctagagttattgcttctaagactacagatttagaatcaaaggtaaaatacccatgtgatgatcaatgtggtgtttcttcattaaataataaataatgcttagtaaagtatagttaaagttaggaaattcagttaagtatttcaatactctctggcccaaataataatttgttagtaaatactacaattcttgaactcagtggctatctgttaaaaattctgttattcacaatgaaatcatctcaaatggaactattcccatgatttgaatcattccagattgtattcatatgcctatttagaaaactgcagatatccatgtatcctggaggcaggaggtattctactttttgctaaaacaaaacaaaacaaaacatgtttatgaaatgtaaattatcttgagggttgtggatactttttattaatagggtataagtaattttcagaatgtagttctgtgttccctaagtacgaaggtaactagaatatgggcatgtagtaaggattaggttatttcattactgtcaccagacagaagtccttcctctaacattgtgaaaactgttcaattaccaggagtcaacagctttctaaataaacattctatgtattttgttttgtatttaaatgagtaatttcaataatttcattaaaaatgattcagtgtctcaaggtaaatgtttttaaaacaaaaactatagtaaatagctgattagattaagttactgtcatgtattaaattgtaaccaaaaagtcaagacactactttgaagtgtgtaaaatttcaaagagagattgttgattttaccagctggcctatagtagagtagatttgtctgttgttctgaaactgacttttgcaaaggctttgctcccatctttccttgttcttgatctttactgctctcctgatgtctactcagtgtcattttacaatttagtttagaaactcctcacagcatgttttctttttttttttagcttcatctccttcatagagggacagattttgacacaagtgtttatttgacatctatttattgttcctgtttggccatagtgtgtgtgtatgtgtgtgtgtgtatgtatgtgtatgtatgtgtgtgtatgtgtatatatacatatacatacacatacatacacatacatatatacatatatacatatatacatatatatatatatatatatatatatatatttaatcttccaaagtacagttttagtttaaacccctctgaattctgcttccaatgacatatgtggctatttaaatttaaattcattaacacaaaataacattttaaaaaatttctgttttacttcgcacttagaaccttcccatcctagcagactggacggagatgccctggattcgatctagatgtgttcaccctgattggcaggtccctactgtcctgcacttgcccacaatgagcaaactatatttggtttaggcatagagtagggagtttgctgtggccatcagcttcttccttccactctcatcaccattgcctctgtccttctttctttccttcccaagaaatttccttcccctccttttccctcccctgttccttaaagaatccatgtgtcttcctaaaatccctcttgacccctgccctttaagaacaccgtcagtgcctactaagggtctagaaagacctccgttgagcagtcagagtcttccctggctccacaataccccttcccttggctgactctccttgccaatccttacctccctggtccttcaagcctttgtcccctcttctttgctccaaccccttcacagccattcttcatagcctggctcccctacccccctgcttagaagctgaggctgtcaggactctctagagtgtattatgggggaaaatgaacacatcttaaaaatctgttatttgctacatttttttagaaggcatttttcctcatgagtttgatatgttaattatacagaaattggaaagcagaaatgcattttaaaaggcaagaaaatgtctgagtgctttatactaagattgccatagtttgttctttttggggtatgaatgttttacatttcttgatcctctatgttgtttataatacaacttctgctctttctttctgaacattatgtatggttggttattagtgaattttgcagatattttatattgctggtaatatgtgttattgcatagatttattgtaattttctcagccttctttcagttgttagaaatttagattatttccaaattttcagtgttacaaataatgctgtgatcaattttgtgaatatagtgtttttacgtatttcaaagtattcccataggctagtttctcagtgccaagtcatcaaaaacagctccgttttctcttcactcttgctatgatagcatattaaacttagaaaagaaactcaaaaggcctatattaaaaaccataataccaaaaaggaaagtctgtagtcctataataatagatgagagttgtattctgctttaatatctgattctttgctgattaacgacatgaaccattatgctctctgtatgacagttgtgtgactttgtgtggtcatgttatggatcttaccttttaatgtaataaagtaaattgctcttttcctgtgtgacagtttttcctgtatatttgttctaagcgtagaacaactctatttgggacctgaataaatactcattttcctttgaaattttttggggttcttaatgttaatgtctttctacctaattataagagtaatgtatgcttattgtgtgaaatggtaaaaatatgatgaagctagaaagaagcccactttcttagttgtctttttgaaattatttttattttatgtattgagtgttttgtctgtgtgtatgtctgtacaccatttatgtgcctgatgctgttggaggccagaacgaagagttgaatctc

SEQ ID NO: 35825 - DNA, 1041 bp, Mus musculus
gtgatggtgatgttctgaggcagtggaaacagaggtgtacaaggagttgtagaattgatggtgatgatgacacaatatgaatacatttattgccactaaagcatggttaaggttgtgaagttcatgttttgtgtttttaccatattaaaaagaaaatatggatcaaatacaaacacttaaaaacaagtcatcttcaacagatttttacacagcgggtagagctttaattgattaaatgtgtctgaatcaagtatctagctctaaactttaagtagtttaaaaatgcttctagctggccagagactgtaactttccctcctgctagtccattgggtgtcatagtgaagagtggcgtcctcaagtagcacttccaagctgcttttacaaacaaatggatgttgtgtatgaagaagagatgggggagaggtggtgctcagacaggcttctgctttcgctggtgtctgcagtgtactacatgcaaccgtgctgtttcctgtttcaggcaggcacaccgaggacctcgtagaacttgtatctctcttccccacgctcgctggacttgcaggactgccagttcctcctcggtgccccatcccttcttttcatgttgagctttgcagagaaggccagaatcttcagaagcatttgcagctccatgacttggaagaggagccagacttgtttggtaatccccgggagttgatcgcctatagccagtacccccggcctgcagatttccctcagtggaattctgacaagccaagcttaaatgatataaaggtcatgggatattctatacgcactgtagactacaggtacactgtgtgggttggcttcgatcctagtgaatttctggctaacttttctgatatccatgccggggaactctattttgtcgattctgacccactgcaggatcacaatgtatataatgactcccaacatggaggtcttctccactcactgaggccttgagttctgccagcctcagtgggcacatatgtgtccccttccccccctacccattgtattagatataac

SEQ ID NO: 35826 - DNA, 1207 bp, Mus musculus
actattgcaagccaggggatgcagatacctgtagaaatttcagagatggcattccacaaaacttgattttgtttggacttttggtatctatggctgggaggcaatttatttctagttcttcaagtcaccttgtggcttgaattgagccgagtggtatctttggcataccccttatcagagaatgtgtggctctgagcatacaaggattaagggatcattttctgtttagatattcatttctagggactgtctggaatgtgcagagtagacagaaaggtacagtaaattgcatccatttgccatgatctgtatcctaaagtaaaagctgattaaatttcaaacatgccagtttggttctgcagattttaagttagtctggactctgcaggcaaaggagaaggaacattaggttaaggctaagaatcagtgaatggagaggttgggattgggagaaatgcttgttcaggtagctattcattttgtatgccaaggtaaataaaattgttttcattcttgtaattctgtttttcatttgcagcggaaaatccgccagagctactttgcttctgtgtcctatttggatactcaggttggacatgttttgagtgctttggatgatcttcgtctagcccacaacacaattattgctttcacatctgatcacggtaagcgttttgcagggtattggtgaattgagtatctcagtttcctgcaaaggacactttgaaaaattcccatgtccataggggtgctctgagtccaggatcatggggtgcttttaaaagcaacttagttgtttgtgcacctccatcttggatatgtgaaaatggaggcaggtgctgtatctttttatcttagttgcttgtgagagaggatttgtttttgtctcttaacattttaaacatgttttcttatttttaaattatatatatatatatatatatatatctgtgttggtgtgcatacatgagaacagtgcctgcagatgacagagagggtctggagccatagacagttgtgaactgtctgacatacgtgctagaattcaacttcggtcctctggaagggtagaaattctctgaactgctgagctatctctccagccccagtttattttatctgtatgtgtgtgtgtgtgtgtgtgtgtgtgtgtgtgtgtgtgtgtgtgtgagtatctactatgtgcgcagagagcagctggaaattg

SEQ ID NO: 35827 - DNA, 1215 bp, Mus musculus
tatggtcgaggcagaatgcctacatgatgagacccatgtcaaaactctatgctacagttttattgagcttcactggttggcagcattaaacatgtactgtctttcaactagctgggacaccatgtgcctcctaggtgaaattcctgggaagggactctgaagctggtcactggtttcctccagattttccttcatgtttgtttttccttttctgaatgggtttgaaatattttcactctagtaaatgggaccttgtgctaagtcctatgagttctcctgactcactgaaggttaggggagttttgggaacccactgtgcttcaagcccgcctttgtatgttggaagtaaggtggggagcagtaggagggaacagttgttgctgcgagtgtcagaaccgtggcttaggatttgttgctgttcagatctataaggcacagagcaggtgagagcgggtgagtagccggaaggcattagcgccaagccaatgtatcataggctttcagaaaacacaactttgtgcttttgccaaacgactagcaacctgtggctttgtatattcttgtcctaggaatttcagaagttgtatcccttggaaaacataaccctggctcctgatccccatgttcctgatagcctaccacctgtagcctacaacccctggatggatatcagggagagggaagatgtccaagccttaaacatcagtgttccctatggaccaattcctgaggattttcaggtactagtactatgcttgggggataagtgattgtgtaataccattggcgaggcaacttttgagttcaaggtcaacctgtttacataatgagctcaagaccagtctagactaaatagtaagatcttgttttaaaaagacaaacaaaacccttccttacgattttttctgagcagtggatttctcttaatatttattgacatgggtagtgctgtgcagatcaagttttcttactagtaccttagctcccctaagaagtggcatccagactcgttataaacaggcacagggatcagatgtagtttgggtgaacccccctagcccatgggggattaatattggtcacagttgggatgtttgtagaaaagtgcagaatctttagtttgctggcactttgatttactctgagggaaagcctaaagtggcacctggtactcttggggtgacttgagtgagctgagccttggaccagaggtag

SEQ ID NO: 35828 - DNA, 1793 bp, Mus musculus
tgtgtgtgcactgagacacacactcctacttcccttgcccccaacctagacctggaacctcggaccaccatctgaagcctcgtttgcatccagtgtcaaccagccactcagaacagaacataggtggcagggactaagggtatcttatcaatgtggatgccagtgacacatgagcaaagaacctatttctttcgtatgggtacctgaaatgtgttctcattcctgtgatacccacccagggatgactgctgcctaggcccacagaaagcacatctgtggtctgggcagattttctagtgctaaaattcctatcaaagtattgaatgatgtggttcctctgggaccacttccatctgtggctcagctgtgctgcttatgggtagccagtagggactataagtaggtctgtacacacctgctgtgttcagatacagcccggccctgctttccttgtctctgctgtacagaaatttagctttagccaggatgacagcaggtttgcagggcctcatcagtgagcccttcccaatggcatgattccatgcctatatagtatttatacagctattttagcactgtaatatacagtgtcaaatcctagttctgtacagcatattctctgttaaagtatttttttacaagcttgtgctggagatggatgggttaagccatgggagaagcagatagctcagactgctgtatctcagtcagatgccccacctcacttaccatgcccactgataccctggaatttctgccagcacagctactacaatcaaggaaagctctgtgcttttccaacatggggtgtgggagaaatggcttaaaagcccaagaaatgcccccttgagaccaggacactagagaaggttgccaaggcaggccagaatcagccaggaactcctgcaaagtcgagagcattctgcctacctgcaagaagaacactgcatactgggcatgcaggtaccaccacctgtcagcagtttctccaggctctgctggtatagccagcccagaacccatcataccagaaaataaccttcagtctaaatcaaatgattcattcatggtcacctgatcagtggcttcagtcacacataattgaagtctctaaccctagtcctacccttggcacaggcctccagtgagcctgttctgtttcagaagaaaggggaagcagtgtagcattttttgtttggtctcttaaaaatgtggttaaatccactattttttgctcctgtagttcaataaagtggttcattttacatgtatactgtgtgtattttattctgtagaaaaacctgaattaatctcacctaatgacaaggacaccctccggctaccacaggcaagtaaagcaggcaggtagggtgagcatcctttgctgtttcttcaagcagcagtagagggaagaaactcttgccacccatccccagtgcttgcttgatggccttctgccattgtgagagctttgggggctttctagactttctgaggttctagagcatgcctgcagttgcactacacagttttatctagctctcttaactgtttctgaagcttaggaggaattttactgggaggtctttcaggttgaaagaatctgtaaggaatcctgtggctgttgataagaaataccctgcatgtagccagagatcaggcataaattctttcttgagctccttggatttcataaaaaactttgttaagtcaaggcagttgctggtactcagctgccaggagctttgcttctgtttgaggtaccactggttctcagtcttggcacttggatg

SEQ ID NO: 35829 - DNA, 1179 bp, Mus musculus
cttcaccagcagccattccttcctctttatgggcgtgactgggacagaggtgagttgtaaggacattcctagcattgggtggtggtgctttaaattccctttgttggcctgtaaatttctttatggccctgagattgcttaggtggggatttagaataaaaaggactttacttgatttcagtattgccaagaagtgatcccagctgttttactcagccttggactgtcgctatacatcagtgaccctctggctatgactcttactgtacctcctagttagtgctgttcaacggtaacaacctgcagaagtttgctgttgacttcagggagacctcaggctgtgtgactagcagcaagtatgtcatttagagtttcctggttctgagatgttccttgtgcgtgacagtggggatgtgagagcatagcccactctctgacaaatggcctctacctctaggttccttgcctaaagaaagtctggtggttttttaagtagaggatgataactttttgcttttcagtctttcagctgagatgaagtgtaaatcagaggctgactctttccctgtaggacatttcctttcttcctgttatcaagtccaatcatttctacagagattcccatcatttctgtgtcatcaaacaattttcctttgttgacaaagattgtccagatgcccttaaccctcaacagctgctcctgagaacttataaccaacgtagaatcacagatcagctaagaacccctgcagaatcttcaatttcaggtgtctcctgatgcatatgtgtcaatgaaagtctaggatagctgatggaagacctggtcacatcttggcttcccaagcctttgaaacaacattaatcaataatacagtgctagatttaaaaagtaaacaggcaaaataaatttaaacatgtttttgtaacggattatatgtaaaatactatcatttacatataattaccatactaatgaagcatcacccttttttttttgtactagacttggaaatcatttgtgtatttttcttataggacatctccatttcgaccagccacatggttggtgccagtccctacagtgtgggacagtaggacgctgagagacgagttcatcaggttggcttttagtgaccagccagctgcctctgtactaacttatattaatgttagggttaa

SEQ ID NO: 35830 - DNA, 1200 bp, Mus musculus
tgtctgtctgtctgtctttttctgtgtctctgtctccctcccttcccttccctccctccctccctccctccctccctccctccctccctccctcccatgagacagagtatcatgtatctcaggctggccacagactctatgaaagcaaggattaacttgaacttctgctactcctacctcatcctcactgggattgccagcatgtaccaccatggctgggttatgtgacgctggcctggaacccagggccttatgcatgccaagtgagcactttactgacttgagctacatttgcctaggctaacctgaaactcatgatcctgttacctcgacctcctgaatgacaaatgcatgttgccaggccttgtggacatcctcatacccctagctctcaacaaacatagaggtgaactctcattaatagggggagaaggaaaagataccattgttgaaaaatgtataaatggttttgaaacagctcaggctggcctaaaactcactatgtagctgagagtgactttgaatttctaatcaatcctcctacctccacctccccacctccccgctgttggtcttagtgtttggtttatgtgtcattgaggatcagacccagggcttaatgcaagctagtgttgtactcttccaaatgagctacatcccaaaatggctacagacggaacagacggtgagaaggatcatatccggaaactatcttgcgttttctctctctctgctattttggtctttttgtcatggtaggtggttgtggttcttattcttgttttaataaggaagtgagacattttggggggagtagggggttttttgtttgtttttgtttggtttttttttttctttactgtctctggatctcaccaccagcagttgtttgcctttcaggaaacacccacctggtagaagggagaagccattaggaggagctaatgagtacattatacccttactatactgacaccagatggaatgtgtttgggaaacaattctaccaaaagtttctatatttctgatcaaataagattttaaaaatgtttctttataaatattttcaactttattaggatggaagtttataggaatacatcttttaaactattataaaggtgagactaaaatttgttatgatttagtcaggaatagatcttttcaactattatgaaggtgaggctgaaatttattatg

SEQ ID NO: 35831 - DNA, 1169 bp, Mus musculus
agcatgtgttgaagtcaaagagattgtactctattcttcagagaccccatgcctaggaatggtgcatgaatacatgtgtaggaagacactcatagaccattacatatagcatagaggagccctggatatgagctctgtattttaggactgtgtccacagtgcagtgtgtaaggaaagtatgtgtggttgtcagttcttgggagcttaatctgaagacagtagacagatagcatggctaacagaaaagatgacttgtgcctgtgattccttatagcagcccaacccagtggagcagcgttacatggagcttttggccttgcgtgacgattatataaagaggctcgaggaattgcagctggccaactccgccaagcttgctgatgcccccgcttcgacttccagttcgtcacagatggtgccccatgtgcagacgcacttctgaggggactcacttctggcactgcacttgaactctagataagtgaaatagctgactctcattctgggcatgtggacaaagtagatttaaagtgtctgcctccatttagaagttcaactaacatcttagacttttgagtatgtgccttctgtaatacatatcacaagaaatcgatggtgtccgtgtggcaatcataaggaaggagtcaagagggggttctggaaaatcctcatacttttttttacaaagcacttttgcaaagataaaacttaaatttaatttacctctatataaattctacatatacagtatgtattttgtgggcttaattgaaatattattttaaatccaggggggagatttgtttgcaaaatgtattttcctccagctgcttataacagttgctttggattatctaaaattaatccaaatgtgaaagatgggtattactgccaaagccaaattgcactctgcttcttcagcaaattccaagagcaaggcgtttaaataattgccaatttttattttaccataagtggtaaggtaaaaagaaagatgaacatttcatcattttgaatttttgaaaataaaaggttctcccatcatttttcaagagaagcacatttttatattaagaaaaagtgataaggtttgatttttttttccctcaacattctcagctttgctttctaaattatcccatgatttttgtctaacactgagtcatact

SEQ ID NO: 35832 - DNA, 2576 bp, Mus musculus
tctagcttgtcatcttagctcttaggactcagcccagggaccatttgtgggtggtgaaagctcctattattaacaagtacttcttttgtgtgaacagcctgtgccccttttgcgagcagcctcaccctgtgaaccacctgtgtcttgtacaggtagcttgggagaaaccagattgaatgcagtgcggtattttaacttaagagaatcttacaccacttctttccaagttacatcctttgttacgaacaactcgtttacttatagaacacatcaccagccatgtggctcctctcagccttttggcacaatttaaaaactgttttaaatgaaatgttagtgtggcaaatgaaccattgccacctgttctacagttatcagttatcttcatacaagaagtcctgttcaactggtacaatatgtactgctgtgtacatataaggtattttttaaagagaaacatgcctttattttcctatgtccttttttatgtttagaatagcctgagaaatcatctgctaaactgtgctgtaggagaaattctttcccaacggagtccatgctgccttttgcgcagcacatttgaattaagattcgagatgtgtcagctcagtggcaatggagtgttgtcctctaactctggtacttgtcttttgagatggcacagcccattcattcattggtggtagcagcaggttccctcaggatgcagcaaactatgaatgctcagtcctctggccttgtcgcaggtaaactgagggctcaggcagcaactctgcatttgttggcctccctctatgacagctctctaaaggagcaagtcttgaaaattgctttggcatcctaccacctgttaagatgcccagcatctatgtcaaatcaagtcgtctctcacctgttagacacctggacagcttgctttcatttaccacgatctcttctcagttgatttacatgactgcctggccatactttaaggcaaccagtggctaaaatactcatgaaattaaatatcagtgattgcactgaactgtatacttcagatgagctaattttactacgttaatttagcatttatttaagtggagaattaattagttttgtattccctattttacaaaaattgataaagatatagttcatggattttattctgctgttatgggtttatttctatgggtctgaaagcataacatgctcttccatggttttcccctctcggacccagccctggcttggcaggcctctttccacagttaacagtgttgatctctgctactcaaccagtccttctaggaatgaatctcccatcagcttcgacgtgtgcaatgccagcatagccaccaccaccaccatgtccacttctgtgtgtcaccaggcccttcagagttggagatgtgtttgaggctgaccaagtgagcccctgaggacagatggctcacatcttcctcttgtcagtgtcaaatcactggatgctgtgcagtcctacacattaacctcggttttcaaaagtgttcttaaaagaatttttacagccaaatacatagaaactagatgatttttcaacttacagaaaactacccaactataagataaccagagacatttattcaaggaagtttcataagttatgatcaattctccatttttaatcatctgggggatttgtttctaaactacagtttaagtgattttagcttttgatttgtgttcatcatagatataaaaccttatttgtagatggataaactgccatatctgaggtaggagaagctgtgagttcagggacagctttggctacatatcgagttctgggacagctggcctatattgtggagccctgtctcaaaatcaataccaaaaagaaaataacatgaactataatattttttttcttcatatactttttaaaagtggggacatttaccaatttttccctagaaatactgtgtaatttcccagcgacacttgaactattgaagatagagtggactggataatgttttgacagaaccagagaagccatggggatggctgcttgttgaggtcagctagcctggtacagatggctggtaaactgtggctctggctcctgctcaagccatggcctcccagctgccatgcctgcagcacccctaaaaatgtccactggattttaaagaagcacaacagagtctttccctttgtatgtttctagcacagaactgtttctaaaacaacttgaagtatagttttcttatctaaacaattctttcatgtatgttttatttaagtactataatgtaaaccctttaaggttcaggtttttaaacaagtacaatactgtatttgcctcatctgaagcactgtattccaacatgtaactaaaatgataatatgtttgctccctggtctctgttgtctctgtgttttcaccatttcagtagtttttcacccctgaggaaaatgagtactaagaaagtaccatgtgttaaatgctttccctgtacctgccacagttaatatatgtaaagtgcccaatagtagttgattaacttactaagttgtcagcaatttgttgtgagtcttgagtgggctgg

SEQ ID NO: 35833 - DNA, 1788 bp, Mus musculus
cttgtccaggtgaaggctcttcagtgattttagtgcaaacatggtctcacaatagtcttaccccaagattagaaagaaggagcatatgggagctgtgacttgcggttggattcctatcagactgtgtagggatctccggctggcctggttaacaggtcttggaagtcacctacaaatgaactttctcccaggtcagggtgggtgtttacactaccctgtacatgatcttatttaagtagcaagagctacagatcctgagaatgaacgtggaaaccagaagcatgcttgttgttttattagaagtggatggggaaaggggaaggtaggggaagggatactagcttagctgcctttgtagttgtgtagctgtcctccctgtctgctctgaaaagggctctgaccatgttcatagcggtaaatacaggaaaccaagggccagggccagagctgactgctacccctagtttgggctggatctgcctgcttcctggattgtttctttggctccagtgagcttgatagtgaaccctgcaggtgaaagctaagctagtttccaccccatatgaactaatagtttgccacgtcaaacggcacttctgaaagcaatgtgtgtcactgtgaaggcaagatctacagctcctctggacaacatgattggccccatatatcccataagctgtgaattggctccttcacctctgctgagctgggaagaggcaacactcaccttaagaaactccctaactcttgtgctgtctaatgcatgccttgagtgtgtttgctgtttaaagactattcttggtggagggctgctggtggtgtcatgtttccaggcagcctgaacaccaactcctactgtatacctgtgggcgatgagatgccccctttgcttggcctttggtcccagacggtccaggtctgaggatccaatagggaagctggagcactgggaaaatgacactaagatggaaaaaaaaaaaagctcatggcctcaggaagcccgccttattcttcaggaggttaataagcaaagaaggcatcacttgcaagatgtgtccgtttctagaacctcttaacttgctggtcggattgctgtcaacattgtcaggattgtgccttactgacaccaaggacaacaggagatgatggtgccaccatttggccagtgctgggctataggtgacttaaaggaaggattttagtatttctggtctgttgacatgtagctagctagggtaatctcaggagggttgtctacctttatgctgaggcctgtctgatggcaaagccctcaaaccccacggccatgatgtaaaataaatgccctcttgttaaactgttttctcaatagcactggttccagtgaaaaagagctctaatttgctctcccttagctacctcggtgccttttgcataaagcccttctgcataaaacccatcactcagcccgcaggcgctagctaagtggctggacaggcctgagcgggccatcggcctcctgttcatacagtttcatcccaggggccgggctcctccttcccactggcattttatacttggtggggcattgtggcctgcagaaggcttgggactggtcctgtaactgtgtcccccctgaaggctgagttggccaacttgggttagtcccaggtgacagaagggagaaaccaaatgaagcagaagagccaattgccaagatcagatctcgatcagtgaaacttgacaggaagaactttaaaaatgctcaacagtctcaagtggcttgatgtaggggctcctaccctggtg

SEQ ID NO: 35834 - DNA, 1397 bp, Mus musculus
aggaagaggaggaggaagaggaagaagaggaggaggaagaggaggaagatgaataaaagctctgtctccttgtgaataccttagagtaggagagcgctgtgattgacacatctcttatttgagtcgtgtctattgcccttgttaggtttaattacaaaatttgatcacgatcatattgtagtttctcaaagtgtcagtggtttacatgaagtggccgtgggtgtccggagcgccctgaaactgtatcaaagttgtacatagctccaaacatttttaaaatgaaaaggcactctcgcgtcctcctcactcagtgcactttgctgttggtgtgacaaggcatttgaagatgtttctggcattttgttctcaactcgtaaggtagtgttaactatatggttattggctagcaatcctgagttgtcaactgtacatatctatagtttgtaaagagaatgaaacaacccagacagattcttgatgctccttgtttggcgtggaggctgtgaggggaagatgccttttggagggggccgtagctcagggcgtgcactgtgaggctggacctgttgatactgcggtgggcatccatttagcttcaggttgtcctgtgtttgtatatagtggcatagcattctgctgacattcttagttgtggaaaggggggaggggtcggccggcatgagaagtgtttggagttttttctttagttaagtgcagtaggtttgaaactttttaaagaaactgtaggactcatcattgtcagcaaagcaaagaactactgcatcaatggaagttcaagaaccctctggacctaaacgcaatttgcaacattctgttattttttgtatgtttagaatgctgaaatgtttttgaagttaaataaacagtattacatttttaaaactgttctgtattacaacggcctaaatttctgactcaccagtctttgtcaacttgctttcttgtgcttctaaaactgctaaggtttttttccagctaaggacagataggggtgggcgggtattacctgaagtcccttgatttgtgtctggcactgttcataccatagataatggtttacagcctacagagatacaggaaagcaagcccttaggtaaaaatctctgccttccatcatgacttctttatgaggcaaccagaccccttttgaccctttgccccaggatgtgtagtaggcacttactatgctcacaatctcaagtctcaagctgtgtctcatttcctgaaccctatgaggtggtgatgtgggttggagtggcagagtggaaggcttatctcttagatatgtatcttactccttcaaaaagtcaacactagggaagattgcaggttcctctttagggctgctgatctgtccatggaggactgggttagtg

SEQ ID NO: 35835 - DNA, 1123 bp, Mus musculus
ctatatcaaaagaacagcagcaacaacaaaagctacaaaaacaatttgacttaataataataaaaaaaagcaactaatgggcttgtgcttattttcatataaatcttttgtagacaggacattcaaatgggtaagtgaaagtatacaaggaagatgtaaccaaggaaggctgatgctggaggtgtgcgaaagaaaggcttgagatccgttttacatatatccagtgtatctccagacagtttgtatttagtgtgtaagtatagtaaatctgtagacaaagtgttcagcgatggtacagtatttgtcacttgtcttcagttaatagcaggtttctttactacgttattcactagtgaaacacacagctattcagattttgctcctaaaatttatttttaacagacttgtgctatagtgtagcttgacaacattttttatcccaggagaatggagttaccttaaaataaattactttcagagatactggaaatttactcatcaatgcataacctgtgaatttcttaactccattcctttacagacgtctagaatctttccatatcgctgccggccacacttttaaacctgtgttaattgctatgtgtgcttgaagtatctgttcttttaaagatgttctttaagtcatattgtcagttttacaatctagtcttccttccatgtttggtgaaatctcactgaacaggaataatagcaataactaacaacatctgcacagcaccttacagtttgcagagaacgttcacatattcttgtctgagttttgcatagtgaacatgtcacagagatgtcccttgatgtcaatgctaagtgttagaatgttcagtcacagtgtcactggccttgctgcggcactgattagcacactgacgggtggggggaggggggcgtgccgatgtgctgtctgtaaagctgcgtcatcacaacggggcctggatagcttagccacttgcttcagactgacttgttaagtgatgcttttctactctacctgaatggcttttgtagtcagtatattgtagcctgtaatttatattaatttaccatttgttgtcattaaaaaaagtgtctgtaatgctactgtgctgtgtcctcattcggtgaa

SEQ ID NO: 35836 - DNA, 1155 bp, Mus musculus
gcagtcctacagtttctcttttctcaacagttttcacttcttcctgttctcacttatattatgaggacagaaataacgatttactaggaacaaaacacaagttataacaaataatgaaccatagatgaaaacaatagctcctggaccatctgtaccctccaaaagacatcaagtgaacagaccttggcacagccttcctccaacacccaaccctatgcacctggccagggtgaaatctatgtggagagcaacctggcaggagaatagggcatgggaaggaggagggaagtggactgtgtggcagagctccttttttccagaccactcacggggcccacttgaactctgccatcttgtttctgatgtgtaccatctgtgtttaaccactccccactggcattagtccaggtatagccttggagtactctgttgtggggcaactgataaccccttccttcatgaagtccagggcctctccttggctgttacagactggcacagagagctcaagattcctcctttgtggggttgattaatccacaggatagtttaaaccatgagatccacctccttggcactgtgctatctggctttgaagtattagaatatatatatattggtaaataggtgcattgaacttgaactttagattgtgatttctcctgatgatggtgcccttacagggagaagttcccaaagtgtgtcttaaaatttttcttagtgggggagcctctgagctggggtctaaagcctacctggggttcgctctgccatggccaggggctgatctgttttcagtgaggctttggaacacattgggcagaggtgacttgctctttaactgtcaatgataaagtaaaagacagcgctgacaccatctctacctgcccccgctgtattctcctggcctctatgccaaatcattcttcctctgcggtgctttgaaatatgtagcacagttttgtggggcccaaaaagagtgcagagcgtgggtctgctggcaactgcagtggttcccagcccacagagtcgacaagcttccttctgtccaaacagccttccaaggcacacactgagacacattccttgaatgcagttctgccttgaggccccagatgacttctacaggctgatccagcgctaaggacatgccta

SEQ ID NO: 35837 - DNA, 3841 bp, Mus musculus
tgtttctaccccagtgaggctgccagcttggagaactgaaccctgtggctcccctacctcactggcccattagaaatggctgatggagctaatatttgtgaagtgcttgaagcactgtggaaccagtgaagtttgcccatagtaagattctttttgaaataagtagtagctgaaagggactggttttagcagagggtttccagtgccactgatgttgagtgtcaacctgaagagtcaatctctttccatttgaccctttttgggccttcctctctccccaaagtctcttccccctttccctccattttgacctccttcctctgttccttcctgctttcattccttgtgtcttccctcttcccttttctttcttcccattttttccttttattctttcacttccttggtcttctagtattgcctttctgcatggagagatttggggttcagaagtcccatgcttttctcatggtagagattggtatcaatctcatccagacatgttggagattctggggaaggtgaaagctctggggccagcccagcatctcccagcattttgttacgctggtgcctgattgtgatctgagatacatgaaaacagacttaccccaatgtgagtcctcccccagctagcagagactcagacataggctccactgactagggccacagagagtatgtcaaggaatgcccactgcctttggcttgtgttgaggtttttctgttgagctccctgacagctagaggctagggatgtataagtaagagcaggaaactgactcccaaggcctatagagagtgacaggtagcccccaggggctgagaactggatgcagggtgagcgagaagcagctccttggatgtggtctgtgggttctaggtcaggtgcttcacagagctctcccaggtgacttgtgccaaggcctctgcaatggttttcacagcatagtatttagtacatatataatgggcataattcctcaaggtgcacacttggcttttatgaatgccctgtacataacttttcaaactctgtctttgtatagacattgatttgatatgatgctaacacttcagtagccacattttgtttgtttaagacttgtgtgcacatgtgtgtgtgtgcatgtgtgtgtgtatacatgtgggcacgttgtcttttctcattttgcttctatgaaatgatagctggtgtgtgattctatttgtcctaagagagatctgctctgaagagaagtctgtcttcatcttgtggggcctgaactctgtgggacccttctcccattcacatgtcttttgggcccggtgccctctgcttcagctcctatctcctatctttgtagatgtcaccaactaaaggaaatctgagcacacctgtgtgtgtatgtgtgtgggagagagacagagacagagacagagagacagagagagacagacacagagacacacacacagagacagagacagacagaggcatagaatgtgtgtgtgtgtgtgtgtgagagagagagagagagagagaaagacaggtagaaaatgaatgtgtgtgtctgtgtgtgcttgtgtacatgtgtgtgtgtgtgtgagagagagagagagacaggtggaaaatgaatgtgtgtgtctctgtgtgcttgtgtgcatgtgtgtgtgtgtgtgtgtgtgtgtgtagatgtgtgactattgacttagatacttttcactaaaaatgaaaaggctttaaaatatgactgtcacttgttttcaaacaaatcctttttaagactttttaaacaagaatggcaaccctgtatgtcccctcccagactgcccatcactttgggttttcaaaatgaaagcacaagagaaagagtggggcgcacaggtgcctggcatgtgcatacccttgcacagctctgtgttgcgccctggctgagcagttccacccaggaaactgaggcctcctctgctacttgccaattccactgccattagtgtgaattccttagggtgctccagcaaacaagcatctgcccaattgtttcgatattgtctttttggtagttcaaacactagggattaggggcagcagtgttttttgtttaagcagttagagccagatgcttcctctctcccactggatggtaactctccagatcccagacagagttgacagatcttttgacaagcaaatggcatcccatgagaaaaccaagaaaaaaaatccaatattgccactagattgtcttttaattcaagtgggaggaagatggcagagagaggctgagttgccaggacagtgtctttggaacagagtgtgtgctctgactgtgtgtctgctcagtcaatcctgagctgctgggtcgggctgcttttcagcctgtcaagtgctgaagctccattcacgggcgtcaccgatcttccccactgaaatctcctaatactaatcagtataattagctaattttagactgctgcaatgaaattgcttccaagtacagtaaaagcccattaatttgagcacactaattcagaacttagaggaaatccaaatcgagataattcacagtaactgttattcttgctatataaaaatatttgaaagcgtcttcccttcattcagtcttcatctgtataaaaggaattctgtttaaaatgggtacctttttcaaaggaaatgctcaaggtaccaaggatcccttcattgtgccttcagcttggagtttagcagttcttgtgtctaaggctctttctgtgcagggtgatcccttgttctctctccattgtggggatgttagatattaaagcctttcactccatgtctgtatttatcctgtgattaaattagtttgtgatcttgactgcagtttaaatacaagtatgtgtctttgtaagtgttctgtaaagcagacgttgcactaacagaccgcctgctctcatttaccctcaagtcttcaaactttagagtgtctcctttcccaggctgtggaaggagaatctctctctaggaagaatttctgtgacaaagatctccaaatagcacacgccctcagctccatgcctcaaccgttgtttcactgtactgctatctgactgctgaacgtgcctgcccttctccagcccccagcgagcataaagactgatagctaggattgggaccaaccctccagctgctttttgccacccaacctgtcttgcctctctgatgccattttcccagacctgaattcacctgctgttttactctgtcattgtgaatttgtgacaatggcaaccccgagcttctagaaatgattactgtgaaatggattaattttggtaccatttgaaactgtgctcatactcatgtcttgactgatgtcagctggagcgtctgtacatttagtcatatgttgggatttcaaatggggcctaggggcaacaaaccaacttgcttctgatctttctcacgcacgctttctggctccctttttacaattgttgagtttagctgttaacttttgtctctttctgtataagaaaataatgattaaaaataaagatcacatggcatccacttgtaccttgtcctggtcgatcatagatcctagaagactacccatattttgcagaatgtggaagtctggtggtcaaacttgtggcatcaaaagtcagattgaatagataaggaaacagcccaaaccagtttaggagccagttggaagcagacatagtctggatcctgaagtttgtgcttacagcgtgtaatatgatcttctgacccattctcctgtgggatgaggttaataagatctgtcacagatcttgtttagcaacttcctagtcatcagatccctggttaagtgaagactgggctcaa

SEQ ID NO: 35838 - DNA, 3841 bp, Mus musculus; identical to SEQ ID NO: 35837

SEQ ID NO: 35839 - DNA, 1130 bp, Mus musculus
cgaataatgaggatttgtgagttggtcagttcatcattagcatattttcagctctttcaaggcagctgtcatttaaggatgaggtaactgcctccatcagagtgtgggtggaggagtaaagtcatttcttacctccgcagctcttcccaaaaagccttgtgcactcagcctaaaggtttctggtagcctgggtccaatgttagcagctgacatacagaccagcactatactactgttgcatatctgaaaaggaagaagtagagctagagagcgtgggtctagggggagcagaactatatttcaccagaggcgcaccgactccagaccaggctatccctctcaaagtccttgggccggcactatgttgtcatttgggagccctagaaccccctccctagagtgaagtgatccctgggaatgagggaaggggagcttggatgaatgggaaaggttttgacttctctctctggcttactagcagcccagaattcctcgtgtcttgctctagtgaccattgaccatcaatgtggctacctccctctgagttttcaccttttgtttccattcttgtttgaaagctgttaaatctgaatagcaatgtttgcctagagtccactggaacttggattggctctgatcacaataatttagagaggcaaagatttctgctcccaagtcatctaaattacacgaggtcacagcctaatgaacgtgctgaaacaggcattggtgcaggaaaaaaaaaaaaaggtgagatgccagtgcttcccaccgccattaccagtaccacatcctttgcccatgcatgttttacttcttgttggattttcttcttctccagacttagccactactgaacccccatcattgactctccaattcctgcagaacaaatccaagtccctaactcatagctataggcccatccctcagcaaggaatggcctcgggtacaatgaatgtgtggggaaggcagaaaaacaaaaaacaataacagactaatgaatgacctaataatagaggaatctctgccttcttacaaagtctgccttccccacatactcatctgcataagtagcctttgtctccagggatgcctctgttttagtttggaaccatgttggaattggt

SEQ ID NO: 35840 - DNA, 1931 bp, Mus musculus
ctagtatgttagacatgggtacaagtctaggtatcagcgtatgcagactttctgaggcttctgagagcccaagccaaaaaactgttgacgatccctggtagggaaattacaggcattaaatactaagggttggcaataggctactgtttagcttgtctattcactttgtgtgtatgtgtgtgtgtgtttaaatttctcacattttaaaaatagttaattttttgattgaattacatagcagatttaaattacctccttccattctcctttggtttttccagtaaggtatgtcagcacatgttggaaagtttacccaggtttaaatttgataagatacaatattaggaggcttctaccaaagggatatctgtgtctgtttgaattttgttagttagttaaaatctttaccctcagtattgctgaacttttatcctctgaacagcttttaatgtgtgtaaatcagggtaaagaaaacagatacggtttcttgagacttctgttcctactgtgaaatatttccctgaagcgtagtgttagaaatggctttgaaaagtgtgaaattcaccccatctctgggcttcttgggtccctccttgaaacactacggtaatttaattgctccctttccctctcctccagagtctttcacccagagacgaatttggcttatgtaacttctcaaagaaaagcttgctatccagtgaaacgtcaagtaggctctctgccctgatcgtgcagcattttgtgacctgttttctagtcctgaatctgtctcaaactaacatcaacttctaggttcccaggtactcaaaacactaccagttgatgtctggcacagcagaggcaggttcgtccctgcagtttgctaatatgctgctctaagtcaacctcactctgctgcctttgggctcagcattaaattggaagctccttgaaaggaaaaaaatagtcctcaagacttgggaatgcaaaattgaggcttctttgttggattgacttagaagatagctcttcactctctgcagactttgaatgggcttgttcttcctaccaggtaaccagagaagaacattctatttatttgactatttatctgttacctgaactctgaagggaagaaggagtacattgtgccacaccccaatactaattatgaactagttctttctcaagttcagctctaggatgggacttagcagagagtggccaataacatatgtgtgccaaatgaattagtaagagaaaactaagtcagtcccttaattatctaggcatttcagtgcaggcctcatagacaagagtaaaaggctctaaatcggatggcttccccacttaaaggtgtactctgccatttaaggagttttagaaatataaaatatactcaaagacagcttgtaaggctagtattgatttgaatccaaaacagcccttttgtgtcttagacacaaaattctgcagctaacaaagagagatggttttgcattgatttgcttctttttaattgctttccgtttttaattatccttgcttaatccacattaatgtacacaaattataataaatgttaagatgttacacagcagtattataacttcttttttaaaccatccgtgtgtatgtgtgcacttaagtataataacttggtagttataggccttaccagatgccattcttgctacaaaacaaaactggacatggtagcctgtgatcctagcactcaggagacgggccactctgaggtgacaggcctgatccctgatataatcttggaacactgaagaaggagtgaattgttgtcttcttgttttgttttgcttacttagagtgagcctgtctaaaacaaaacaagatgatatgcggggcccaagtctgctccatcacagggcacagctgctcggggaaccgggacatgggaactttaattgtgttta

SEQ ID NO: 35841 - DNA, 4043 bp, Mus musculus
cgttctttgcactcagcactgtgatcacatctgctgagttctagtcatctttcttatctgttgagcatttcttcaggtggaggagagtttatgtgttgccaatcttgaacctaacaaggaatgggttaaatccaatatagcactgagtgggtggcagagtgctctcctgttctttcctccactggcattggtctttgcctcctgacattggcattttccccacaggtacttgcagaatgcacagtagtgtccctggacttgcaaggaggttgctgcaaccaaaggtcagcagggttcagtgaggtttggggagctttctgtgattgaacaagactgaatgtctgggaaaaggaaaggtgatgggaatcattaagtaacatcttaacttcatttgcatttcaggttgtggaaaccaggacatcactgcctttctatatggcattggtttagaatctttgagtcctagtgttaggtctgctgatagagggagggaacaatggccgtggctctattagatgactggtgtaaggggatggatctggatcccaagaaggctgtgctcattgtgggcatccccgtgcagtacactgaggctgcgataaatgatgctctgaaagaaggcttacctcccttgtgtgcatacaaggtgataggcaggatgttcaggagggaagatgaagctaaggcagtcttaattgaactgcctgaagttgttgattatactatgatgcctactcatataccagcagagggtggggcctgggaagtggttgtcaaaccccgtagcccagatgatgagtttatgaataagttgatctactttctaagagatgaaggacggagaatagtagatgtggccaaagccctggggtttagcactgttcctacagggaaaatagagttaaagaatttagaccaagacaaaccaaaaggcttgaagtctctgtgtaataatagcacatgttacaaaaaactgaaagtattttctggcagtccctttccaggcccaggagaagaaagctttgaaacctggttagaggaggtcactgagctgatgcagttatggcaggtgtccgagagggaaaagaagcagtgccttctagagagcttgcgtggctctgccctgtcaatcatgcaggcactgtggactagcaatgactccctaaccgtggagcagtgcttgaaagccctaaagcacatctttggaaataaagaggactctaaggtcttacagttcaggttccttcagtcttctcagaaacctgcagagaaggtatctgactacttgctacgtttagagcccctgctgcaaaaagcagtgcagcagagcccactgtcagcacacagtgcagattcaattcgtctcaagcacgtcttatctcaggtctccatgaccactggccttcggggaaagctctccctcttagatcagcaagggtgcccacctacttttctggaattaatgaaacttactcgagacgaggaagagtgggaaagcactgtggtagtggaggagcaggagcaggtacgaagggacagcagcgcatgtgaggcggcaaatgaagttgtcacccaggcagaggattctagggaggtcagcacccagaccacaggagaggagatgacatcagtgaaacggaggcgactgctctggagacacagtgctggggaagagggacagaggaaggaatcaggtttctgggctgaaagtgaacccgatgagcagaaaccttatgttagagcacaggagtcggggaacgagagaggggcttgggcagtgagccaccctaaccccaaggaaatagaggctcaggacagccaggaattccttcctgtggcaggcaacagagatactttgacaaaatcatggggcagcccagacaaaggaacaggggacatgagtgttgcagaagggcaacagggccagggtaaggcacccaacttcttactagctagaaatgatcccaacaagcaagaacaaattccacacagctcagtgactaccaaatggcaggaccgtggggagtgtcagagactgaaatggggagctagtatgataactagaccacagggtaatccagaccgcagttgggatactagtgggtcacaagatggtgaggatgggtgttctgagctaagaatgcccactggcactgaagcagcacagggtgtggaggagcctgccacagggttgtcttgggcagaggacaccagtgcctgggaacaagcacggctaggcagggagacagtacccaggagaggaggccgcaggatccagcctgtcttcaggatcatctacacagctctaggggagccccatgagggcagcacccttgagtcctttcgtgagtgaactccccccgctcctgtgaaacctgcaagcctcaggacccaaaggacccgggaggcaagtgccaacacaaggcagtttccttcttgacaccctgacaggacactagtgcctgagaaaagccccaggctggggcacatggcaccacagggttaatgccctcagctggcctgagagcctgggagtgtgcaggacaggttttgtgtgagcaaacaggagcagcagaaagaggactctgtgtgtggggcgggggcaggcagggggcggggggggggagagtttgttctgctctcttttgtccagggctgctggagaattccagagagcaagcagggacaggcaggtgaatacaactctgccaggcagctgccaaggctggccccaaaccctgccgacctggagggtggcctggcagctttgccgaggtgccatcctccatctgccacccataaccaaacaggtggacatcacagaaaaggccatctcaagggttctgccaactgcctggctctcccaacacaaatgccccttcctcttccctttcccctctcccccttcccctgccactgctgtccagaggcaggctgccccctgctctggaaccccgcccccttatctgttaacctcatagtgacccagctgtccagtgagtcccttcccctatcacgtgcttacccaccatcagctgctcctgtataaagctgtgagtgagggcaactggaggccctgactacctacctggtcagccacttctacaccctggcacgtgttgtgagcttctgtgccagcctaggctacgctagctgctctcttacccacctggtgttgtgaactccttgtcagctttcctagtgtacatctaggccagctgcctgctgcttgttctcttgcagatgtgtgtgctaacctgagttcctgagcctggttctggaaccatggatgttgacaaggctgatgacttcaacttgggactatgtgtgatattcctctcctgttattacttataattttactttctagggttggtggggtgttgcatgctatggttccaccaattccctgtgcctggactgtgtatgctataagggagaactacactgtagtgagtgatctcttgagatagcagaaggccctgtgtgagcagagcctatggcttctagtgaccactcaaagtttctgttatgtttttaatggttttaatacaatttttgttgaataaatctcatgaatgttctggctatgttctttctggcgatgttctgcctcgctgtgagtgagttgggcagcagtagtggctgagttgacactggcatatatgcatgtcagagaccatgaggggctatagtcgtctcctgggtgggaaggaaccaggctactggtagccaatggatatggggtacaatagctatttgtcttcctagggcacttggcaagaacagggataaaggagctatgtgctgaagggaggatgcagtatataaggcaggccccaggattcctggtgcagcagtgtacttgtaaagagcacagggcatctatgtgatatattgacaggtatgaaaagatgcccctatagatgtcatgcctaactcagaccatggtgtttttcactccaccttgttcagtctacctcctgactggttaggggccagcttctgtcttcgctgaagggtgtttgagcactggtaggaca

SEQ ID NO: 35842 - DNA, 1174 bp, Mus musculus
tctgctctcttttgtccagggctgctggagaattccagagagcaagcagggacagccaggtgaatacaactctgccaggcagctgccaaggctggccccaaaccctgccgacctggagggtggcctggcagctttgccgaggtgccatcctccatctgccacccataaccaaacaggtggacatcacagaaaaggccatctcaagggttctgccaactgcctggctctcccaacacaaatgccccttcctcttccctttcccctctcccccttcccctgccactgctgtccagaggcaggctgccccctgctctggaaccccgcccccttatctgttaacctcatagtgacccagctgtccagtgagtcccttcccccatcacgtgcttacccaccatcagctgctcctgtataaagctgtgagtgagggcaactggaggccctgactacctacctggtcagccacttctacaccctggcacgtgttgtgagcttctgtgccagcctaggctatgctagctgctctcttacccacctggtgttgtgaactccttgtcagctttcctagtgtacatctaggccagctgcctgctgcttgttctcttgcagatgtgtgtgtgtgcgcgtgtgttctaacctgatcagatgctccccggagttcctgagctccgtctggaagccagcaggaaccatggatgttgacaagagactggctgatgctcatcttacgattgatttcagtctgggacaggaagacctgaactgggcatgggtagggcctggggactgggctgtgctgatcccctcctgttgttccttgtgactatcattccttgggttggtggggtattccttgctttgctttgtagtttcttgttactatcctgtgccagaatagggcaaggccaccctacagtggtaatcccttgtgagagttcctaaaagagtgaggaaattttaagaggtagctcttgggcctttgggaagggaaaaatagcagagggattccatggtggtgggcagacaaggcccatctgcgaagctccaggagggtggcccagaacctggtgcttccagtggctgtggagaggtcctgtgctgctaaccccttctcttcaatagtttcagcaagtgtttctgttcaataaacttcataaatgttccagctgtttct

SEQ ID NO: 35843 - DNA, 1209 bp, Mus musculus
tctcctgtcttcctcctgttcctgaagatgccccgttctgttaaaatccaaataaaccctgggatttgtgtgacagcagtgcaaatatgtctgtagggaactccagccctcgggtagagatggcaggctttccttggtagcatcgcaattactggttagcacacattggtgttgatacagtagattatcatacctgaacatcatctccccaaattggaaggcacacaagtgggctattgttgtcgtgtccagataaataattagagaagatacaggctttctttgacattctgctctgaaatgtgttcagtgatggagcctatgaaactgaccttcagcctccaaaggcagtgtgctcttaatagttaaagtagtagaattcatcaaacctcccgagtaagaaagatgtgagtaacgtggcttgaatcagtggaaatgccatttgcagacaacatttacaaggtctttcaattaaatgaatctgtcacactaagaggtgattctgaacatgaatacagcttaattcgccatcatttattaatccctcacttgtatggataggagtaacttagaatgttttgtttgtggaatttatcggccatgtagtatgggatcatcagggatattatatatgaggtctcgtgtacagttaaagctcgcgtcctgtgatttcctgtatggataccctgggtaatccttacttgggaacgtttgatttaataaacatgaaatagtttcagacttgttggcatgagtcatttaattgcattctctttctgacatccctgacgtttcaccccttctcagacagacatagccccatgccatgtggaggtgtgctgtcacctgtgttcctgcatggggccagtgtagtccaggccacttgtctcattgtgtcccgttgtgtagaagcattgaaaacaggctgtgttcagcctcccccattttctccaagtggaattgcattcctccagattgaatgagggcttccctgttggaatcattttactgtctaaaatttgcattatctagaagaacttccccctttctgcaaactacctgtggccctttggacctttagtattatttctttaataatcattaataatcataatataatgttgtattattaccagctttgaatgtctcctacttgaaatattctgcctatctttaccatatatggatactgtccatagtgtttctcca

SEQ ID NO: 35844 - DNA, 1213 bp, Mus musculus
gaagctgctagtgctgatgattgcagctttggtgcctggatcttctcctgtcttcctcctgttcctgaagatgccccgttctgttaaatccaaataaaccctgggatttgtgtgacagcagtgcaaatatgtctgtagggaactccagccctcaggtagagatggcaggctttccttggtagcatcgcaattactggttagcacacattggtgttgatacagtagattatcatacctgaacatcatctccccaaattggaaggcacacaagtgggctattgttgtcgtgtccagataaataattagagaagatacaggctttctttgacattctgctctgaaatgtgttcagtgatggagcctatgaaactgaccttcagcctccaaaggcagtgtgctcttaaaagttaaagtagtagaattcatcaaacctcccgagtaagaaagatgtgagtaatgtggcttgaatcagtggaaatgccatttgcagacaacatttacaaggtctttcaattaaatgaatctgtcacactaagaggtgattctgaacatgaatacagcttaattcgccatcatttattaatccctcacttgtatggataagagtaacttagaatgttttgtttgtggaatttatcgcacatgtagtatgggatcatcagggatattatatatgaggtctcgtgtacagttaaagctcgtgtcctgtgatttcctgtatggataccctgggaaatccttacttgggaacgtttgatttaataaacatgaaatagtttcagacttgttggcatgagtcatttaattgcattctctttctgacatccctgacgtttcaccccttctcagacagacatggccccatgccatgtggaggtgtgctgtcacctgtgttcctgcatggggccagtgtagtccaggccacttgtctcattgtgtcccgttgtgtagaagcattgaaaacaggctgtgttcagcctcccccattttctccaagtggaattgcattcctccagactgaatgagggcttccctgctgggatcattttactgtctaaagtttgcattatctagaagaacttccccctttgtgcaaactacctgtgaccctgtgggcctttagtattatttctttaataatcattaataatcataataatatgttgtattattagcagctttgaatgtctcctacttaaaatattctgcctat

SEQ ID NO: 35845 - DNA, 1228 bp, Mus musculus
tcttgtcactttgatcccagagctgttgacagttggtttgtgagcacaatgaagggggaatagccagtggccccactggctagaagctttgttggcaagtgaacttgccttgatttttctgtaggacagactttgttttgttttataccctcccgttgtactgaagtcagtcaactgcgtttcctaaggatgaactaagatgttttgacacagggcagttgaatcagtgtaacagtaagtaaggtgtgagcgttgtgtgaaagttctgggtacattgagcttgaaatcctcaaatcatccatcctggagtccttcatctcttcagtgtgaaatgaaatgaaaatctctagcctccaatgttgtacaggtttccggaggagcccggttcaccatgcaggtatgctgaaatcctcacgggtacagtgatgaagagtgggtaggcgtccacagaattctctgatggtcgagggtgtgcatcctcattggacctatctttataatgggaaaattaagcaggggttgtgctcgtcagagagactaatacttgtggaatgctactaagacaatcctgagttttctagcactaagagctgtgaagtgactcctgtctcggccaaggaggaacacatgctattagggtggtaggaactaatccacctcattttccatttccctgtcagaatattttagatctcctttcccagtcttgcatttagtgaaggaaagtcagtcgtgctgtgtttgaatgggctttcttcatgtcgagaaggaatatcacagtgttcacgttgtcttttacaggcagaaactttgtcaggactattctcttcagtttacaaatttgaataggaagttaacttcggatgcatacaaactcaagaaacatgccgaaacactctctgtgagtatcaggcttagatttaaaggagtccatttcctcagcatcagaggtagcaacacaggcttcctgcagcaggtctggagggaagggacaggacatgagctctgggagacaaggagggtggttgatgtggaggggagagactggccatcctccctgacttggttttttatcccccttctgtgggaagatgacaagggtaatgatgggttaggagcccgcatggtacaggtgtggggggatgagcaggttctgtctgcagagtgcaggagaaggtactggattgtatcctgagaggggacccttcaggatcgacaagtgcagatg

SEQ ID NO: 35846 - DNA, 1175 bp, Mus musculus
ctgtgcctctttctttccatgcctggtctatatggcctttacctgcccatctgtccatattctgagataagtgccttaggtggtgttctcttctcataatgatagtgagctcaaatgtggaactgcatcttttggtggagagttcatatagatgcacaagaagtagccactgttacttactttgattccaaacaaggatcctttgggatacgcaaagtccgtagtttaagttaaatgaggtgaggtgtcaagttggggcttggggcttcctgctcaagtaccttcttttgttgtggtttgttccagaaagccaacgacttgagtaaacgtcaaaaaacctttattggtggtcagcagactattgtggagaaggaaatctccaaggtgcagaacagagtaatcatggaaaccgtaagtcgtgtgtctgtaacactacgccctgggctaccttcctattagcagagatgtaatgaagatcctctaaatctcctttttcttttcaaacagcaagatcaagacatatccatggttgaaacataccttcagtccctgatccatgaaagctctgaagaaaccatctgaagatcacacataggatacacagggaaggaagcgttagccatgctaagaagatgttggtagtagtcagtgcagcatctttctctttactttgtttgttacaattgagactgagacactgttaatcattaagtgaactcccagcagctctgtgagtagcgaggacagttaagtgtggatcatccaggcccatgacagcaagggagattcattctgcccagtagtggcaattacattttggaagcaaatgtcatttgactttgtggttgattctctgtcactgttccaaagtgaatgttaccatacttattttaggaagaagtgaataaagatgggacccatttttctgtgcatgctttcatttctcatgaggtcacagagaccgttccattgcaatgggaaaatcaacccaacatgccaccgagacttgctgaacacactcatgtttgtgtgctcagaagtgttaaaaaaaaatcttcttaacacgattcccacgacagagccattcctaatgtgttgactctgtgctagttgtggggctgtggcatttcccaaagacacccagactcattttcaaagctgtcttcaacactggt

SEQ ID NO: 35847 - DNA, 2774 bp, Mus musculus
ctattttggattcactggctgagcagcagctccatctaagaaacatctcagacacagaagattgacctgactggtaatgttatgtaaccttcattctcctcccaacaagtgactctggaatgagagaactttgtggtttctgctttgggcaactagattgagaaatttgcccatgtgttctggcatcacttcctaccgtcacatctaagaggggtgacatataggcctggagaaaaatggagctatgttcttccagtagcctgcacaccatgccacaaaagctggttgcaccaggtctggtctatgacttggagtagccatgcccaagagggcaataaaacaagatcagaggacaggaagccacctgacattcatgtggcacagaaattgaaactgatcacactgcagttgggccattgcttcaagcaagccccctcaggagaagaagcagcaggtgaagaaggtggccacatcagggctgtggcctgagtttccagttgtgccctgacagatgttgtagggccagaaaatgtgccattattgtcccctagttagggaggttgggctctctatggggcatagcctgaaagggctttcagccccatcctgggaagcaagatctaactgacagtgacctctgatcttggttagaagggcctctcgaaagccccaggccaccacagtggccctgtagaccttctctatgctggagagaagccaacaacagttgctacatagcaacttctgttgctctgtgggctcagttctggtggtttcttgtaaaccagtctgaacccacttctttctctaattacttttctcattgtgagctgttaggacatgctttttacagctattattgggtaaggaatgttaacatcaacaagggagcaaatatggcacctttaccttgaaagaatgccatttcttgctcagtcactcatcaattgtcaaggttgacaaaagatattattgaagtctagaataacactaacttggaaggtagcagtgtgagatgccacagatagggcgtggcatctcttcccatcccttcctaccctcttttactcttttctagtttgggttctgtaattttttttctctttaacaaaacctttttcagagttaacactaaaaatcggtgtcttttccatgactgttgtcagatcagcttttaaatggtgttggcagtgaaatccccactctctccaaatgcagtccgtgttgtggctttaacatgtggcccatagttgcatcctttgccttgggtaatgtgggggtggatttccttggatcctctaggtgtacttctatgtccaatgcaaacgtgagcaagcttcttgcagtgtgtgcttgtctatgcattcgtgtatctacctcattgcacttttctttctaaccacatgtattcttgcaagggatggagagcagctggattacctaatattctggctgtctatagagatctatccctttaccatattaagaaagaaatactctgtggcttttattagttttttaatacttgctgaagtttttaaaaagcaaatgtttaccattttgctgcttattatgattaactgtatcaatcggttgtatcatatccactcttggatttacagaacaatccccaccagatcaccagaaagatgggtgggcatttttctcccatgatattgcattctgtgtgcttgattttgtgcttgaagtggcatgacacctgccctgcctgcagtcctaggctgtggccctgttgtatgccacgtgacttgccacctcacttctggaccacactaattaagccaaccccagacacctgacccaaaggcagcaacaagcagtcagacctgattgaagaagatggacttggccttttagggctatgaaaagcaaaagaggaaactgatgtatctagttggtattggaggcatggagggacgcacaaggtatttcaaggagttgctcctggaagtagaaccaaagagatcttgctggcctgcccagagctgcttgggtcctaccatagcaggcctggctgtatgttcttggattgctggcagctgtcttcatcagtctatgtgtgtccccagcatagacgcctcccctcccctgcaatgccgttagccaacttgaatgaaccttgtgcttttttttttttaatttgtcaagagccaattgcatttgacagttgggctgcttcccgagaagattctcattgctggcttttctcacattctacccatccagaattcctggcctaaatccagttgattgacatgaacacctatttaaatgtggtactgtactctgttcactaagatgggtataaatctatgccttttaatttctgggtttaacccatgatctgtatgagtgtagttccttttctgaacagcatttgactcataacacgagctcattatagcccattttattctatttttggaagtgttttactattttcagcaaacccgctagattaggggattggtgacacctctattcctagtgtacttacattctgtagttcacattacgttgatttgagtactttcaaaaatagaagtggtatatttgaacatgatcctcagtgctacttgcgtatctctgagaatagtagttgtgtcctgcccagtttgtattcagttttagaggcattcttgttcttccctagtctgattctcttgttgttttatggcactcactataatcagccttgcactagagttgtttgtggacttggcttctcctccccttttttcagccttccccaa

SEQ ID NO: 35848 - DNA, 1147 bp, Mus musculus
gcaagttcaccagaagttaaggtgggagagcctttaaagagcctttcaaaggggggaagttttatggcacaagagactggttgagactgtacttcctctgtggccagtgggaatcttgttaggctgtttgactcttgaaaaactatgacaaactatgttggttggcttttggggcctcaaaggagtgtgaggaagtagaaaatgatatctgcctcctttgtggctgtattcttagttacataaacaagatgaaggtactcttaagattattcttctggtaacgccccacccccaaggcaccatcacctactgtcacctgaaagggagatgtgacacagaccctgaaatctctttctcttataagtcaacaacaggacctgttctcactctgatggaggggcaagtgggttggagagatacaaagtagatggcactaagcaatgttcactttcatgaagaccttaccccacaggcttttccttttgagttccaagaaaagaaggtggcttacttggtcacacagtgagcatagcagttgttgagcacttaaattgattcagagcctctgcatgacttgtttataccaaaaactgctcctgtatagatttatgaaattaattaaagccccgaagatgtctttttctgtgaccatgtttgcttagtaatggcaccatctgtttgtctggctctgttggtaaattcatatatcaaactacaagagactctgccttttatggacacagatttctgattttgtgtcaaacctatttcatggtgcagaatccctgggcaactagcaatgtgcgtgcggttttcattgtgatttcatctcccatgtcagatgagtagtctgctgttgccatggtgaattggtattatactgtgaccttgattctgaacagaaatgtacgtcgccttgaccatgattacacaaaattcgttgtctaggaaacagtgcagttccgggaacaggaagagccagataattcttagctataactggaagccacacagggttaccttgtactcagcagtgtctcagttttcctcagggggcctctgggcttcatgtttccatgtgtgacacaaattgagagaaaggggcaggagcagtggtaggaagagaaaagtgaaggcaagaatagga

SEQ ID NO: 35849 - DNA, 1501 bp, Mus musculus
gctcagaaggtccatccaggggctccctcctacctcagacatccaagtcctagaggcaggcaaggtaagcccagggcctgtgatttactgtaaaagtagagtagggcccacaaaagattttgctcgaccttaaaccaacccagtccctcaacttcccaaggagtcctggccaccaccaccaccaccaccttccattctagttacctaggtatccatgtgccctttaccatgacagtgttacctccagatctagtcctaaactgttacgacttagtttgcctaaagtagattgctgagggtccattttcagagttaagggtgtggcctagaatctagctggatgatgcagaaaagaggccatcccaacatttccaggtaccttgttctcctaacacaggcagcccaccctcatttacagtctacaaagactgctctcttccatgggatggtcactctgatctgcctcatagcaaagtgacctagcatagccagagcattcatctccacacacctcatccattggttttgtatcaagcaataagataaattaacctggaccagtagaggttctggctgcccactcaaccattgcacatgcatgagcacaggcatgtgcaggaagctgaagtgctagtcaagcctttcttgctcatataagctacttgtctgctttctcaggatgaacataggtaggccactggctaattgttatctagatgtatgcattatttgagcaggttgttttcagagacatccccaaatccagcaacaggagccagtgggaagaacagaagacaagggactggttggtgttcactttgtgactgtcagatgattaatcttcatgggcaaaatgacatggacctgggaggggattgaccactgtttcgatgttccatttatgttattcatgactcctattctacttggtggggtattctgtgttatgatttctaatgacctgtaactggcctttgtcaataataggacagggccatctcacagtatgtgacctcttgaggtgatcctccaaagtaaaggagtattgccagaagccattgtcttgataagatgaatgtcttggatcttgacaaagggaaaaaattacaaggtgcccccaagttatttgcaggaggagtgcagtcttggaactgcagcttctagtggctatggtgtgttcctgactagtgttttgcctttttcaatggtttcattaaatgtttttgtttaataaaatttttggatgttccaactgtgtctcaccacttccttgggcagttggggatggagagaacttttatttcaaaggtgatttgttgttcagtttcactggtctaatttgggcttttgaaaatgttttgccagcctgactgaatggcctatgactaatcccagtacttgttaaatgtgcagttgtgatctgtttagggagttgcatgtttatctgggctatagctacatagtaagactctattgttttgtgtgtgtgtgtgtgtgtgcg

SEQ ID NO: 35850 - DNA, 1195 bp, Mus musculus
ctatgggttgggtaggagctgcaggtgaggtgggagctgcaggagagggaggagttttagaggcaggtgaagaggggtctgcaggggatgaggagtctgggagtgacgaggggtctgcaggggatgaaggatctgtggacggtggagggtctgtgggtgaagcaggagctataggtgaggatgaggcaggagctgcaggtgaagcaggaatgtcagatgaggagggagctgcaggggacatgggagttgcagggatcataggagctgtaggattggcaggagctgtaggtgaggcaggaggttcgggtgaggaaggggcctttgatgtggcaggaggggcacatggggctggagcctggacccagcagtggagccaagccctgcagcccatcctggaaaacatggcctaccaggagctgagacacttctctgggatggaagagcctggctgtgggggtcagtctttcgagagctggctggactatgccaatgatatgctatacctgtggcgccacatatctgagagggagaggaggcggcgtctggtggagagcttggagggccctgccctggatctcctgtgtgagcttctggaacagcatccagacacctctgctcaggactgcctggctgcactggtgcaggtatttggcaacaaggatacagcaatgacagcgcggctcaagttcctgacttgctcccagcagcctcaggagacgctgtttgcctatgtgatgcgcctggaaggtctgttgcagatggccatggagaagggggccatccagcctgcaatggtggatcaggcgagggcccagcaggtgctgatgtgggcccggcccaaccagatgctgcagagcaacctgagaaggatgaggctggagaggcggccacctggatttttgggactgctcaggctcgttagggagactgaggcatgggaggcagctctggctggaaatgcggaggttcaggagggggaaggggtggaagtacatggtgggcagctggatgtggtccaggctgcccttgtcagtgttggggttgctgagcctgcccctgctgttagagaggccttcctagccagtgaagatgctggccaggctgctgctgctgctgctcagcaagctgctggcgctgctcctgatggtgatggtgccacaaaggcagaccctgattctggggaggccaaggcctt

SEQ ID NO: 35851 - DNA, 2105 bp, Mus musculus
aaatgaggttgggaagaggggtgggaaccgatggagtcctgagataagtctagagctggctgtaatgagaacgcccaaaaccatgcattatatgtatgggtacaagacgaaatctgtcaggtcccatttttttttgacagaaatctttacgttttgttgactcatctgaacaacacagaaagtgtattccatcatagctcttagagaaactgtctagcaaagtatgctaggcagtgatggcattaccagggcagcttggagctaacctcagctccttgccctacactctactcaccaacacatactgatctccatgagaccattaaaggttcagatgtttcccaagtgccatcagtagcaagttcaggaggcagaggagaggggaggtggagtggggggctggggtgctcaccctggttgcctgccccgttttaggccctggtcttggtaaacaataagatctccaagatccatgagaaggcctttagccctctgcggaagctgcaaaaactctacatctccaagaaccacctggtggagattcctcccaacctgcccagctccctggtagaactacgaatccatgacaaccgtatccgcaaagtgcccaagggcgtgttcagcgggctccggaacatgaactgcattggtgagactagtctgtaccttagcatcaggcataaaggagacaggtagaggatatctctttcagccagggcagctgggtccatgtagtcatggaaaagccctgtgtgcctcagaatgttccagatgtttgttttgggacatgaagaaaaagactgtggtggctataaaggctcggttgaagaaagagtctcaaatatagtctaaaaaagaccagtatgtttctggaaaaaaaaaaaaacaatatgggtaaaaggaaggtataggacaccgactggactgagagagaaagggagaagggcagtggaccaccacagcagcaaacgttggatggctttctgggtccccacagtttcctcttgcttcccaactcccaaagaccaagaatagtggcagaggccttgagctagtcatgcagaacagctggaatttgtagttagcggtgcaaattcacaacctgctttctatggaagtgggaagagcaagcaatcagcagagctgcagtccagaaaagaacaggctttggtggagattggcttcagggctcacaggacttctctcctagagatgggcgggaatcccctggagaacagtggctttgaaccaggagcctttgatggcctgaagctcaattacctgcgcatctcagaggccaagctcactggcatccccaaaggtaggagagtgtcaatacccaacctccaaaagcattgatgggccttgcacagtgtacttgagcagagaatgggccttttatctgccccagaccctgcacttacctcccagcatgttctcttctgggtagatctccctgagaccctgaacgaacttcacctggaccacaacaaaatccaggctattgagttggaggacctacttcgatactccaagctgtacaggtggggttgaggcagcccttgggggatgcagggatccattagcaaatggggcaggttatagggtggcacccaggtccctgtgctctatcccagagtcctcctctcccccagcctctgacgacctctaattcatttaccttcaggttgggcttaggtcacaatcagattcggatgattgagaatgggagcctgagttttctgcctaccctgagggaacttcacttggacaacaacaagctgtcccgggtgcctgctggcctcccagatctcaagctcctccaggtgagagctggttctccaagactagatggggagttgtagaaggtccattctctgcaccagcctcttaactgcctggatctcctgtctccctttataaaggggcacagggtagagagcagaataagacctagattcacttttgggtctcatgtactcatccaggcctcagtggaacagtgtctgcttcgtgtttgtggttggaaaaggggagtctccttccctgacttagcttccaaacacatgagcaaactaggtctttcccaaccttactctggacct

SEQ ID NO: 35852 - DNA, 1473 bp, Mus musculus
cagcctcttcaacaaccctgtgccctactgggaagtgcagcctgccaccttccgctgcgttactgaccgcctggccatccaatttggaaattataagaagtagaggcagtggttgccaccatggtggccttggtgagagtctctgaggaacatagccagatgaagaagcaacacctttgttccccaatattaactcactgccccaccacagcttccccctgactcctaagcatgcatatatgcacatggcctggccctctcacccattcccctcaacctttgaaatttaacattcatcaaccatgtccactcagagactccctataaatctttcttcttgctcatcctgaaactcagatgtttttggcaagaggggctaggaaagatggatagagcacactgccaccgccattgttccatccaggcatgtgttcctcctcttccttgctcatgtctgacttccagctctcctgggctctgcttgctgcccttatcctctggtgttctctcttcaacaagttcactacctgtcaatcccagctacaacctggctgtactaactcctggatctttccctctctccaaccctgttatgcttcctgacacttttcttccttctggagttattgacctgtccccttccatctctggacctaggtcatatttctccatctttgtctctttctgtatctccttgcctatatctctgtctgtctctatttctgtctctctgtctctgtgtatctctctatctttgtatctgtctctctctgacaacacacacacacacacacacacacacacacacacacacacacacacacacggatcatctgccccaggctgctttctgcttcacaggtctctagccagtccctccacaaacaaatatggggcaactatcttcctgattgccctacccagaacttgaccccccaaccctggaggaagctggaaggtggaggcccagaatcctgtccattttgtccaggaaagggttcatactctgctatcaagacgaggatcaaggagcttcctagcccctggagaggctcagcaggccatcagagccgccagaaccagtttgcattggcccctgctctctccccaagatggctaggtcccctccctcacccctgggtccctgatgtggtaggaggtgatggtcagttgcacccagcaagagggagtgctgcttatgaggtcagttgtctctcaattaaagaaacactgtgcaatacgagtctgtgtgccagttctttgaaacatcactgggcatcaagagaaaagcagaggtgaaacaagggcctcctcaggccacctcaaaggctctgcctttccatccccagtttacatcattgtgcttcctcttcactgttgcccttgcccgtagaagaaggcccctctcaccctcaggtccagaactataaaagcacatcccaaatgaccagacataaggcctaggccctatct

SEQ ID NO: 35853 - DNA, 1656 bp, Mus musculus
cctgggggggaagcgctccggggggcggggcagtgggggaccagagtccaccgtctcagacccaccttccttctttactacccctaccagtgatggggtctttgagctggaccccacataaagccgcatggagctgataggctggtccctacttatgacccctagtataagcagggatgggatgcagccataagcagggagaggggaaaggggaaggggggagggaaagcgcaatacctcatgtggggatggtggagcaaggcaggaacagagtagaaacctgccccacccactcaaggccagccccagattctatttcacgtgcctactggtgggcccgggcttcgggcctgaccctcaccgctctagagcggggccatgctccagaacctgcctcgtctgtgactgttactttcttttttcagggtgggagtggggcttcctatccaagagaccattccagattgctgcctgggccctggcccttcttgctgtttcattttcaggaagagtgtatcattctttgccacaggaacctgctcttggctccatacctgtccccgaatgcccacctgtgggagcagacctggccactttgactcgtgtagactccttcctgcttctctcactagggcttagacttcttggaactgtagggtgtgaacccagagacacaatggctgctctccgcatccacagggacagcctctctgggtggctttttgctgggcagtgtcacatgggagggcatgggcctgggagccaatgggcgagatcccagccacacatctggtgccctgactgtttctttcctcctcccccagatgtcttgacaggatcactgagactctttgtgactgagggtggtcaaactgccaccggaggagatagggtctcagagctagagctgagggggagggagggaaagatgaaggcctcaattttgctactgtgagtctcacacagccactgttggtttggggggcagggaaggggccaagctgcagacacacatggtcattcattgcagtccacaccccgttgtagactctgtgtgtgtgtgtgtgtgtgtgtgtgtgtgtacacactagcccactcacatactcagcctggagctggcaatacctgtggcagcaggaccatcttgtctttgtttttgtaatccacatcataatcacattctttcattgttactcctgaataaacagtttatttaaggtactgaacagagaggttgttgcttcttggactcctttgggaagggagggaaaggaaagggaagcctgcccttcaccgattcatcgttccccatcgatgtacactgcctattggctaccaggtctctcacaacccatttgaactcctaacacacacttcaggaagctgggcacaacagtgagccagacatgaagaaactgcctgtttgcagctgcatttccagaggggaatgtgatacaaagtgtggccagtaccacagagtggggaatcaaatactccaaattcagtcgtgaagttgtaagtgacgcccaagctgtgagtcaaagttggtggcctgcatattttgctgagggtgcctaggacttgagggaatggacatgggctatgcatatcatacaatgtggaatcaaggctacaaaagcctgggcaaaggtagga

SEQ ID NO: 35854 - DNA, 1205 bp, Mus musculus
acttggggctgggccggggccgcgggcctcaggccccttgctccggccgccgcttgcagacagtgggcttccgatgccacccgcgacgcgctagggtgagcctccggcagggcgagcagtcctcgctgcagccgccaccgccgcccgagccgcgggcaggagtctcgggagccgccgccgcccggccaggctccaccgccgcccgcgcgctcccgggcccccgacacacatgagattcttcaggctcactttcaagtgcttcgtggactgcttctgactgcgccgcccccgccgtcccgcacccctcccgcccacccgtcgccccgtcccccggcccggccgcccccgaggcccccgggcgggcccgcgctttcggggccctctctccaggtgccaccggagccccctcgcccgcccgccaccctcgaggcgccgcgacccccggcccggcctcacggccccgctggggccatggcgaaaaagagcgctgaaaacggtatctatagcgtgtctggtgacgagaagaagggtcctctcatcgtgtccgggcccgacggtgccccagccaagggcgatggccctgcgggcctgggggcgcctggcggccgccttgcagtgccaccgcgagagacttggacacgccagatggacttcatcatgtcgtgcgtgggcttcgccgtgggcctcggtaacgtgtggcgcttcccctacctgtgctacaagaacggcggaggtgagtgccttgcccctgagcatcctggcttttcatcagggaccaattccaaccccagcctgccacaggcccaccagagcagtggggcaaagtccagagggtagggaggcccgcccaaagcgggtggaggccatggtgccccctcaccaaccaagcgttctgtgacccagcacagcggcctccacccccctcaccggtcatgtgcctggcagtgtggaagagaggcaatcaagggtagcttccagatgaactgaggggctgcctctcagacttccagtccaaactgggagtgattggccactgaggtgggaagggaagccctgccccccaatggagggggctctaggaggtgaggagccctagttgccctcatgggtcaggcacacaagtgacacattgtgtggacccccccacgtgtacacataggaatacgtacacacacacaatgggccactctgtccctcccccacac

SEQ ID NO: 35855 - DNA, 2031 bp, Mus musculus
gcatgtgacccatgggaagttcaacatgccctcctctcccacagcgatggcagcacctgacccagcctatctggggcctccatcacttggaatacagagctcaggatgcagatgtcaggggcctgaccaccctgactcccgtgtccgagagcagcaaggtcgtcgtggtggagagtgtcatgtaacaggcacccccagctcacatcaccagctcatcctttggtagccatagcagccccaactttagcccccactcatccctccgggggcttgcctttccttgacagtttgggggtctgcctgggggaggggagggagcaccatgagtgctaacaaaaataactttttccatttttaataaaacgccaaaaatatcacaacccaccaaaaatagatgcctctcctccccaccccacaactaagctggtatttgcattgcttccaggccctacctcctctccttctttccagtgcccaggacccatctcctagccttgccaagcccacctgcctgcctcccaagctctgctctgtaacatacctttgccctagaaacaacagtggcagcttgggtaacaggagaggagggaaaataaggtaggacaggaggagaagagagggacagtggaaccaatgtgaatattgcagctgaattagacccttcctacccctattctagaagctagagagccagtcagcaatggaactttgtgttcctgcgccaattgccaccaatattaactgtgtgagcttgggtctgagtgcacacccccctctgtgtgtgtgtgtgtgtgtgtgtgtgtatgtgtgtgtatgtgtaggtctgtagatctcttatcccttagtgaaggtgaataccagaagtaaacacagcctctgggcaaaggaggcttatattttgcacattttataagaaaaacttgagagtgagacttctgcttgtatatttctaaaaagcccccaccatctccacatttccactcctttccttcacatcctcacctttcttctctgaccctagccaaggagtgtgaatttatagacttaattttcataggcaaaacaaaagcttcaggctgttgagtatatatatgagtctgttgtatggatgttctgtatggtctccagccagagactggagtgggaaagtgggagcctcaatggtgtccccacactgctcctttgcctctaagtctgtgggacggaaggctgtaacactgttccagggaatctgggtctgctcacctgacatgctcagacttgcccacacccagctccctgggcaggattgcagggatttcccatggacaaagcccgggaaagggatcctgggcatggctcccacctccaagctaaaaggctgatgtactttcgacatctcaagtcttccgtgtagcagcttaaacccacatctgtgtcccatcaagcctgaaacagccaagtagcccttagaaaggcttccttcacacagagctggactaagccagagaggtggggctgggtaagggtgcaagcctttggggacattcttactgtgctaaaaaagccactgcaaacatagcaataaaaacacttcattttccaaaattggctcctgtttctgcttctctggaagaggaattaggtggggatgcaggtgtgggaaccttcctccagctccagccttgcattcactaaagcccattctgagggattctgtacctagtaccatgtcagaaactggaaatagagcaggaaaggaagcctcaaccctctagactgaagagcatggggtgacagtaagttcaataggaacaaatgcagcagagcgaggctgtagctatgagttgttccaagattttttctaaaccaaccaccatggctcatgcctgtaagcccggaacttgagatgttgaggcaggtggatcaagagagagagagaagtatgtttgtgtgcaagtggccttccaagatctaaaagtaaatggcacactaggatcacagataacaagaggccagcatctggacctgtccagtgacactggagctggg

SEQ ID NO: 35856 - DNA, 1315 bp, Mus musculus
acgtgtccatacatgtataatagacgtcagaggataaccttgggttatcactcctcaagagctatccattttattttataaaaccaggtatctcatttgcctagagcttacaatgtagacttgttacctagctataggaatctaactgatctgcctctccagctctgagattacagaatgctctacatctgactttttatgtgttttgggattgaacccaagtcctcatacttttatggcagatgctatctcccaactcccaaggatttgggttttactggaaggtaattgtttaagggccctaagttgggacttaaagactagcctgctgtgtgttctggaggtggccttgctcccattgcagtaagagagagctgcaggggactcctccaactgccagtctttctagaccctgttcatttcatttgggggggtttctttccttttccaggcatcagtacgtggtccctcagtcaagaaggaggagtaaaggcttggtgtttccctgcctgccgctggcttctacctgacccatgcttactgcttccttggagcccagactatccctctggtacttgggtttattccctacttccccaattttcttccatggcttatagatcattattttggcaccattacacatactgctcttataccaaaagggacctgattgttgtttattcagagtacttttgccactgttctgcctggctagggcactttccactcctggaagtgtagaaaagcactggtgacctggcctgcagtttgaacccctttttattttgcaatgtaccctaaaggaggctgctgtgaagcaggtcaactgttttatcctgaggggaataaatgttgttatgttataaggtgtttgtgtctaactgaggctttgggaatggttctgctgctcctctttcaaagttaaagattgcccaggaaggctgcagatgctcagtgtggcacttttattaccttgagcttcttcttattctctgaagaccagactcacacttgctgtcaaagctcctgctctctgcctccgccctacctccccccttcaagtcaggacaacgctgctttatggctcttggggagtgtctgtcttgtcagtctccctgggagttggcaactgtctgggaagcctggtaaaccagcaggacttcctggtgccttctctgagttcctattcatcacattcaggacagatagaatgtggcagagtgccaccagtcactccctgcccaacctcctcctgaaggtttacagcatgacctctgactaatgctgactgggaaaggagactgtccttggc

SEQ ID NO: 35857 - DNA, 2016 bp, Mus musculus
gaggacacagcagaggaagagggtattaccattgatgtctccatatgctggttccagtggcagttgttttgttttgttttgtttttatgagaatgactctctaataacagagacctgtgttgaagaaggcccttattctttagaagttagttagcccctttatgaacatggggctgatggatcccttggtattagggaagaatcagagaccaatttgttggtctatcagaggatctgtagtataagcaagctgggaaggagagtgatggtttagagattggtggggtgcagttgaatataaacaaattttggagtcattggctgtagtgaagctacaagagtcagggaagagaaggaatgggtgtggttctttaggttatctgggctgagagctccaggtgacagcaagttgagttactggttagatgggtaaacatagagccattgaactttattggtgggaaagtaggtccagggactggggtaagcagagtgtaaatgaacttgcagcaggctttctggaccttcaccttcacttccttctgaataacccaggtgcttggcactttccctagggagctgccgaggatggagacaagttggatattgggaatactgaaatgaagttagaggagaacaagagcctgaagaatgacctgaggaagctaaaagatgagctggccagcaccaagaaaagtgaggatggctgtcctattacacccagaagctccactgtccattgatgcccccatggatcaagtattaatagcacacttcacgtgaaagctcaagagttgggtggaaacaaacacatagtactctgctccttcacacccaaatgagatcaaacaagttcactcctagagcatctttgagtaggccttggagaagccctaacaaatgttgtgtatgctttggtagtgcttactaggggtttcccattaagacaggcaggcaagggggaggcccaagatgccttggagccgagaacaaaaatgtgtaagaaagaatttgtgtgatccaacctctttcacttctagattaatttcagactcatttggcactgtaggtgttggccaatgtcactaggggtcttaatggtgggattttgctcattgcctctcactgccagccagttaaaaggttaccccttctgggaaccgttagtgtccttccatttaaaggactaagggggctaatgctgactttttattccatctagctgttgggttatccatccttacaactctccccgagtggtttgtaaaggcagaaacattgacaaacattggaaccttatctgtataacttcttttgcgacagatttacagaagtttcccatgttttaagcaggtagggtttttcttccctaaataatctttttgatctcttcctgtattcatttgtattgttgttagaacttgagaaagctgaaaacgaggctctggctatgcagaagcagtctgagggccttaccaaagaatatgaccgcctgctagaagaacatgccaaactgcaggtcagtgtttccctttctgtaggtgcaagttagggtcagggtcctacagcacagttctggggtactaaggagcctgttgcctcctttgttgttgtgtgtaggtttagagcagacccagctgtcagaacccttcatgtaggaggtgtggcatggtactagatggtgggctaaaacctgcaaagttcaagggcagcccttgtcagtagattgactctctgctctgagcctttcctaccttaaatccagtctcaagcccctaaagaggggttatttaacattctaaaacatcccagctgtggtgtcctatttcattaggatcatacatgggaaagctgagtgtggtggccacacccaaaacaccagtactttaggaagctgagactggaaagttgagaaaattctaggtcagcctaggctacatactaagaccctgcctcagaaaacaaaaacccctcaataatgtagagacctgcttttgtccacctctcctgtgggat

SEQ ID NO: 35858 - DNA, 1191 bp, Mus musculus
tgaaattaggtcatctggaaagtttcttttcattgtactagtctgggggagtagagatgacaagtatagggcccagcctaaaggtgtttatagcctgataggacagatgactgaatatcctgagaaagtgaatacaagagcctgtcgtgttttgggggctgctgtgggaacactacaggctacctccccaataggaaagactttccggagggaggtgatggttgaggcattactctcacacagtggctcaaccacaggagcaactggtcaaatttgtcagctctggagtggatgggaactctgtacagatgccagcgggaagaagcaccaggcactgaccatgggatggctagagagcatcctctctaaacttgacaaggcaggaagtgacttgtccttctgtaggaggacagagcctctaccacagaaacacacttgatagcaggttctgatggagtaagggaagacctatcttgatgggctatgtttggagtgtttgtgttacatcagaatctgatgtttagtaggttgttatgagtctggtggcaggtaatccctttagggaataaagctagctggaggaaaatacagactgcaaagtagacacctgaggaagagtttaccagatggaagacctcttaaaaccaacttgtcagtagcagcatatgttacagagtgcacatcatgtgaaaactcaagtgtttgaaggatgaagcagttagagggcaaaggcagggaaggaaagaagacggacttaagaggaaatggcaagaaaatgacccacaatcaaccctggatggattagaggcctagctccaacacaggtgatagaaagaactgtcagtgtatgtgttgggggtgcaattagagtgtttgccattggtggccagctagggtgccctgggacagaggtggggaaaatgtccatggcggttggccagaggaagaaaaatcagggctaggttggcaatgtgactgtcgtgttaatggctgcaaatcaaatgccagaactgtgagcagacactgttcagactttggtttttgtggatgctatctgtgagtattctggactatccaggaaaccctagttcacaatatctgaggaaggcttacaaaagcacggaacagagttgtcctgagactgttgttcctgatgggactgcctttctagttgtggcagtcatttaccag

SEQ ID NO: 35859 - DNA, 1127 bp, Mus musculus
caccaggtgctgtggaacagctatgccctatacccagcattgatgtggtgagactctgtccctgtagactctagcttccccactcctcaaggtccttgcctccactgtctgatactcccccatgtcaaactgcttgcttcagactcgcaatccctagtagtttggtctagacatttttaagtatttggctgactgggcaccaccactgcagagtgggatgtgggtttggagaatcctatctgccatccttctttgctacagattgaacccctgactggtcccccagaaggtggcttggccatcaccatcctgggttccaacctgggccaggcctttaatgatgtgcgaaatgctgtaactgtggctggccagccctgcaaccctgacccttctctctaccgcatctctgctcggtgaggctcctcagcaggctggggaggaaaggaatgctatccagagtaggccttcaaaaactagtcacctgccagtagtggtggtgcacaccggtaggatttgctgaaggaggcaaaggcaggaggatcacgagttcaagatcagcctgggctacacatttcaagccgggcgtggtggcatatacctttaatcccagcacttgggaggcagaggcaggtggatttctgagtttgaggccagcttggtctacagagtgagttccaggacagccaggattatacagggaaaccctgtctcgaaaaacaaaacaaaacaaaacaaaacacctagtcacccagaaagaggggaggcaaaaaccaaaaccaaacaaacaaacacaaaagccgggcagtggtggcacatgcctttaatcccagcactcaggaggcagaagcaggaggatttctgagtttgaggccagcctggtctacatacagagtgagttccaggacagccaggactacacagagaaaccctgtctcgaaaacaaaaccaaaaaaaaaaaaaaaaaaaaaaaaaaaagaaagaaaagaaaagccaaaccaaaccaaacagaaaaaaaaaaagaaaaagaaggaaagaggatgtgaggtcctgggtgagaacacaaaagggaaagaggcagcagaggaggaacaggctccaggcagcccctggcaggctgttctaggctc

SEQ ID NO: 35860 - DNA, 2546 bp, Mus musculus
atgccaacgtcatccactgtaagagcctgccaggagtggtgacccggcacaaggacatagacatcctcattgtacgggaaaacacagaaggcgagtacagcagcctggagcatgaggtaggcaaagctacttgaccctcttgggtaggtggcaatgattatggccagggtcagagttgaggagagaacttcagaatcaaggtaaggtactgccactcaaagggctggaaaagccagatatacttagtaataaggctgcatcctgtagtgctcccatcaagccttttgtcccctggcctcttctcagagcgtagcaggagtggtggagagcttgaagattatcaccaaagccaagtccctgcgcattgctgaatatgctttcaagctggcccaggagagtgggcgtaagaaagtgacggctgtgcacaaggccaacatcatgtatgtttactccatactctcctgtctactttgagctggaagggccacacacagggctatgtcctgttgttcctgaggttctttgtcttactacactgcatccataggggagggagatcgatgggattatgcttgtttttctatctggagaacaggtttcaaactagtccttagggttctatgagtctctgtatgccctgactctccagctgactgtagtgagaagttaagctggtgtcttatacccccatcgtctaggaaactgggtgatggactcttcctccagtgctgcagggaagtagcagcccactaccctcagatcacctttgacagcatgattgtagacaacacaacaatgcaggtaattagcccagctggctccatagccttctactcacccttggttctcatggcttctacaactcagctcacttctttcttttcccacagctggtatcccggcctcagcagtttgatgtcatggtgatgcctaatctctatggtaacattgtcaacaacgtctgtgcagggctagttggaggcccaggccttgtggctggggccaactatggccatgtgtatgcagtattcgagacagtgagtagccaggcacaactctgctgtctttctcttatagtggccttgtgtcagttggtatactacagtgttgtgcagccattggtactgcttaaaggctaaagttttctaaaggaaacccagacccacgagtatctccctgaagccctaatatgccttcatttgctgtgtctgggatgggcctctattggatatggtacatgagtagaatcatctaccctgcattcttatattttcccaactacttcctccttcttctctttaccaggctacaaggaacacaggcaaaagtattgccaataagaacattgctaacccgactgccacactgctagcaagctgcatgatgctagaccacctcaagtaagtgggttgctcatgtctgatcatgagtcctctgactagcccctaagcactgagaatcaaaagtttgttctcttcatccattaggctccactcctatgccacttccatccgcaaagctgtcttagcatccatggacaatgaaaatgtaaggctcttcttgtcccctccttgtcccacctttagtctcccctcatctaccccatgttatattggtctgaccaaccctatatgctttaggcagtgactaacactgtctgtgacctataaaggaagggtggtgtcacatagggtaaggtttctgggactaatctagaactattggcctcctggtgctagttctttgcctttccaactataggaaaccatgggtagccctaggacaccatggggttatggtagatgttggcctgatgtgtccaagcttcttgttttcctacagatgcataccccagatattggaggccagggcaccacatcccaagccatccaggacatcattcgtcatatccgcatcattaatggacgggctgtggaggcttagctatccctacagttttgctcagcttgtctgtaggactctcttctcactttagcactccagctagcttgggggacaggacccagaataaagccacttctgttccagaacttggccctgttcttcccttactccaagacactggcatttcagttcccactttattaagaaacaaacaggcagttttccccattcaggagcatctagaaggatcacaagtagacaggttgagatatgggccttgccccagcatctcatcctgtcatgggggtgagcacccagcaggatggaagagcagctcccacagggtggaagaagttgcctgctttccctcaaggcaccaagagctagcatagtctctactgtccacagctgcagcaaaacctatggattaagccagggatgctggaggcagtcggcagcactggcccgcttctcagggatgtactccatcatgggcaacaggaaggcactgaactgtgtggcctgctccaggggccactcatacttctccatgagcacctcatataggccccagtgcttgaggttggggatgtggcgcagctctcctagagggtgagcaacattaggcactgtccccagat

SEQ ID NO: 35861 - DNA, 1187 bp, Mus musculus
acgcgcacagtcacaccggttcttacgcccccttccggtgcctagagcactgttccgccatcttggggaggggaaggctgagaaggagggaagtgcgaccggttgggaccctggctagggaagcggacacgtcagtgccgccagcgacgtcaccatgcccgacccagcccgccgacgcacgattgggtgctgaggccgcttacgcgtcgcgcttcctcgtctgctccgcatgtccagggtggcttgctctcttttcccctcggaagagaagaggcgatggcggcgatggcatctttcggcgccctggcactactcctgctgtctggcctatcttgctgctcaggtagcggcctggccggagcttgtttcggggcgcgcccctgctgttggcaggtggtgctggggggaggaagggtgtgcgcgaggtggggatctggcccttcccggggctcgtcgctactgacgggatcttcccccgatgggtgttgtgtcgtggcgaccaaagcaccacacacacgtttacccgacagccaggttgcttccttgtctgcttttgggagaacccccaaagcagtaccatgctccgaccaccagctccagcagggaaggtgatatgtatgtccctggttcctgtgtcaaaaggtagtcgcacaagagcagtgctggcagctacgaaccaatgctgcataggccaggcttccccaagagaaacctaagagagggaggcagatcagagtaagggcactaggcgagttagatagggaaccgatgaagtgagcaagggcttttagtgcccagagcctcgactttttgtgacgccttggtatatcccaccccaaagttcatagcaaaattgaaccgtgcacagacccgttgatatttgtgagacatctgtaacgtggtagtggggctgagctcaatctggagtgccggcatgtgttttgaaagatgttagcacctcagacctgagagcctgaactaaggacgatttggtttctgtacatacaggtagcctctggccatcccttctacccacccctcagagaatccttcagtctgttgctagcagtgtcttaaaaagacaaacctggctgtaacatctattaggggttccatagtgtctacagggaaaggcccagctgagcaggtcacagaagggttggtggaatatggccttgagagccatt

SEQ ID NO: 35862 - DNA, 1184 bp, Mus musculus
cagggttagagaccaaagatttaagcactgctcatggtggtattgtgccagcactagcagagtaatcccccatgtatctgctatgcctgccccttaccaaacacccaaccaggtgtcctggagcctggagcacaagagcgctcatgcgggcacctatgaggtcagattctttgatgaagagtcctatagcctcctaaggaaggtgagtatcatctggaactcctctgaggccccaaggagggagggcatgccccatttctgaagtcctctttaccctggtcattctgtattccccttctgcaacatcagtactctaggggccaggacaagtggttgtcttcctgcacttctgcccctgcttccttctttgtctcttgctcatttctcccttttcttggcaacctacccagcacttcttgaccccagcacctcccttacaggctcagagaaataatgaggacgtttctatcattccacccctgttcacagtcagtgtggaccatcgggtaagtgcccttgtcttggaagcagagaatacagggcatacctcatcttttggggttgtctaaggaaaagctctgatcctctgcagcccaggttctgggctgctgttgatctgtgtgtcctgagaacaagtgattaagggtgactgctccactccctggcactcccctgagctgtcttttggtcttcttctttttttttcttctctctctctctctcttttttttacagggtacctggaatgggccttgggtctccacagaggtgctggctgcagtaattggcatagtgatctactacctagctttcagtgcaaagagccacatccaggcctgagggcagcaacttcagccgtccattgcttctttcaataaacagtcactatttgacatgagtacattcaagacacggggctcctgtgtctatggggaaagctggggatccagctgcccttgtctgcctggacagcagatagtaattctgagcagagctatattttccccaatgtcctctgttttctctgtccttgtcctgtttgtcaggatatcttgggcctgtcttctcttttcttgtgtgtggcctctaaaataagaccatcttggctgggcagtggtggtgcaagcctaaatcccagtactcaggaggtggaggcaggtaaatcactgagtttaaggccagct

SEQ ID NO: 35863 - DNA, 2568 bp, Mus musculus
gaagatgcagcagttgcgggagcgctgtatgaaggcctggctgctggaggaggaaagtctctatgacctggcagccagtgagcccaaaaagcatgagctgtctgatatctctgaactgccagagaaatcagacaaagatagcaccagcgcttacaacacgggggagagctgccgcagcactccacttcttgtggagcctctgcctgagagcccgctgaagcgatctggtgctggcaattccaacttgaatcggaccccttctggccctcctgtcaccacccacctcaagggggctccttcaccagggagcccagctaagttccgatcactctctcgggatcctgaagtgggccggagacagcacacagaagagcgtgtccgccggagcaccaagacaagtgttactctggagcgtgtgggccctgaaggcagcccttacctctccaggcgccatcgtggccaggagattgagcagtaccacagctgtgtgcagttggccccgccacgcaccctggaggatctgggccatggctccttgagcttggctagtggtcctcgggtgggtggggtggcagctgcagctgtcgaagcaccccgcatggagtggaaggtgaaggtgcgaagtgatggaacccgctatgtggccaagcgacctgtgcgagatcggctgctgaaggccagggccctgaagatccgagaggaacgcagtggtatgaccactgatgatgatgcagtgagtgagatgaagatgggccgctactggagcaaggaagagaggaagcaacacctgatccgagcacgggagcaacggaagcggcgtgagttcatgatgcagagccgtctggagtgtctaagggagcagcagaatggtgacagcaaacctgagctcaacatcattgcgctgagccaccgtaaaaccatgaagaagcgaaacaagaagattctggacaactggatcaccatccaggagatgttggctcatggtgcccgctcagctgatggaaaaaggatctacaaccctctgctctctgtcaccactgtctgagctgctccagcaggagcccagcccaggtctagaaagcctgaccctcaccctcccttagaatctagtgtgtgtcgatgtgtgtgcttgcacgatgtgctcatgcacactccttacctgtatgttatgtgtgcacaggaccttggtaatagaaagccccaagaagggacacttctcttacgcctagttccttttccccaagaagctatgctaacaaccaacatagaggcatacccataaagggcacctctttgtgtatacacatggtattcttgctattttcttggagacagggaaatcagtgcagagaggtgaggtggactatcctaagcacaagagaatgtccagcttcatgctgagcacgacctctcccctcctaggagctgcaattatttgtagacaaaggcaaccctgaattttgtggtttttcttcttttctgtgcttgccaatagttgttttctgttttgtgggcctgctctgggggctggcagctcctttaggcagcctgacaaaggtggaccccaccgagtgctggctggaaaggaggttggggggaggaaaagagggagggttgggtgggagggaaaggaaaaagatggggaagaataaaaagcagctgtcctggtggcctctaggggctctgccttggctttcaaggcttaaccatggaggcccacctctcttgccagtgactgaaggaaagtgagatcacagggatttggggcacagtatccatgcaaaagaatctgtctatgccatctggagcagagtcactcttctcagtggcttaagcaaggagggccaaacctaatgagtctagagaggatgtggtgggagttggaaggcctgggcccaatgaaaggaaggtgggctgactgagagatgcctagaaccttttccaggtgatggaactttaaaatgtttggtgcctgtcaggcttggtgaagctcattggatgctacaggatgcccctgctccccacctacatacaccccaagaataaagcaagctgcctttttgctgttaatgtggacttgtgttcattgccatcatgctatttgtgctgagaaatgtcagtatattagttcctgaatacccagatttctatagcagattggtggtgagcaagatgccaagatgggtgtgagtgggaaatctaagggcccattcctagaagctgagtctattgctggaaaggctgggtctgggtgggaatacacaggacagtcctgctggtgaatagggagagaatagaatagggagtggtgagaatgggaaagcaggggctagatactagttctagattctttttattgggggggggggtcaagatagggtttctctgtgtagccctggctgtcctggaactcactctgtagaccatgctggcctcaaactcaaaattcacctgcctctgcctcccaagtgctgggactaaaggcgtgcaccaccacgcccggctagttctagattcttttaggagcatttccaatagttttagctttggattctttgaaaaaacaca

SEQ ID NO: 35864 - DNA, 1214 bp, Mus musculus
cctctgcctctgcctcccaagtgctgggattaaaggcatgcaccaccactgcctggcctgaccccaattcttacctgtgggcaagttcctgtatggctgtgtgcctcaatttccccagctagtatgtatgagtgaaagcatttgtttatagtggataagctgatggaagcaccttgcatatatctccttcatggtcaacattgggtccctggcatagcagaggtagaagtaagtcattgttgctgcagcccgttcagttgatccttagacatagaacccctgtaacatccagtgacagaagactgtcttactttattctgagagtttctctagtgagaaagaaaagggaggggaaaaaataaaaacaacagaaaagggctccaaattttgaggacataatagcatgcagggtgagttaggagaggaacagggacaacagtagaggcatagtttgtctttttgcacagaaggaacaggctaagaagttgcagaactagatgccaaaatacttgcttctcataatgcattctgtctgatcttcactaatggttggaacaaataacatcctggttatggctagctgtggaccttgccatcgatttgccaggctggcaggaggtggtgggagatttggctctctgccgctaatatttattgtgcacaagaaaactgaacaaacacccaaagagaatggtttcaggaagttgtctattgaccttataggacattccttcttcctgtctgcttctcaggcaggactacaaggttgtggaggggcagctggcctctgaaaagtcagggagtgggagaatctcagtcaactatgagccagcattacccacactgctgctttggagaagaaagaaggtgctggagcctggtctagtttctaaaggagtttttgtggaggagtcttgtttgtctctgtttctcagggcttgaccccctcctccccaggtttatcccctccgaggccccaggcaagactccacccccaccagaggaagacccttgttcaaatgtaaatccagattaagggatgtaggggtgagtggtggtgggactggctgtttctggagtcttcatttccttctcaaaaactgggagtgaagttgttttcctgatgctgtgagatgggaatttggagaagatcagtgaaagcctcaagttttgtcagtatcagaaggaagtgttaagacctcaccacagaccta

SEQ ID NO: 35865 - DNA, 1221 bp, Mus musculus
cctctttccctcacttcctaagctgtcaagttgtgacatggcctctgttgactctagagggggctatgggatgctttctagggaagaagcctggaggtgggtggaacaggagagagagtaggaagatatttttctagggagagggactactagggtcaggggcagcctgctcagatttaggactaaactgggctagggggaaagggtctctgaccaagcctcctggggaggtactgctctgtcttggaggctccccaacagcacatttgagggcaataggacctttgtcattttacagatgaggaaagcaggcttagggcagagctaggattgaactacatttctacccagtcctatttcttgccttggccctaccacttctcactgtgtcccttcccccagccagcctcagggcctggctcctcttgtctcctgtctggagacttaggccctgtctctttccacccgcttccctctgggctcctggcggcagctgaggcggcacctggagctgaaggaaaagggcaagcacatggttctggcggccttggagaacaaagcggagaacaaaggcaacgtgcttctgagctcaggagaggcctgtcgtgaggagaagggcctggctgctgaggatagtggtggggacagcaaggacctcagtgaggtcagcgagaccacagagagcacagatgtcaaagacagctcagaggcctctgactctgcctcctagaacctgccccacctggtcccaaccttgccccatgtgcttttacaataaatgtcacccagtggccttgggaaatttgtgaatgtgcatagtggggtatgcttttttttttccagttcctatgtgtcagggatactatcttcacagcctagactgtattgagctcacaagtcaaaacagatttgaggatgggaccccaaatctgactatcttcaacaactgagttgaagttggcaggtaaactgttttgggtgctatattctttttttgttttttgtttttttctggtttttcgagacagggtttctctgtgtagccttggctgtcctggaactcactttgtagaccaggctggcctcgaactcagaaatccgtctgcctctgcctcccgagtgctgggattaaaggtgtgcgccactacgcccggctgggtgctatattctgatgtcacgtgtctggcctataggcctcattaatgtcctttttgtcctaat

SEQ ID NO: 35866 - DNA, 1220 bp, Mus musculus
caggggcaccctaacttcacaatctgttgagatcaccagcctcagctgccaggcccagattcagtctcctacctactccctcctcataaggccagacttcctcacccagttcccaccagggggatctagagcttgactgctcagtccaggcctagaagagcagaaggcggggtttgaaaccccgcccttcgtcccgcccccaactcggggcccttcggaactctgaagaggatcaggtgggtgggacactgctcggtcagctgagtgatagtcacgggatcgcgaccaagtctgaattcctggaggaaagcagatgatggacctaggactcctaatgttacaggtatgtggtagtggatggttccaactaatggtggggtcagaagcccattgaagaggtgggagtactgtatccttggctcgaggccctgtggtggtggggtggaatcaagtagctctggggcctactcgagttggttcaggaagtccctgtgaaggaagagctgtgcttccctgctctgccctgattcacttcacaggacatggagaaggaacgggagacactgcaggtctggaagaagcgtgtggaacaagagcttgatcgtgtgatcgctttctggatggagcattcccatgaccaggaacacgggttagctatcctgccatgatcctcctagggcccccctccccctatctcacttggaggtgacacacagatctactgacctgaggagagtagtgaagctatggagaacggctctttccttcactttctgacaacacttgtctcacaggggcttcttcacatgtcttggccgtgatgggaaggtatatgatcacctcaaatatgtttggctgcaggggaggcaggtcagtttgcacacttaaggtgttcacacaacaatagggtatacccagggatacttaggattccctccaccccagctactcctctctaaactgtgttccctcacaggtatggatgtattgtcgcttataccgcagttttgagcgcttccgccgtgttgagcttctggatgcagcaagagcaggtcccctctcctagccctatctccccaggggcttcagtgggttatgtattcaatgtatctaaagggctctagaagaggaaagggactggcaggttccaagaggcagtatattcagagtccttacctaccatgcatactttccaaccaccaggtggtgaatttttgctg

SEQ ID NO: 35867 - DNA, 1194 bp, Mus musculus
atgccaacaagtggtgcccagatgtagggattatgggaaacgcagtttctcatgctgtagaggacacatcagggtatgaagggattaatatactgtttcagaatgtcagcaaaaggtttactacagcggcggcggctgggttctctcccactttgttcccacagggggttttctatttctttgtcttcttcatgttttccgtttcaaaaaagtttgggagactggctgaataataggaaaagttgtgaatggatatggaggggtctgaaaaacaacaacaaaaatgtatgaaataggaaaaccagaagggtcactctagtctctcatttgaaagaattgcagagatggccgtgaaactggagagtacaggttgaaatgcttgagaagtgggtagttctggaaaagataaaaaacggttcagactaccaaacaaacaaacaaaaacccaaaacaataaaaagcggggcgtggtggcgcacacctttaattccagcacttgggaggcagaggcaggcggatttctgagttcaaggtcagcctggtctacaaagtgagttccagaacagccagggctactcagagaaaccctgtcttgggggaaaaaaaaggcttttgatcttaaattgtaggtcgagagcaggagataggaagaataaccttatctcagacagatggccttgatctagtctaagaacagggcaggagataagaaacactgtctcacctgatttttagattgctttaattgctttaattatcaaaatgcatgtggttataaagtttgatggttatgatattagaaatcctctgggagagaggtcaagctactaaattgagtcagtctatatctttgatgatttcaggttactggaccaaggacatggtattttgggagagaggttctgtatttgtgttaataagaaagaaggaagggctttggaccccttccagagtgatatggatcagatatgacaggggaagactcccctgaagatcttgactatagaaaaaaaatttcaagaaaatcaaacaagacaggtaacttaaattgctgatttctcatgggaacagtcttgtaactggcttagacataaaaatttctctagccaaaacctcagctaaaattaggtaataaatcttgttggttgaagaatccttttttttggggggggaggcatttcgagacagggtttc

SEQ ID NO: 35868 - DNA, 1599 bp, Mus musculus
ttttgttttgttattatccttgtatttccagccacctcccatcccttcttcaagcttagccagatcctatctcgcccagtgaaatcacaggaagtttaacgtatctcagaggcctttgagttcccactcaatacctctccctctttacagaagagaggggtggggggagccttggttggtctgagcagtggctgtgaaatcctcccaatgggcacagaatggcccccaggaaccctggccttggcctacttttttgagcctgggggccacatcaccaactgctgcatatgttgtattttttaagttgaaattaatgaagttaacatttttattgtaattttagccttagcgtgtgggggtttatccctttttgttagctgtgtacagaatgtgtatcctatctcctcccctccttggctaatcattggcaggggtcttcctggggaaaagcttaaagagcagctagggaaggagagaaacagtgtcctgggtgagacttggtagatactgctccaatatcctgttgctagcccccacctccttctggaacagtgtgagacaattaaacttcattccctgtgggttagcacttaatatgtagaagcttgggcttgaaggtgatgtccaccttaatcagcatcacttgcagagactgaccctaaacaacacagcaggggcagggaacgggtaggacttgaccctcttgaaggcagcccaggatgggagtagggtatgccatatcccacaggggctatgagtaggtaccagataccaactcagtaattaattttgtagcattgtccccaagctctggatttttttctctccaggacccaagttttaggcagtgagtaatgcttataagcaaattactgaaggatttaaaaatggacagccaatgtgttcagccgctctggcctgtaccccctggggcctctagtgtattgtattatatttctgtggaaagtcatgtttagtcaaattggaatccactcacctgttccctttgttttccctatcccttctcctgagcaccctttgatttctgaggacagtactacccattcatctattgtagagtaacccttgtgactcaatattaccatagtgcgatgttgttttgtgctattttgaacaattaaaaagactttttttgaaataaccatctggtatttacccgtgtgtcaagagtgtcttgtgagccaggcaagtggtggcgcacgcctttaattccagcacatggggggcagaggcaggtggatttctgagttcaaggccagcctggtctaccgagtaagttccaggacaggagctacacagagaaaccctgtctcggagaaaaaaaagaaaaaaatgtgtcttgtgacctttggagattggaggctgggacctgcccaaggttcacttgagctactggaggccttttctaaccagaaatcatgggtttcaaagaaggccccagaacaaggtacacccctggggcctctaggaacatggtactacagctgaggggcctcttcttgcacagttgctgattttgcatttagaaatcagttcacctattctcccactaaggtagaaaaactgaccattggcagt

SEQ ID NO: 35869 - DNA, 1154 bp, Mus musculus
acgagcagtgaccactgtgacacagtctacaccagtccctggtccctctgtgccggtaagcctcaccccaaaggatcctttctgtggccttttgcccactttcatctgtgctgtccataaatggacactagatgtcgcccttgttccagaatggtattgttccttggttgttcttctagaccataaaagggcaatcttggtgcctgggaggcaggaggcaaacagtcccttagaggagcgttggtactttatctccactgttggtttccttctttgctgttccccatcatttgtctctacagtgaagtcttctgggcatgagtggaaacttgacccaggggctttcctcttgtcacacccttgctgatgcttcttgactcacattcctcatttacatttacccaagataaatgttgtgggtgataccataggcctacagggacaaaacaaaggctatcttgtttttctgccccactgcctggttctagcctttgtctcctcccctctccctctgacgggggcttctctccctttctagaacatctcatcattgactgagactaccccaggggctctgaattccgaagtccccatcccagccacgataacagtgaccatagccaacacagaaacttctgacatgcccttctctgctgttgacatcctgcagcccccagaggaactccaggtctcaccagggcctcgccagcagctgcctccacggcaactcctgcagtctgcctccacacccctgatgggggagtctactgaggtcctgtcagcctcccagacccctgagctccaggccgccgtggatctgagcagcactggggacccatcttcaggccaggagcctaccacctctgctgtcgtggccactgtggtggtccaaccacccccacccacacagtctgaagtagaccagttatcacttccccaagagctgatggctgaagcccaggcgggcaccacaacccttatggtaacagggctcactccagaggagctggcagtgactgctgctgctgaagcagctgctcaagctgcagccactgaagaagcccaagccttggccatccaggctgtgctccaggccgcacagcaggctgtcatgggtaggtatcagctggcagatttgagggataggcccctta

SEQ ID NO: 35870 - DNA, 1147 bp, Mus musculus
aaaaggcttgactatcgtacaactcctcctgccccagctctgcctcattgtcccttcatcctcggctctaagtaagtcattgttttgagatcacgggccaaacttttcttagatttgccttggatagttaacagagttggtggtcccagtcaacatgggcgagcataggatagtaggagaggtaaatgcaaaatcacatagtccaggcactaactcctctgttctctttccccagcctgtctcccagcctacccaggtcactctgattacagcacccagtggggttgaagcacagcctgtacatgaccttcctgtatccattttggcctcacctactacagagcagcccacagcaacagtcaccatcgctgactcaggccagggtgatgtgcagcccggcactgtgacactggtgtgttccaacccaccctgtgaaacccatgaaacaggcaccaccaacacagctaccaccactgttgtggctaaccttgggggacatcctcaacctacccaggtgcagtttgtttgtgacagacaggagacagctgcttcacttgtgacctcagctgtaggacaacagaatggtaatgtggtccgtgtctgttcaaaccccccctgtgagacccatgagacgggcactaccaacactgccacaacagccacctccaacatggctgggcagcatggctgctcgaaccccccctgtgagactcatgagacaggcaccaccagcactgccactacagcaatgtccagcatgggcactgggcagcagcgagacactcgtcgtaccactaacacccccactgtagtgcggatcactgtggctcctggggcattggagagagtccagggtaccgtgaagcctcagtgccaaacccagcagaccaacatgaccaccaccaccatgactgtgcaggccactggagctccatgctcagctggccccctgcttaggccaagtgtggcactggagtctgggagccacagccctgcctttgtgcaactagcccttccaagtgtcagagttgggctaagtggccccagcagcaaggacatgcccacagggcgccaaccagagacatatcatacttacacaactaataccccaaccacaacccgctctatcatggttgctggggagctt

SEQ ID NO: 35871 - DNA, 1195 bp, Mus musculus
gcccacaaccatcattaccaccacacaggctagtggggcagggaccaagcccactatcctgggcatcagtagtgtttctcccagcaccaccaaacctggcacaactaccattattaagaccattcctatgtcggccattatcacccaggcaggtgccacaggtaaacaggcagctttcaaaaggcctttgctggtttgctggtgagtataaatcaaaaagataagtcctcacagcttattttctctgaatccttccccaatgcaggtgttaccagcagtcctggcattaagtccccaattacaattatcaccaccaaagtgatgacttcaggaacaggagcgcctgctaaaatcatcactgctgtccccaagattgctactggccatgggcaacaaggagtgacccaggtgaggcacacatgacccctcttcacttcagtctagcatagaccacatgtgtcatcctaacaggtctgagaggggcagcacagtccattcagcctgaaagtgacattggtggcactttgctctgctgttccaggtggtgctaaagggggcccctggacaaccaggcaccatcctccgtactgtgcctatgggcggcgttcgcctggtcacccctgtcaccgtctctgctgtcaagccagctgtcaccacattggttgtgaagggtaccacaggtgtgtagcctgcaggccaggtcctcagcaatggctgggggaggataacaggtcctctctccagagccttctgtccttggtggctacatggcagggctcccattccctagccctcgagagagagacaggctgctagatagaaagtggtagcaataggcctcattctgcctttgcctttccctccatttaggtgttacaacgctaggcacagtgacaggcactgtctccaccagcctggccggagctggggcacatagcaccagtgcttccctggctacacctatcactaccttgggcactattgctacgctctcaagccaggtgatcaaccctactgctatcacagtgtcagctgcacagactacactaacagctgctggtgggcttaccacacccacaatcacaatgcaggtaagtgggtcctaagggtgtaccaccatacacagcagcactcccacatgaaagtagggggcattttagcctttctcccctttccagattcagttctatagacc

SEQ ID NO: 35872 - DNA, 1204 bp, Mus musculus
cctgcatgaagggaaggcatcagcctataatagtttctaggaccacctacaggtgcagctgtaggctctggctgtctttaactctggtacagagagaatcatgggctctgaataggaggaacatgagctttagggggcatttggggtatagaagtttaatgatcatgtaaacagtgggggaaggaagtcatggtctactagattctcagaggctggtgaattatcttggtgactttactgctttctgagatgaccttaatgagaagttgtgcaattgtttgaaagccagggttctgcagatggtttgaataaaatgactagagatttgtccataatgctctaaaaggatagtgtgctggctcagcctcttctctcttggctacatttgaagactaggagttgtagagtacaagacttaaggaataagaattgtggggtggggggcacttggattctagaagctcccggatgttttgacttttgtttccttttcttcagcaaccaaccagtggttcatcccagctgtgagaggggatatccctccagggtgtgcagcctatggctttgtgtgtgatggtactcgcctattggtgtttggtggaatggtagagtatggaaaatacagcaacgacctctatgaactccaggtaataacatagagcctctgtgggcctgggttgttacactgcctcgggccctatggaactctccatagtgttcattgtgctggtttgtgaggaaaggcagtggaaggggttacttgagagtctaccaaggctgttcgctccttgaacagtgtcagaggagagaacaggaccaaactctttagaacttacatgtttcagcaatgtgctctctcactcccgacaatcttttccttgtgccacaaatagcccctggcccctaaccagtgacttctcatctcttaaatattattgattttgtaggcaagtcgttgggaatggaagagactgaaggcaaagacacccaaaaatgggcctcctccatgtcctcggcttggacatagcttctcccttgtgggcaacaaatgttacctgtttgggggtctggccaatgatagtgaggaccccaagaacaacattccgaggtgaggctttgtcctatttttttctctgaagcgtcccaccagagtgggtctactttccccaggtataagattcatctgaaattctaaagttggttg

SEQ ID NO: 35873 - DNA, 1577 bp, Mus musculus
atggcggctcccagggaggaggcatgatcgccctgccgttaccgcttcttctgccgtacaattgtcacttcgggtcttaactcctgctctttcgagcggctcctgtgggaaggagtcttaaggagggaagcgaggattggacgctgccttgcgtttggtttgctgtggaagaactgtccaggaagaagaggataggtggggtgggggggggaagagaagctagtctcaagatggcggctcccagggcggccgccacagcctgaatagcagaggcggactcaagggagaggtgcaaaacctctcgagccatacgggtcggggcttcgagcagcaactgagagttggagcccgttccgccagcctctgacacgcctttattacttaggaacgttggggttctgcgatcggtggttgtactaagtgctgggtggggaagcaggacggtttcaagatggcggcttccacaattgtggtctgactgtcggcgaagttgagacaaccgcggcatttgtggctcttttccacccgccccggaagccagccagtgctggggacggggggtgtgggaaccgggccggggctccgccatttccggcgggggagggctacgactgaggaagggaggagagagaggcggctcaagatggcggctcccagagcctcctgctcgaggttctaagcgggaacacccaggcaaatagttagagcgacggcgctcagtggcctccagcttctcgggaataggtgctctgcagttctgagaagcttttaaggatacgagctgagtgagaagggggggaagagccaaaggaaggaggatagttaagatggcggcctccatggagtcgtccaccgctgtgtaaggagccgcttcttcgtgagagctgccttagacgaaagggggtgtgtgaagaattaagggtatcctcccattcagtgacctcttcccactgcatccttaaccggaactatggcttcggctgtgtctcccgcaaacttgccagcggtgcttctgcagccccgctggaaacgggtggtgggctggtcgggtcccgtgccccgaccccgccacggccaccgtgcagtggctatcaaggagcttatagtggtgtttggcggcggcaacgaggggatagtggacgaactacacgtgtacaacactggtaagtgctaccgccctgggtttctcaaagtcttccctccatctctctcctaacccttcttttccctatcttctcttttcctatctcactcccctgatgtgttttccttctctctttgcacttattgccatctttgctttctccctgatttttcaacccccgttcttacacccccgtactcttctgtgtttaaaggttgcatttcggtacttagagaaaccctctactccgactggtgagggggaggggatgtcgcgggcgacagtgacttcagacgtacaccgttacccagtgggctggggctggcgcggcagcggatgtgttctcttggcgcaggcggaatcctcccccctcctgcgatagtcctcatctccagcgcccatgctcgttcgggagaaaagataatatttagat

SEQ ID NO: 35874 - DNA, 2137 bp, Mus musculus
agacaagaagttgtccccaacttattaagtgatattttcttttccataggcttggatttagaacctgaaaagagccagggacctgaagaaagtgatgaattccagagctgatttgttcactctgacaaatccctcagactcagaggtcaaagttctcatgcttggaagttctcatagtgtgcaaactcctcagtagcccaaaggcatcaggtgtgggggctcactctggcaaaggagagagggcagtggaccctgctgttctcagaatgtgaacacagacagggccagccaaagaacttgatagaagctgataaggcaggcaatgtgaggccagcatttgtgagcaaggcaagcagagtacctaaggaattgggtagtacaaaacagaagactggggctggtgagatggctcagtgggtatgagcacccgattgctcttccaaaggtccggagttcaaatcccagcaaccacatggtggctcacaaccatctgtaacaagatctgacgccctcttctggagtgtctgaagacagctacagtgtacttatatataataaataaatctttaaaaaaaaaaaacagaagactgctagctacacaggcccagaggacacaagtaggtctgtttgtatggtgggagctagctcccctgagagctagataatatatctgcagtctgtgagtctattcctcagaacttccctaaaacaccaagcgaaagtagctgttgtgcttgtaaattgcaaaaaaaaaaaaaaaaaaaaaaaaaagagtgtcttacagttcagtccactagctagaagtgagcactctgagattctcccaagagtctaataaaacccccctccccatcttgggtggatatatgcaagccttgccagatagcagtgagctagtttcatatgactacctgcctgcctaggcaggctctctctataccctgcaaattgactgtggatgcccaaggttctgcttatggcagaaaggtccagcaaagcccagctttgtggtacccagacagtgagaagccccaagaaagaagaaactgagagcaaagctaagtatttgagggggaagaatgttacatttaaaaaaaaaacaacaagtttttgtataattaagtgtcttcacaagtagcccagggctatagcccaggcttacagtgattctgtgtttgagtcatgagtcacactacatgcccctgtgtaattggtgacatccaatttgtccttgagtaataaaagcatacatttcactgtctggttaaacttgtggaatttgttgtgctaaaagtgttatgctttcctaatgctttatatctctgggctcttaagtgtccacccaaaactcaggcccctagcatttgttcttttctcttgtcaggccagactggggatagatccccttgctttcttgtcttgcagatttcgtggatattgatgctattggaattgaagccttcatgtctgaattattcatcaatcatatatagaaatttcattaagttttgatcctgatctttattctgtggccttacttcttagccccacttgttttgggggtgattactctgagatagtttgtatacaatcaacctatctgaaaataaagataattttactccattgccaacctatatgccttttaattttcttttctttttagaactaactatatagccctgactgtccttgatcttgatatgtagaccagactggccttgaactccagaggtctacctgcctctgacaaggcatgctctaccatacccaacttgactttttttttcttcatttattgcattggctagggcctataagttttgaatacaagtgggaaaccccacccactctcaggagtttttctcacttttcttaacaaatctatgtttgttctattaaagaaaaagaaaataaacatcattgttatttttcttgtaaaggtggaattgaaagaggagttacagaatatttcaaatgatgctactgagtctattgagataaacagaatttattttcattctgttcatgcagtggtcacattggttttgaaatgttaagctagatgcatattctggcttggttgccacatgttctgtttttgtttgttttgctgaattctgtaagtgcaatttta

SEQ ID NO: 35875 - DNA, 1138 bp, Mus musculus
attgagcttcagtttcccatatagaaaacagactttaacacaggaacactattccagcaattcctaggcccagaacatgcttggctaatgctgggtcgtcaccttttacagagttacatctcccattgcttctccaggatgaagcctatttttgtccactgttgggcccagtgggggatttaaccaacccaacaaactgaaccagattctacccatccctccttcctttactgcgtccattagcacatcccagctcaagtactggttgttcagaccccacggaccttgctaacagactagtaggtttgttggcatctgtttcccccactgcaatgggatgtcaggactgtaaaacacggcccagagtgtttgatttgtggctgttatcagtagagccccagacagcactaggcacacagtggtgtttaatgaacctagggaaagaagaccagaggactgagtggcagtggcctggaagttttggtggaaccatgctgaactgacagtatttgttttacagaaagacctgattgaagatgaggctgaagaggctggagtgaccctgaaaagcacccagcctactctgtgggtgggtgtagccacggatgcttgggctgctccaattgctgcccagatctataagaagcacctggactccagacctgggccctgcccaccccagttgggcctggccctggctcaactagcttgctgctgcatgcaccgtcgggccaagaagaggccccccatgacccaggtagccctggggaggccagttaaccatggggacatagtggccagcaagaaaactttcgtacttgccctgcttgatagcaatagctacaaagtacctacctgatctcttacagaggcaaaactcccaacattccttgcttgccctttggctctatttggggaggtgctctgtggaactaagtggtaaagggctgctgctttgctggatgagcctcagatcccaggaacaggtagaaggaaagggctctgatcatgcccctaagtgggggtgctgtgccactcactacctttgtctttttgtcttaccttccacctcttctggtgatggttaagaatagagttcctggctttggtggccatgaatctcaatagttcttgggat

SEQ ID NO: 35876 - DNA, 1147 bp, Mus musculus
gacccaggcctgctccccactttcctggcctcaacgactggacattcttctgggcacagcccgggctattcagtttttacatcaggatagccccagccttatccatggagacatcaagaggtgaggaggggctcagaagagctatagaaagtcatatggccagggagacagtgaccctctgctcaatgaacagctctgttctgagtgtccctgtgatattcttcctgcccagtcctgtgaatatgggaacaggtgttgcctgggacctcagagctgagagtacttagggctatgagtacccctgcatggtgcaagtatacaaataaagccacggtggtgagcagaagccaaacaatgtgaaggggctcagggactgcgggccctcagacagctgggatgcaatgcagccactttccataagcagtacgcctctagtccagtttatcaggaccatttgggtgtaggggacagaaaaacagaaaggtagtaggacctgaactggtgccattcttccgtttgtttccaagttctaacgtgcttctggatgagagactgatgcccaagctgggagactttggcctggctcgtttcagccgctttgcgggggccaaagcaagccagagcagtactgtggcccggacttccacagttcgaggtaccctcgcctacttgcctgaggagtacatcaagacaggccgactggctgtggacaccgataccttcagctttggggtggtgagccaccagcccttctgttggcttggggagggaaaagcaccagtaagtaaagtcaggaaagcctagagaattctaggcctaaggcagaggtgagcctagtggggagctagcatagctttggccttagggatcaccctgcctcatacacctccctcttcccttgcactaaattgtggtcataatttgcatccttttgcttaagcttgcatcccataacaatgctgcccttgctgggaggtggtctgtacctgcctgttccgggactactttcccactagtcctgatccatgcccatgctacaagcctcttctacacacaatttctccctgctaaagtgatgttgtctatcccccctctaggtaatactggagacccttgctggtcagagggctgtgaggacacaaggtgc

SEQ ID NO: 35877 - DNA, 1627 bp, Mus musculus
cagggctcagagcatttaaaaaccctccaaactttgctgagtctagggactagagagaagatagaagatttggtctatctccaaggtgtgtaagctgtaccaggtagaatgccagggaccccagaaccacatccaacagcccaatgggtctcctccagaaagtagtgaagactccagaaacatccctttctcttctccctgctcccatgagtaactgcatttgcttttgtaatccttaatgagcattatctgctaaaaaaaaaaaattagctgtaacagttctttttgcaaaaggatcattcttaaataattaaaaacacccccccccaaaaaaaagtccagaaccttgttcttccaaagcagagagcattataatcagggccaaaatctgtcccacacctctaccccatctcctcatgattgctgcttctaaggccagaatacagcaaagatatttgtaggccctttgggtgactgggctacccttggagctcttggaagatgggctggggaagcctctgagaccctatcctagggccttgctctagggagtaatcagtattagtagagtgtcacaacattattccccagccggcatgagatgggggcagaagaagccaaagggttgtctccactgctacttacttggccactgacaggtaggtgaccatgtatgtccatatgcatgttttatggctgatgtgagatcagcacccaagttagcttcacctggtgacctctaaccctgcctggatggagcaggccacctggttcaatgtttctgggcagctggacaatggagtgcaaaaggcttacagaacttgaagccttttccttactttgctagcacggcctccttttccatttgatttgtcactgcttcagtcaataacagccgctccagagtcagtagttgatgaatatatgaccaaatatcaccaggactgttactcaacgtgtgccgagccctttccttgtgctgggctccctgtgtacctggacactgtaatgtgtgctgtgtttgctctccttcctcttccttccttgccctttccttgtctttctggggtttttctgttgggtttggtttggttttatttttccttttgtgttccaaacatgaggttttctctactggtcctctttaactgtggtgttgaggcttctatttgtgtaatttttggtgggtgaaaggaactttgctaagtaaatctcttctgtgtttgaaatgaagtctgtattgtaactatgtttaaagtaattgttccagagacaaatgcttctaggtacattttcattacaaacaaagcatttgaagggagggaagtggtgaataagacaagaggggcaatctgaattgatccctgcccagatcagccagaagctaccaaaagttaagcactggttttccattccaagtcaagagactgaagctgatgttttgccattttcaaagtcaaagcaaaaccagcttttccacccaatggattctttgcttctccttcccagattattactactgctgtaataatctaggagtgccaggagggaaaggagtattaacacagagctgtgctcactgagtatggaaaggcttggtctgagttttcaggaggatgacccactg

SEQ ID NO: 35878 - DNA, 1160 bp, Mus musculus
agactagaggccatgaacattggacgtgggaaccagagcaacccgaattgctgctgctttattcagctttccgttgctctgacaatgataaaacaaggcagtaacttaaaacagactgccaggtttggcagagaaaggaaattccttagctgacagcacctctggattttaaataggttgtaataagtggctcaaacccatccaggaaaaagcaaaagggttagaactgaccagatgagaccagcctgatttcatgcagcccaaatggagtccagctgtctgaactctgcagcacttctctactacagtctcctagagcattccagccaggctcttcaggctgaggagacatcacaggtgccagttcttcaagaagacttttgtgcatcagttcatagcctatatctttgcccaagattgtagattcaggttaacactacagattctagggcagatgactgagactcagaaaaaaagcccctgtggactgtggtatagcgaagtacaaaaactgaagggggctagggcagatgccgcatgcctcatgccagagccaagccctctgctccatccacatccttttctggctccttcttcctgctctctgcttcagtgaaccagccccactctgaagagatttgttgattctctccatttttatgtctttctcttttaggtactatatagaaaaggcttagtctaattgttataaattgctagaatactgcctcccccagggtctaaaaatatatgctaaaggggaaaacttgaacactgaaaccagttctgaacaatttagaaggaaaaccttgaaaacatttaacaaaaaattatattttaatgtttatgaataagaggaggcttttgaaaaaatgttgatctataaatacttactttaggcctgaggtgtctaatgagtgaactgagcaatgggaactcaaggctgaagcctcctgcatcagaggaggtagaaccaggagcctcttgagatttgaggtgttttagcattggaaagccactctttgggtagctggccccagaaactacttctgaccttgtcatttggaatggaggttagtggtctgccagatgccaaagctgcatgagaccagctcttggtttatcaatttgaacactcagtaacctagaaggcccagcac

SEQ ID NO: 35879 - DNA, 1131 bp, Mus musculus
tgagaaaagcgggaagggactgaagacctgcaagagccctgggcgtaaaagcaaggagagcagccccaaggggcgcagcagcagtgcctcctccccacctaagaaggagcaccatcatcaccaccatcactcagagtccacaaaggcccccatgccactgctcccatccccacccccacctgagcctgagagctctgaggaccccatcagcccccctgagcctcaggacttgagcagcagcatctgcaaagaagagaagatgccccgaggaggctcactggaaagcgatggctgccccaaggagccagctaagactcagcctatggtcgccaccactaccacagttgcagaaaagtacaaacaccgaggggagggagagcgcaaagacattgtttcatcttccatgccaaggccaaacagagaggagcctgtggacagccggacgcccgtgaccgagagagttagctgactttacatagagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcggggtgggagtagttggagcattgggatgtttttcttaccgacaagcacagtcaggttgaagacctaaccagggccagaagtagctttgcacttttctaaactaggctccttcaacaaggcttgctgcagatactactgaccagacaagctgttgaccaggcactccccccaacaatatcctccctcttccccccccccacccccgccccgtgtgctcgttagggcaattgagaggacactcccatttttggtgccattgatgccctgtccataatagcttccctgacttttacaccaccccaactcccaatctgaaggactgggaggtgtgatgcaggagaaactatgggactcttgggagaagactatggagttggccagtgattaaggcccagtaattccaactgtggtagcacagatctggctccacatcaacccaatccaaaactgacaaggatattttgcaaaaaaagaaagtggcacctgtctgatccagctctgacatggct

SEQ ID NO: 35880 - DNA, 2447 bp, Mus musculus
aggtaggtttatgggtacagctctgagtgtagatgtatagccccagcaccaggaagcatgtggaagtatcaaggctgtgctgggtagctgaatgcaaggaagccagtgagatagattctgcctgaccttctattttcccagggagcccagcagagtttattgtgaacacaagcaatgcaggagctggtgccctttcggttaccattgatggcccctccaaggtgaagatggattgccaggagtgccccgagggctatcgtgtcacctatacccccatggcacctggcagctacctcatctccatcaagtatggtggcccctatcacattggtggaagtccctttaaagccaaggtcacaggtgagccttaggctaagctgttggtggccacccaatgccttgatacttgagcagcttcttagtctcacccattctgttttgtaggtcctcgtcttgtaagcaaccacagcctccatgagacatcatctgtgtttgtggactctttgactaaagttgccacggttccccagcatgcaacctcaggcccaggtcctgctgatgtcagcaaggtagtagccaaaggcctggggctaagcaaggcttatgtaggccagaagagcaacttcacagtagattgcagcaaagcaggtgagtagccctatttttagcttctggaagtgcaaagccataaataacaggatggtcagcatgtaggaagtacaggaactgcctttaggggtatgattattgcttttagagctaccttctatttgggccttcgtactttcctttctacccttcaagaaaatgtcctggagtggggctgctgaaaaggtggctcagcagttttcagaggactggggttcaagtcacagcacccacatggcagctcacaactgtctgtaattccagtttcatgggatctgttgtagaaattatttaatccctactgttttacccagggtttctaccccaccttagattagttctcagattaaaaacacacatgatctttatatttacagtaagccttaaacaatacaagagcttggcagatactactctctatgttgttagaatttattttcctatggataaccccaagttattacttactatgtttcatttgggttgctcttaactccaattgggcagctctcagggcccttgactccagctcatggtggcttctccttcctcctctattttcttacacagatatacatgcaggcaaaacaccaatgtcctggaggagctgtaatttatcctctggtggtctgggtggcaaggctggggtatgagatgcttgcttgggaatgttaataatcaggcaaggaacagaatgtggaatagtgagaagggctcagagcaattatagacaaagaaaggatctaaggccactgagacctattcctgccttaggtaacaacatgctgctggtgggcgtgcatggcccaaggacaccctgtgaagagatcctggtgaaacacatgggcagccgcctctatagtgtctcttacctgctcaaggacaaaggggagtacacactggtggtcaagtggggtgatgagcatatcccaggcagcccataccgcattatggtaccctgagcctgccacctaagttggcacctgtgccagctagaagctcccatggcaatgagcatccccacacctgtcctattcccaagaagccccattttcctttcctgagccctggaccctcccttccctggatcactctggccgctcttcactgcattcgcccttgccctgcactgtgttcacctgtctctgggctttcacttgggcagagggagccatttggtggcagagcatgtcttctttggttctgggaggtggaagtcctatgtacaaccaccttctagttctctttcccagccaagaggaataaaattttgcttccgttgtcctgtgaatgtagctttcatggaaggagtaatggaaggccaaactagcaagggcaccaacaaggcaaaaaacataggccatgggacctctgagtagcacagtttgtacttgatcttttgcttcacagagggggatatacggtgtgcctagaatggcatatgggatcaagcagtcaaaatgtagggcatgaagattcgttgctagcttgttggtgatccctaatagtgaacagtctttgaaatagcatcagggcatagccatttcttacatatcatgaacatgataccagcgcttttatttattttaggttttttttttccagacagggtctcattatgtagccttgaatagactggaactcattgggtaggtcaagctggcctcaaactcacagaggtggtctctgcctcccaagtgctgggattaaagggtgaaccaccatgcctggcttgctatgaaccctttaaataagacaccattacaaattccccttcccacaacagggtagatatcttg

SEQ ID NO: 35881 - DNA, 1134 bp, Mus musculus
acatagtctccacttggttcttattctccatcgtaaggttccagggacaaccaaggggactgtgggagggaggcaagaggcctttcctaggctagcctttggggatatgtggcacctccaggtatagccttatgttctcttcctttccaggtgactatgaggtctcagtcaagttcaacgaggagcacatacctgatagccccttcgtggtgcctgtggcttctccgtctggtgacgcccgccgccttactgtttctagtcttcaggtgaggcactgagagaaactgcccatctggggctcctgggcccggccagaccagagtcaccatagcaagcaggtcttggccctgggctgagtgcctacgcagaaataattctggatggtaggcttctgctctggccgggtacagcccacgcttgaggttggcaggaagtaccctgcccaccgcgtggagtttttctcgtgtctcaggtctaaaggctttgaacagaaccctgtgcccattgagcaccagggctgaggtttaaagagggacagcctgttagagctgagtgctacctacagggtgggccaccttgcctttctgctacctgggtgtgtgattgtggagaacatgtttaggagataggaggttgggggtatgcctgtggcttgctgccctcacagatcaatggctctccctctttaaaccatgttggacaccagatgggtaagtgactctgtcggtcttctgctctcccatttgccctggttctatacatcctgtctaaccacatctgctatgcttccaggagtcagggttaaaggtcaaccagccagcatcttttgcagtcagtctgaatggagccaagggggcaattgatgccaaggtgcacagcccctcaggagctctggaggagtgctatgtcacagagattgaccaaggtgaggctctatccctgcctattcatccaaccatttgacctagctgactagaagtaggctaatgtagtgattcaaaagtgggctcctcagctaaaaaacccttcccagattgacaagcacccaggaagataatggctttccatcatggccactaggaagaacaccttacaccagtgtcatacatgagaaagacataaaaacagagacag

SEQ ID NO: 35882 - DNA, 1183 bp, Mus musculus
ttcaggcctcggggttgggtagggaggaaagtttcacatcccccacactgcagcaggactctgcctcacttcatccacacatagcactggggcccagggccagaccacgggtgtaggtagccatgggcctggccagagtgccggtataagttagcataggccatgataccagctgaggctgagttggcagaggaggtagcagtaaatgcttgtgctgggattggatggtcccttacttgtcttcccaggtatctgggtaccacttgttggtcttctctcataaaggggcttgaggtggtcaggagaatccttcctgccttctgagaaaccactcaccatcgtagcttggggtatgggttgggctagagattggggctggctgtgcttggttgtagcagtaagaggcctggatgggtagcaagctgatgggggtagccaaaatgttcggctcacctgctggctcccctctggggattcactctgctttaccaggtgctggcattggccccaccatccagattggggaggagacggtgattactgtggacacaaaagcagcaggcaaaggcaaagtgacttgtactgtgtgcacacctgatggctcagaggtagacgtggacgtggtggagaatgaggatggcacctttgacatcttctacacagctccccaaccgggcaaatatgtcatctgtgtgcgcttcggtggcgagcatgtgcccaacagccccttccaagttacagtgagaagaggccaaggatgggtgggcagggagatctgggaaagtcctagcctgtccttccaggtccctttgtgacaacagtctccaaccctctcactttgccccacaggctttggctggggaccaaccaacagtgcagaccccattaaggtctcagcagctggctccacagtataactatcctcagggtagccagcaaacctgggtaaggcctgggcctggtctattattcaatttgtctaacccatagggacacttgaagctggccacctggatgtctcatgtggccctgagaaaccccatatcttctcatagcccctcacctgattcttctgtctctattgcagattccagagaggcccatggtgggcgttaatgggctggatgtgaccagcctgaggccctttgatcttgtcatccccttcactatcaagaagggggag

SEQ ID NO: 35883 - DNA, 1501 bp, Mus musculus
cccttcccttcccttccctcccctcccctcccctcccctcccctcccctcccctcccctcccctcccctccccttcctttcttttgaagctgtaaggtgaagatccttccttccttccttcctccctcccttcctccctccctccctccctccctcccttccttcctccctccctctctctctctctttcctccctccctctctccctccctccctccctccctccctccctccctccctccctccctcccttcctccctcccttccttccttccttccttccttccttccttccttccttccagccctgggtatcttggaactcactctatagacctggtatgattgagcaggtgatctattaggcagcctattcctttcatgtctctgggtaaggaagaaacctagggcaaaaggagacagatgaaaggttgggctgatagatgcttctgatttcttccttccctcaggtgaaggcgtttggaccagggctacaggggggcaatgcaggctcccctgcccgcttcaccattgatacaaagggtgctggcactggtggcctgggcctgacagtggaaggcccctgtgaagcacagcttgagtgcctagacaacggggatggtacatgctctgtgtcttatgtacccactgagcctggggactacaacatcaacatcctttttgctgacacccacattcctggatccccattcaaggcccatgtggctccttgttttgatgcatccaaggtgaagtgctcaggccctgggctggagcgggctactgctggtgaggtagggcagttccaagtggactgttcaagtgctggcagtgctgagttgacgattgagatctgctctgaggcaggactgccagctgaagtatacattcaagaccatggtgatggcacacacaccattacctatattcctctctgtcctggggcttacactgttaccatcaagtatggcggccagcctgtgcccaacttccccagcaagctacaggtggaacctgctgtagatacctcaggtgtacagtgctatgggcctgggattgaaggtcaaggtaaggaggcccgctgtaggggggttggctagcagttacagggtgcaaagagtcctgtagccacagcctcctcactatggccttttccaggtgtcttccgagaggcaaccactgagttcagtgtggatgcccgggctcttacacagactggagggccacatgtcaaggctcgagtggccaacccctcaggcaatctgacagatacctatgtgcaagactgtggggatggcacatacaaagtggaatacactccatatgaggaaggtatgaatgtactggggataccttaggcagagcagggagtaagtggagcagcctagttattcctgacctgccctgtccttcaggagtacactctgtggatgtgacttatgatggcagccctgtgcccagcagccccttccaggtgcctgtaacagagggctgtgacccc

SEQ ID NO: 35884 - DNA, 1363 bp, Mus musculus
taaaaatggtgccttggcaagggaatactagtaagttccttaagtcatactggcttgtaggaagcttcttgattgaaggagaagaacctcacgtatgaaggatgacctcgtgtactgctattctataattggagatgaagcagtcaggattgtgcaggtgcaaggggttaggaaagtacagcaaaccagatttttcagagaacaggcatgggcctgtcttggtggcaatagcccatatagcatggatctgaggcccggctcaatgctgggtttacattgaacaaatctacctgattggattgtacctagctgggggaggggcactgagcctgcagagggatagggtctctaatgctgtgtccataaccctttagggtctgggaaccagggtatagaggtgagagggtagccctactagttggttcatggctttctcatcttctgacaggcatcgagcctacaggcaatatggtgaagaagagagcagaattcactgtggagacccgaagtgctggacagggagaagtgcttgtatatgtggaggacccagctggacaccaggaagaggtaggattatccattagcagggcaggattctgttatgcccccttttaaaggggttgctcttaacactcttcccattacaggcaaaagtgactgccaataatgacaagaaccgtactttctctgtctggtatgtccctgaagtgacagggactcataaggtgagtccttggctgagaaggaagctggtggccatgggtagttggtgaagggccccttacctcactctcacagcctgccccttctgggaacaggtgactgtgctctttgctggccaacatattgccaagagcccctttgaggtgtatgtggacaagtcacagggtgatgccagcaaagtgactgcccagggccctggtctggagcccagtggcaatattgccaacaagactacctactttgagatcttcactgcaggtgaggggagacagcccaggcccagccagccatgggggagagctgtgctggggtcctagagctgagtctgtgccttgggacaggagctggcatgggtgaggtggaagttgtcatccaggaccctacaggacagaaaggcacagtggaacctcagctggaggccaggggtgacagcacctatcgctgtagctatcagcccaccatggagggtgtccatacagtacatgtcaccttcgccggtgttcccatccctcgtagcccctacactgtcactgttggccaaggtaggcctgcccatgagtgttcttctactgtggtactatggcctggggctctagggagggagttggcaactgggactgtcccactgaagcccatgttt

SEQ ID NO: 35885 - DNA, 1091 bp, Mus musculus
caacacttcctctgtcttttcccccactctggagcagcagttgtatttcctaactactctttgccaacttagccttcctcttctttggttccaacccagcttgaggtcaggggccctgtttcttggccagttagggctgagccacttctcccaattcccatagatctcaagatattagggcaggtcttgatctcagcagctgtacagcatccatctcacttgctcttccaccctccttctgggctttgcggtttttggcagggtcccttttattggattgtattatgtgtctatgggagtctttcccccccaaactctcctttatcacaaaatattttcttacaccatttagatgccctgggcagagggtgcctgatccactttctacccctagttgggaggggcctcttgtcacctaattgatttgctgtgctgcagacctaggtccctccttgctggccttcatgagggaataccctaactgcaatgccgccacgccttttcccacagacagcaaggctattgtggatggaaatctgaagctgatcttaggcctcatctggaccctgatcctgcactattccatctcaatgcccatgtgggatgaggaagaggatgaggaggccaagaagcaaacacccaagcagaggcttctaggctggattcagaacaagctaccacagcttcccattaccaacttcagtcgagactggcagagtggccgggccctgggtgctcttgttgatagctgtgccccaggtaagggagatcttgggctaagactgtctggtcaacctagaaggtagctctatagccccagactcacaacaagttcttttctgtgttgtaggcctatgtcctgactgggactcctgggatgctagtaagcctgtgaacaatgcacgggaagccatgcagcaggctgatgactggctaggcattcctcaggtatgctcccggactgacccctgcagctaaggggtgcttggttaaagtgaagagagacccaatggctcttgtcttctgtctgtaacaggtgattaccccagaagaaattgtggaccccaatgtagatgagcattctgttatga

SEQ ID NO: 35886 - DNA, 1197 bp, Mus musculus
gacattattcgctccgccttctgcagggaccttggggaaagaaagtcccttgtaagggtgtgcctgctggagctgagcaattctgtgacagaattgctcaagcgttcctagatctggggtccgtttcctgtagtactgtagcggatgttgccagacctttttgtgctctttggggctcaaagaccctttctgaagcagcggggctgagttgcttttggcggagtgcagaggcagcttcgggggatgggggcggggggcgttgtggggcattccaacgggaggggcgaggtggggcgggcgcggcccagaagccccacccagaggctccgcccccaaggaaactttgcctctggctccgcctttcgcatacatttaaagggctcgctctttccgcagtgcaacctctgttctgtgcctcgtcgttcatgctcggaggtgcctactgctttaattaaagggccgtcccatcggcgaagctgcagcaccgcccctccgttcctcgcgcctcaaaatgagtagctctcactcccgctgtggccagagtgcggcggttgcgtctccgggaggcagtatcgattcacgggacgcggagatgccggctaccgaaaaagacctagcagaagatgcaccgtggaagaaaattcagcagaacacattcacccgctggtgcaatgagcaccttaagtgcgtaagcaagcgcatcgccaatctgcagacggacctgagcgatgggttgcggctcatcgcgctgctcgaggtactcagccagaagaaaatgcaccgcaagcacaaccaaagacccactttccgccagatgcagctcgaaaatgtgtcggtggcgcttgaattcctggaccgtgagagcatcaagctcgtgtccataggtgagggcacgggctacactggggcgctgagtgggtgcgggcgtggtcgcaacaaattcttcctttcttctcctctagagtctctcctagttgtcttccctagctgctgcacacaaccaaggctaccactaggccccttagccgccttgttctttgaggtcctcgagaacaaaaggctggcctggcgagcatgcgaaccgctacgcgcccccgcccgcagcgccttgctggcctgctcccaggctgagctcacatcctctgtaggccgcgcccccaacgctgcacccgaggtgggacaggcacagactaggct

SEQ ID NO: 35887 - DNA, 1431 bp, Mus musculus
ggacgactatgcggttttgtccgatactgagctggccgcagtgctacgccagtacaacatccctcatgggcctattgtgggtatgctgcacccggtggcgctcagaacctctcttggtccactgctttcccgcgctcctccctgagcgttctccccacctctccctcccctcaagtcccctccccgtgttcccttgtgctcttggggtgctcggctcacgccctctgaccgcttcgcaccctgtgtctgggcaggttccactcgcaagctctacgaaaagaaaatcttcgagtacgagacccagagaaggagactcttaccccccaactcgtcatcttcttcattctcctatcagttctcaggtgagcccttaactgcagagccccaaagagcagcttggggcacacgtcttagggagggagggtgtggccgaagctattgagggagtagggggaaggctggagatcgaatggtcctgtccctcctccttcacatgcagacttggattcagccgccgtggactcagacatgtatgatctgcccaaaaaagaagacgccttactttaccagagcaagggtaaggcaggtatagggtgggcactgatgtttttatcccatgcttccgggatttgggcacagggaaaccccagacctccctcacctccttgtaccagttctcagtggcttcagaggggagaaactgacacagcacacacaggctggggagggagaagaggaggccagttaaggggcaccactttttcctctaccactgttttcctccccaagactataatgatgactactatgaggagagttatttgaccaccaagacatacggggagcctgagtctgtgggcatgtccaagagcttccgccagccggggacctcacttgtagatgctgataccttccatcaccaggtgagttggctggtaggtatacctggggtgcagccttagggaattctaggtttggataggtgcagagagtggatcttaggctttcaaatctggttagggtcagcatacagctgtcgggttaaaaattctatgttggaaccttcaaaactattggatttggggatgctcagcagaagagtatttacctatggtttcatctccagcagcacataacaaatgttttggggttttggcttttttaaaagatttaattactttaattatacatatgtgtggccaatttttgttagtttgtgggtatttccccccccccacttcacccccagtaatgaaaaattcccagaattccaaatatcacacaattgtagaaactatctgaaactcacagaaacacacctttgctaaaagcatgaggcaactcatagttagctgctgtgaagcagccccatattccacacctaagattaaaacaaaaacatattcttacaatatttctgtgtttcttaaa

SEQ ID NO: 35888 - DNA, 1451 bp, Mus musculus
atgctggaacaaagtcaacagggttagtaactgagcagcaaggccccacagataaagaggctccacatactcagaatgggggaggggggggcaattttctggtccctatgatatgattagagcaggctagccagagacatttaaggaaaaccattcttccccatttctaatcctaattattctgcaggtgcgtgatgacattttctcttctttagaagaggaaggcaaggataggtgagtagtgaacatatgtagggacagggacaaattcgagtctcagactctcctgcctacctgttgccttcttttgccacagggagcgcctcatctatggccaagacagtgcctaccagagcatcgcacactaccgccccatttccaatgtctccaggagctctctgggcttatcatattatcctacatcctccacctcttctgtgtcctcctcttcatcttctccctcttcatggcttacccgacgtgccattcggccagagaagcaggcccctgctgctgctctgggccaggatcgacaggtcccactctggggccagctgttactcttcctggtctttgctgcctttctgctctttgtttactattccatacaagctgaagaaggcaaccccttctggatggatccctaagggtattggttttagagcagctcttaccaggagttttggctgattgccttatcggtgtttgctgggggtggggagggtaggggcttttttgtgtgttctagttgggtgcaaggtctagcctaaggcaatgcttgtctcccacctcatcctgccaaggaagcagcaaatgttggccttctacagcccagtaggcctacctgtaccttcctctggagcctcctagccctattgcctctgacccttagggtaccggggtctggtgggaggacctcacttcattagaggaaaacttggtggtggcagtggtagttgtcatgcatgcctgtttgttgtcaccttttcagggggtattaacaaagaccaccctggctttgctttcatggacacaataataaacatgtttatttttaccttgttgattcttcctactgggataggagctgggctgccatggcacaggtggttggttttaggtctccaaactcaatgtggcttttccctttggttgtgcttggccttggggaaggaaacaagtgctacccacagataagtctatgttttggttgtgggctttatttctgggcctacttcctgaagttcttataaccacctagaaaaataactaccgtgtaatcaaatgtgtgggtaagcctatgggaaatgtaggcaaaaccgcatgtgacaacacattcagatactttagtcgggagaggctaacaccaacatctgaggttacaaggatagaaaagaaatgaggcatcttgccagtacattgttattcagctcctgggattggtggcatgg

SEQ ID NO: 35889 - DNA, 1171 bp, Mus musculus
tcactttgtagaccaggctggcctcaaactcagaaatccacctcccaagtgctgggattaaaggcatggaccaccatgcccggtgtgttaattggcatttcttgtgtacttgtggattatatattataatttattcaatgtcctgacaccctgtttcactgctgttatttccccattcagcactggaggctgcccgtatttgtgccaacaaatacatggtaaagagttgtggcaaggatggctttcatatccgagtgaggctccaccctttccatgtcatccgtatcaacaagatgttgtcctgtgctggggctgacaggtaagctggtgttttatttggttttgagacagggtttctctgtatccctggctgtccgggaacttaatgtacaccaggcatatctgagatctgcctgcctctgcctcccaagtgattaaaaaccaccactgtccagcagtatttttagggatttctttgattttttgtgcagctaattaagccgaccaagtccccttttcccatggggactttggtgtgcaatggttgcaaacagcagcctccttggtagtgtatgtagcctattatctatatgggctgcctcaagggaccttggagacaattttctggcagttggtaatcaggcctctgatcacaatgttgtccctgatctaggctccagacagggatgcgtggtgcctttgggaagccccagggcacagtggccagggttcacattggccaggtcatcatgtccatccgaaccaagttgcagaacaaggaacatgtgattgaggctctgcgaagagccaagttcaagttccctggccgccagaaggtaggtagtggtatttaagttcttctgttttcttgctctggtcctccttgctgagtttgttattttctatttccttctagatccacatctcaaagaagtggggcttcaccaagtttaatgcagatgaatttgaagacatggttgctgagaagcggctcattcctgatggctgtggtgtcaaatatatccccaatcgtggtcctctggacaagtggagagccctgcattcctgaaggcttcaatagttctcctataccctaccaaatcgttcaataataaaatctcgcatcaagttcgcttatgtttttgtttctgattcttaaataccatgaggt

SEQ ID NO: 35890 - DNA, 1171 bp, Mus musculus; identical to SEQ ID NO: 35889

SEQ ID NO: 35891 - DNA, 1099 bp, Mus musculus
ctatggatggtgctatgggaaatgaactgctgcctccatcctaaagtggatagaccaggagtgagccagaatctacttcactagggtttggagagtttgatttcttctccagagaatggattaaggagaacagacctttctctacaggagatggtgtctaccagaaagggatggacttcattttggagaagcttaaccatggggactgggtgcacatcttcccagaaggtcagttgggtgcttgatcagggccctccagcattcatggttctaggcccaagctttttctctgtgttctctcattagggaaagtaaacatgagttctgagttcctgcgcttcaaatggggtaagtattgctggccagcctgacacagctaacttccccatccaaagatggccccttgggtccttggcttcgttcctctctcaggtgggtgtgtcaggagcagtagaaaagggacaggcggtgagtcaaggactaagttccattgagagactgtagaagtgacattggccagacgttggcagggaagtttggcccagcttgtgccaatgctttggcatttctccgaagtaggaattggacggctgattgctgagtgtcatctgaatcccatcatcctgccactgtggcatgttggtgagtcatggattgggggtagggaggggactgtcttagatgtcgttaagggggatttcaggttgttgggtagctgagagaagtacctgggattctctctggtaccctgcttctcccaatggctggctttctatccactgtggtacaggaatgaatgatgtcctccctaacagcccaccctacttcccccgctttggacaggtgggtaggcactgctgactcttgtctatctatttccctgctaactgccctgtgtttccttgtccatactatacaggattggttgaagatttgctgagcatgagcatgtagtaggggagctaagtggggcttttctggaagcaagacctttagaaaaagaattgaaatcaggcgggggtgagggacaaggtagagtgggacaaattattgataggatattgactagactggcccttggataccatcaagcccaatt

SEQ ID NO: 35892 - DNA, 1227 bp, Mus musculus
gttctcttgtcactcttcagatgaggtcatcggacaggtactgagcacactcaagtctgaagatgtcccttacaccgcagctcttactgcagtccgcccttctagagtatgtactcttctagcaggggccctggggaatgagggtgtgaggcaatgtggtgagtgtgactagagatgaaggggtatgtcacaggcaggatctctcaggaggcttcagtttgggggattaatggacagaggattgcttcctccatccatggtgccttttttcattttgcttatgagccactttgggcagtgtgattgttagtttagggagatggaatatcaggtctagggactttcagatggtatacagggtaaccagtggggaaggaataccagtccagtggattaggttttgtttttagggctgttgagagaaggcttgttggatgtttctacaggtggcccgtgatataaccatggtggctgggggtctaggtcgccagctgcttcagactcaggtggcatctcctgcgatccatcctcctgtgagttacaatgacactgccccaaggatcctgttttgggcacaaaacttctctgtggcatacaaagacgagtggaaagacttgacctccctcacctttggtgtggagaatcttaacttgaccggctccttctggaatgactcctttgccatgtaagggttataggaagagaaggaagggctatcctatcacacatggtcttcctgtcactgtgagctcagtacaggacaaggatgtgggattatgtttgtgtggtatgttcaccaaggacatagatgtcacagtatcgcagggtgatattgctgggaggttactggtgagggagcctcttaagagtttggccttctcatgtttttttaggtattggttgttgggtcctgagcttttattaccacatagtcccttgggatcctggaccgtttttgaacccaacccctgggactgcatgtaggcaaatatcaaaccaactgttaaaaccagtcctaggtttcctacccttgaaacctcagcaggcagctgaataaccccaagaaggaggcctaggaaccagaggaaggaatcctaagttggagatgtgaaacctaattgtttcacaactgctcctgatttgcttatgactggaactttacttttcccatatggtaaatggggacactgtattggcaggtgactataaggatggatctagggcagc

SEQ ID NO: 35893 - DNA, 1333 bp, Mus musculus
atgcttttcatattcacctatggtctgcacatgatactcagcctaaagaccatggatcgctttgatgaccacaagggccccaccatcactttgacccagattgtgtgacatacacctgagaggaattgagggagtattggtgtctaggttgtcatgtttctgttttgtgacacagtggatggaaaggtttgtcctcttcctactatagcatgaaccctacatacgccaccctcagtctctcttgcttcctctttaacccggagagggactcccctgtggctatcccccatctctaccaacaaagtgtattcttcatagatattagataaatcttccaggcttcatcatcaagaggggaagggaccttaattctagggtctcccctttaccctctctccttatttattcttgcccctctgctattattccttgctgtttatagtgcttttgtgtagtaaatgctcactccccaagctttatggagcttccagcaacagccatgaacttgaggttccttgaatttgcgaggtgtggaaagactacttgactgtctgtccagcttagctgttatgttttttgggggggaggggtgatgtgttaagagtgagtggtacactggggtttatttctgtggcctgggaaggaagaaaccatcacgaggattggtgaacaaagtgtgctcactgggtttctggattattcccataaagactgcctgtcaagaggccggaggtgtgtgtggggggttgctctgttgtttccttcctaataaaataaagacgtgttgccttgtgttgggcttcgtgtcactcatttctgcactgaacagtagatttttttttcttgactgaagggaagaagtgctcagatgtagtccagtcatgcaagaggtgagagaggaagggtgggagggtcttcagtaagctgatactcttaacaaacctacttagagtagaggcttgttacttttcctggccttgggaggaatcctgacaatggtagctccgctactgtgcaacaacacacagcagggcttccataccttgtgtttctcccagggggcggtacgggagcgcgcggggcggggcggggcgcgcgcggctcccgcgcaaggatctttcggaggactcagcacctgctgccggcctgccccgccccgtatttttctgggctcacgaagagccccgataacccctgcagtcattctggtgctgggacccaggtgacagaagccctcccagaaaacaagcaaggaaatgatgactggttgggcggggcggggccagcggagagagagagggactcattaacgctgcgtagggatcaggagaca

SEQ ID NO: 35894 - DNA, 1333 bp, Mus musculus; identical to SEQ ID NO: 35893

SEQ ID NO: 35895 - DNA, 1706 bp, Mus musculus
cttctttcttttcttttatttgccccttaggtttgtggctatcagtgatttatatgagcccattgatgatggttcagagagtcaggtaaaaatgctgtcccagtcagccttggttcttgcagtctatccaagatcctctgcctgacttccgtgagccctggggttctgtctatttacaggtgttctgttcctgctcctatgatgctaccacacactttgagacaacctgcaatgacatcaaagatatctacaaacgcatggctggttctgcctttgattttgagaacatgaagcgcaaacagaatgatgtctttggagaagctgatcagtgattgctgactcccctcctccagcccctgttcccctctccccaacttgtatgtccttctctagggcaggggagatggtatggctaggcatccttgtttccagcatcttctgcttcccctaccacattccaatcacccaccttattgattttattcactgaccatatccttaaccttagggatggtttgggagatgggagttggatagtatcctctttcttggtctgtccttgttctagggaaagagaactttgtgtgtgtgtgtgtgtgtgtgtgtgtgtgtgtgcgcgcgcgcgtgcgtgtgtgtacgtgtgtgtacgtacgtgtgtgtgcgtgtgtacatgtgtgtgcatgtgtgtgtgcatcgtgcacccccaattttgctgtttgggaaggagtggaggaaaagctgacccccacccccactgctcttagtcccaaatgtagtggcctttggagatacccatctcctcccccaactcttaggtgttggagagaagggaccctcccagcacaaaattgcattcctcctcctcctcctcctccttataatttattctaatttattaactttggagtaattgtctgagccctcagcctttctgtgcagcctagggctgtagagtgagctgccctggcctctcccagtgctggcaaagcctgggatgggagaagatttaggtgtgaccccctctggaggttgatctgttttgaatttcttttgtgttgtgttcactgagaaaaagtaatgtgagcaaagcagaaggaggtaggaaagtggatccaaaccccagtgtaccctgccccatgccttttcctttagtggtgggaaacccttaccttgcaaagtgaatgtgtccccttccccaagctctagtatatttcacagaaaacaaaaacctcccaataaaactattgaaacttaagcctggctctttaggttctctgctttaaggctgttttgcaggactggggcaatttagcttctggactagaactgtatccgcaaggatcaaggcaggtgaagtaggtcatctggtgttggacgggtcatcatttactagtggtttccaaatcagaagtcagtgtggaggttttgggttcaaggctatactgacctctccgaagcagaatagcacaggtgagatggttcaatgcataaagatattttctatgtgaccctgagtttgatctttggagcccatgtaaaggtggaaggagaaaactgattccacaatatgacctctgcacatgttcagtggcttgtgcacaacatgtaaacaaacacatttaaatttttatgtgtatggctattttgcctaggtgggtgtgcacaacttgcatatctgctgcctgcagaagccagtatctccagga

SEQ ID NO: 35896 - DNA, 1196 bp, Mus musculus
gaggccagcctggtctacagagtgagttccaggacagtcagctacacagagaaaccctgtctcggaaaaaacaacaacaaaaaaatccaagcaaccaaatgtgtcagtgtgtgaccaagcaggaggaaaaacagcctccgtgggaaggggtacacctgactgagacatggctctcagttccatcatccaagttgggagcagcgcgctcagccttgggactaacagaaagaagttaggaggaatggagggccagcttaagatagcatttaactttgagggtgtacaggaagctagaggacccagctccatgtcacaaggaaccagcagaaagaactggtgatttcgcattgggtatgggatgaactcgtccggcctcctgtgaggcggggcgaggtgcgatcacgtgtcagagccgcgggcgtagggcagggcctgcgtccgcacgttccctggtggctgacgtcacgcatcagctgactaaattgccgccgccactgccgtcgccgtcgcctccacgacttctccaagcaaaagtcactgttgccgctgtcgtcgctgccaacgccgccgctgccgctgccgctgccgctgccgctgccgctgcctccgctgaaaccgccactgccttcgctgaaaccgctgctgccaccatggcccagtacaagggcgctgcaagcgaggcgggacgcgccatgcacctaatgaagaagagggagaagcagcgtgagcaaatggagcagatgaagcagaggattgcagaggtgtgggccaggccggggcacctcagagcttgcgctccgcgcggaccccctggcggtctcctgccactcgtctctgggagacctcaacagtgggctatgagtgcccggagggcgggccccgcgttggtggcgagacttgctgtgcatctctagtaacagaagtcagccgagacagtctaatctataaaatgggctcagtgttggtccatgtcagagatggggagcacactgatgttgggtgagactccttggcactcctcctgagtacagagctcccagccttccaatgcttattgggaagaccccacttcctgtggagaggcacaggggtatgccactgagtctcactcattacagagtactagagtttctcccagggtttgtttagtgagtggtcgctgcattcagaagcgcgataccaagctgaccacagct

SEQ ID NO: 35897 - DNA, 1150 bp, Mus musculus
ggtaggcagtagaaggcctcccttggcttaaattcaatggaaagtaactgacagtcttgacttgggaaacctctgtgggtagcagggtgggtctctgctttcttggaagtatttctttgggctgttgttttttcttttcaacttgaagtatacctacttctgcagatgaagaaaggcaacacgatgcagcagttcctacagaaagcactagagatcttgcggaaagacttcagtgaactcaggtgagcagaggatgcactatgtgtgcctgtgctgtgcatctgtgaggaggctgacttcccagccagggcatcagacaaccctgctgactgctccacagctgggaaggcggaatgctgggcactgaaatcctcaaaaaggagagctgtgctcttttttcttaccttcctgctgtagaaagcataggtgagagagccctgccttggtggtatggtccagaagtggaggacactggaactcccgtcccagattcattaaactacacagcttcccttaaactttaaggcttaaagcactgtggccagcacttcctggccccttgtggccactctgatgacttctagttgttgtcctctcctctttttcctgtaggtcagcaggggtggaacagctcatgtacatcaaggaggatttaatcatcccccatgtgagttccttcaaccctgggtcatgcactctgtgctttcataggagagtcaccatactgctgtgcactcttccagggctgctgaacgcagtgatacctgcaggtagaggtatggggaatagtgggtgataggaccccagaaggattatcaagctggtctttctcatcctctgctcctagcatcacagcttctatgacttcatcgttaccaaggcacgaggaaaaagtggtgagtaattctatcttagttcaccctgtaacttgctccaacatattgaaggagaatagcatggccttgagcttactgcttctctcctacagggccactcttcaacttcgacgttcatgatgatgtacgactgctcagtgatgccactgtggagaaggatgaggtatgatggtgccatggcactgggcaggcaaaggtgccctgaacctgtcagggaggttaaccttggggagaagtcaacagaaaggcaaggt

SEQ ID NO: 35898 - DNA, 1119 bp, Mus musculus
ccctctgttcagcttacctctgcgtttctgggtgaatgtgatcaagaatccgcaatttgtgtttgacatccataagaatagcatcacagacgcctgtttgtcagtggtggcccagaccttcatggactcctgttctacatcagagcaccgcctgggcaaggactcaccttccaacaagctcctctatgccaaggatattcccaattacaagagctgggtggagaggtgggccctgggatactgctgtgtatgcctggtggcaggcaggaactgcctaaacagcctgtctgaggctggccagatacaagaaaaagcctcagaggctggccaaacactgatggcatgagttttggcatttatgacctgtgcatgattcactcacccaaggtctctataggtactatcgagatatcgcaaagatggcatccatcagtgaccaggacatggacgcctacttagtggagcagtcccgcctccatgctaatgacttcaatgtcctaagtgcactcagcgagctctacttctatgtcaccaagtaccgtcaggaggtacgttgatgtacctcatggacccccagttgcatggctctgatgatgatacagttaggggcaaaggcagggagatgtgttgagaagcacacaagcatgtaagcaagatgggacaaagtccatcttatatcttgtttacagtccatcccttgcctagggccagcatgggcaataatttctttagatgctaggatttaaggaatacaggagacaatgcactagctggaatatagaggtcccactggataaaggttacaagactggaaagtgagaacagatgtattctaagcactcatgttaaaatattggatgtggtggcatgtgtgggtatgggtgctggtgagtggtttagataggcagattcccataactcactagtcaatcactgagttctatgttcaatgagagatgtcaaataataaggtggaggggctggagagatgattcagcagttaagaacacttgctgttcttccagaggacctgagtttgattcccagcacccacaaggcagcacatatccctctagctccagttccagggaatctggtctccttctgtggcttctgaag

SEQ ID NO: 35899 - DNA, 1195 bp, Mus musculus
cctcacagacctcttctttggttgatctgggtcctgtttcctgttctggttcctttgtgacactgcaagccttggctcagcctctggcgtctcacatttgctgtgtcaggccccacttgtcctaagaagagatcctcagtaccagcagcatttggggttggatgatgcatctgaagctgccctcagattggccaggccaggccaggccagggcaatatccctcttcagatatctcaggagtcagaccacattttcatggggcctgttgtctctgagagaactataaccaggctgtgattgggcctgatgagggcctgggcctctgggacattcctcacgtccctactgccaaatttcctcagtgttgtaggcacttgccctgaactctctcagcctcagctgccctatcacatgcccatccttaagggccaaggtggcagtgccttactgttttgtgtttcctgcttcccctgaggaatctggccctgtctaatggtcccagacccccagtccgctctccttctgttgcatgagtttttcttcgttgttgtaattttttcctaattaaatgttgggaaatggggtcagtgcatgtctttgtctttggagaaagtgggtagacctgttgggctatggatgaactagattcccactgaggggaaaaatgtaactcacgaagacttctgatgatttgaggaaggccatgtatagtccattagacaatccttgtggctctagtttcaagactgaataaatctgcttccttctccttgcatgtactgtttccactcagatatgcccagctccctgcttttgccatgacccctttagcccattattagttggagacaaagagatactattaagaaataaggcacatgtctccattgtgttaaaaaaaatcttcagtgggggctggagagatggcttagtgtttaagagcaccagttgttcttccatgggactcaggtcaatttctagcacacacatagtagcttacaatttgtgtgacttcagttccaagaaatctgatgtcctcttcaggcttggtgcatagacatatatgcaggcaaagcacctatacacataaaataaaatgaaactaatttttaaaaccctcttcaatggctgcagttgtacccaaaattctgaagatgtggcaactcattggactataattaccattgtactgaac

SEQ ID NO: 35900 - DNA, 1195 bp, Mus musculus
tactgttatgagttgtaatgtaaatatctgatatgcaggatatctgatatgtgaccccaacttgggtcaacccacagattgagaaccatggtcctaaatgctaagatttcttcaggcatcaccacaccaggccacttgacagttttttggtttgatagtgttttggtttttgttgtggttttgttttttagaaaatatcaccttaggtcccttttaggaaactgtagggacaacttggcatggtgatgcactttggaggcagaagctgaccagatcaacctataaatccctggagagtcctcctgcccacccccaccccccccccccaccgctcctccccgccccgcctccctcccccccccccgcccctcgcccctccccggccccaccaccttccccgttcgcgcaggcgcgtgtggaatggcagcctgtgcgaggggcggagcttccggaggataaggcgggttctgggccgcagcaatggcagaggcggcgggctggtaacgcgaaggtgggttgaaaggaggaacagcagcagacatgcagacagcacacacaggtttaagccacactgcagatggcgccgatggtcagactagccgctgttgtcctggtaatgcaggcacaaaggcagttattcccagtggagctcaccctgttgcaagagcactggaagcctcccgaaattccagcaaaagcatggtgcctttaacccaaaggcctggaacccgacatcacagattgtatcctaccggacatggacatatctgcgggatgcttgaaacagggaagcgggtagtctggaggagggtaaaaaaagaaagaaaagaaaagaaaaaaaagcagggaggagggaagcagagggacccgctgattggggtatggcctgggcatgaaaagttccttgacaacagaggaggggcagcagggtggagggaaatgagcaggaatggcccaagcaatgtggaagatatagcctggggagcttagaccagatgcgatgattttagaggggtaaggaggcaaagttgattcaagatggtgcctttcctgagtctctaccagctccctcttcgtgcctttcccgacctctttggaggcagaaatcgcctgtgggtccctagttccagatgtcgaaccacatcgaggactggtagggaaggagcttaaagtgagcggctgcatgctggaggtg

SEQ ID NO: 35901 - DNA, 1489 bp, Mus musculus
ggccacagctgcatgttgcattaaatgtgttctcatgtcgcagtttggctcatagtgataataatagctggtatgtatccagctcttgctaggtgctaggtactcaaagtacatggcctgagttctcttctgcctcccacagcaaagttgaggctgcactgtagagacacctagcaatggcttgggacagacagggtccaagtctagccagcctatagaagtgcctctgtaggagaaagagtgtgctgttttcagagatgggtcttagtattcccatttagcccactcagcatacaccctcaaaagactccctcaggaaaccactagttcctgtcacctgccctctggtgtgtcccttggcaaatctctataggaggccaagtgttagctatccagggcccctccactgctgcagccagtgtgctcttgaataacaagcaggttaaggggctggaggatcagaaagataccccagctccatcatagtttgagtcatgtttctatgccactttggtccccaaccaaagtgaatctgtcccatgttaggcactcctctgacctgaataagtttcctttctcctttatcagttcaaggtgggagtctttgctctcatcacctgcagttccaccttgtgttcagaaagcaaaagtgaagtgatagccaagcatgggccactagatggagtatcctgggcctttgtagcatagctcttctctggagcaccctatttgcttggctctttctggaagtaggtctcacccatgagggacaacaggtgactcagaaaggcagtgtcacaactagaacactctgccttggtctccttatccagtgctcacccacagtatgaaatggatgcttcctctgccacctgtatacaggggcttttactttgcacaccttcattgcttaagaagaaactcagggtgctgagaaagatatgtatgctgaaggctgtgattcctctttttattgtacctatgcctgggtgctaaaggtcatgtaaggactagttcctttgaggaggaccccctgggagcagtcaagctggaagatagctacctgcaagacactactgtccctctacttttgccaggaaagccactctactatgaatgttattggggctacacttgcctttcttgcccaagggcctcctgcatagaccttgtcggtcaaatcttgagtccttgtacagaaatgatagaggcctgagggggtgtgcaggtgatagaccctggtactcctaagacctggggtatcatatcagggacctgcttgtgaacatgtgtatagagtgccagctcagataataagcttaccagtgaccttgttcactttgagtcagggaacgtatttgtaaaattaacactaaagatgcatgtgagtcatttcaccaaaaggaactctattaataagctagactgcttttggtttccagtaattggtttaaaaacacagtaaatttactggcttataaagctgaaa

SEQ ID NO: 35902 - DNA, 1234 bp, Mus musculus
gattgatcgagaaaagccccagcccatcccctatgtatatggcaggtaagggaaggatgggagctaagagggccaagccaaatgaagcagggcagtgggaataccaaggataaaggtcactcatgtctctcctttacctcccagccgcggccccacagaggcagatgagctgatgaagagagtgggcttccagtacgagggtacctacaagtgggtgaaccctcacaagctctgagccctggaagttacaccatctatactctgcctcttctggccaccctttctgcatcttcccttttcaccatctaaccctatattaggactattgaccccatattggaaggactttgggaccataggccttagatacacattctagttcctgggcttggaccgccattttgtcctatgctgctgccactgccaccaccagtaaacccagctacattcctcaaataccaggcatttaaaactcattgtagggtttcagggccaccactggccctatctgagccacccatctttccacaagacctgaatcacctcccttccagccgctgcagaaagaatgcctatcagtctgcccctggactccttaaggagttaggaacaatggggaggagccttaggcctcaaagggacaatgaccaaaccagacttcccagaggctatgggcaagctcctcaaaacttgaaggaagtggtcaaggacacctatgtgagaggacctgcccatggccacactagcctcagtgctactagacattcctcctcaccagatggaagagacctcatgctgcctagcaatattttgggggctctagatgtcccctgaccaattccatactccatggtcaacctcatcccacctatgggcagcctccttaccaaaggaaggcaagcacagcagctagaattttcctatcccaaccctgccattaaatcctcaaaacagttttacctgtctccttgttcttttctccttgcatccaggatcatgaaggagagacctattatttccccacttcccacatttgttattcagggttctataaaagaacagaactgataaaacatatactagagttgcttagaagctacagtccaaatagtccaacaatggctacatattttgaggaaacacctgaagctgatgctagagcagtctcttaatttgaaatcttctgagggctcagtaggactgagaagttttataactgttgctttataccatg

SEQ ID NO: 35903 - DNA, 1117 bp, Mus musculus
cactgtccttagtcctacctcacctcccttgggtgacttgaagccaggcagactgtcagttgcaggctgagccaaaacaaggagagcaggttctatgtcttgttaatcccaaagagaacaagaacaaacagctctgggtgtggggcaactgtgactcagcagaccagtcccctgccaccaacacattggctggagtctgtactgattcctcccagttagttggaatttgatcataagcaaacactgtctgcttagaaaagtctacaagccagggttctcattgtttcttttagtttctagttcccagcaagccagtcctttccagagtgtgtgaggacaggataaaaccctctgaacatgagcagtaacccacatcccactgatggaagatcatagaggcaggcattgagagcattctgaggaactaagaaccatcctggggggaaatcctggcccagaattggacttgtctatgctgggctttgtgggacctataagggcaaccatcttgcacaacagagtaaaagctttgcccagcagagtgacttgggggacagtaattaggccactcaggtggccatgcttggtatcacatgaggaagtgacagatgaggaggctccagagcaatagaagcccagctggcagcaagtcttagacattttcctaaagatagtcatagcattgaagttacttactggccattgggctcaggctcccagaagttcatatggaaggtggtagttatcataggaacccactcgccaatgctcaggactttaattctgagcagttgacagacatgggcactgaattgctcgctcatgccaacacagggtgttagggtttggcaacagtcctctatgaaagttttgggaacccagaacctagaaatgacatgcacacaattgattccatggaccggtcactcagcaaacccctgagaacaaacattcaagccatgggaatccctgagtgcccataactatccttatccagaactgccatttcccatagaaatgggctcatcagtgcagctacatggttaactctcttttgtttgttaatatgctaaccaagtctactcagcctcagccttccctgagcctctgctcccct

SEQ ID NO: 35904 - DNA, 1186 bp, Mus musculus
cgctaatctacaagtttttaacccatccctttgtatcccgcactttccccgcattgggcccatgaggactagacctttagaagagaagggactttcggggatcacccaactgggccagaagagagccggagctgaactccatcatctgcacaatcaaacgtgctcagttcattgtggagtttctggcagacacccgagtacgatacgatggtcccatatacagagtgtgatgccgtaaccagattttatctagctgcccacagtggatgtcctaggtgaattatattaaagctttagtactttcgtaatgtacagcccctagcgaaggcaactttggaggttatggctggagctcagaggcagcagtttctgaatctccgaatgcatgtatgctcgcgcgcgcgcgcgcgcgcgcgcgtacacacacacacacacacagagcattcccggccagtggttttagtaatcgtcaccagcctggtgagaacccaaaagacccttggataaggttaagttgtcaatgctctttcgttctcctaccatatcaatgagtcttttcttccaccagaaaacatcatggcagagcaggtggccctgagccggacccaggtgtgtgggatcctgagggaagagttgtaccagggtgatgccttccaccaagctgatacacacatatttatcatcatgggtgcatcggtgagtctcccttcaggccccgagtctaaaagatgaaatatagccttgtgcaaggcacttctctctctctatctcaactttcccaattgacggaactgctgaggtacccacaagttctactaggttgaactctatggcatatactccacctgtgtgtcctgatcatcacagcagtacctgatatacatgtacttgtgtcacatctcagaactctgtgctgagccattgagtggagaccagacttggaccatcacaggtgctaaagcaccacccagtagcacttcttcctcctggatgaaaaaaaaaaactgatgtgcaatcagggaaaattctgattttaatgaatctgtaatttgaaaaatattactgttaatttcagtggaagaatctgaggtcctgcctctccctcttttctttctacggcatgaagttccctagggataaacacctcctctttgccatatcttccaaagcctactgcaaatttctg

SEQ ID NO: 35905 - DNA, 1212 bp, Mus musculus
gttttgactattacagaagtgcaccccttgttccacattgattgttagtgttttggggcctagaagctgttttatactcctacttacccattctttactcctagttttttgactttggaattatgactgctttgtcaacagaaaggtatttcacatgtatgctttcctttttctagccccagtgtgctcttgtttttgccaagcacattgttaccttctgtgaatggtggtggccatagttcatcacactcctggagtttgtgatcacatgttcttcaccagccaaaatgtcctagggaaccatttagcagtgactgactgatcacagaaaagggaacacttcacttgttttgcaaggttctagacattttgtgggaccttaccgtcattggtattagacctgcagttctagtaaaggaaaggaagttgtagttgagaaagcaataaatatgccttgctcattccttaggtctaaatccttcctgccctcctgtaagctttcatggttctgagtggtatctgtgaatccatcccgggggcttttatttacatggtttctttcccattaagagtgagaaggctaagtagaattcagattataaaaaaggatttaaaaagtaatcctgagctgggggctttctcggaattttcaggggatgcagagtaagttttccatttcctaattcccaggtatctatcagaaagatctttaggaaaatgttaaaggaacaaacaagttctttgcttatgtgttttcatttaaatacctaatctataattttcctttaggaatactattggtttaggttgagtccagttttgtggtggtatatatcacttttctatagctgctttaaaatttttcctaaacttggaagagcaagaacaacaacaacaacaacaacaacaacaaatcactctttcctgtctggaagccacatattaagttttttctggaggctgtgagaatcaattccaggcattctcttaactttcagtggtttgtggtagtccttggtgttgcttggctcatagacccatcactccagtttctggttctagggccttgtggtttcttcctctcttctgtctcataaggaaaccatgttgtgcatgtggggtctatttgattagattaaggaggatctccagttcaagacccttaactcattccacctaccaagatcctttccccaaataaagtcttgttct

SEQ ID NO: 35906 - DNA, 1145 bp, Mus musculus
cacctaacaaagttcttcaggaaaacagagaaagattctcaaggatcatgacctcatctttcagtgccatggaggtcaaaattaaggatgttctgaaaacccagtgtgaacagaggtagggttgttgcttcttgtcactttgatcccagagctgttgacagttggtttgtgagcacaatgaagggggaatagccagtggccccactggctagaagctttgttggcaagtgaacatgccttgttttttctgtaggacagactttgttttgtcttataccctcccgttgtactgaagtcagtcatctgcatttcctaaggatgaactaagatgttttgacacagggcagttgaatcagtgtaacagtaagtaaggtgtgggcattgtgtgaaagtgctgggtgcattgagcttgaaatcctcaaatcatccatcctggagtccttcatctcttcagtgtgaaatgaaatgaaaatctctagcctccaatgttgtacaggtttccggaggagccctgttcaccatgcaggtatgctgaaatcctcacaggtacagtgatgaagagtgggtaggtgtccacagaattctctgatggtcgtgggtgtgcatcctcattggacctatctttataatgggaaaataaagcagggattgtgctcgtcagagagactaatacttgtggaatgctagtaagacaatcctgagttttctagcactaaaagctgtgaagtgactcctgtctcggccaaggagggacacgtgctattagggtggtaggaactaatccacctcattttccatttccctgtcagaatattttagatctcctttcccagccttgcatttagtgaaggaaagtcagtcgtgctgtgtttgaatgggctttcttcatgtcgagaaggaatatcacagtgttcacctttgtcttttacaggcagaaactttgtcaggactattctcttcagtttacaaatttgagtaggaagttaacttcggatgcatacaaactcaagaaacaggcttagctttaaaggagtccatttcctcagcatcagaggtagcaacagaggcttcctgcagcaggtctgtagggaaggggcaggacatgagctctgggagttaaggagggtggttgatgtggaggggag

SEQ ID NO: 35907 - DNA, 1208 bp, Mus musculus
gtgtgattctcataatactttggagcacaaaagccaatatgaggggagcagtataatcatctgggtgaagcttctagtgctgatgattgcagctttggtgcctggatcttctcctgtcttcctcctgtttctgaagatgccccgttctgttaaaatccaaatataccctaggatttgtgtgacagcagtgcaaatatttctgtagggaactccagccctcgggtagaaatggcaggctttccttggtagcatcataattactggttagcacacattggtgttggtacagtagattatcatacctgaacatcatctccccaaattagaaggcacacaagtgggctattgttgtcgtgtccagataaataattagagaagatacaggctttctttgacattctgctctgaaatgtgttcagtgatggagcctatgaaactgaccttcagcctccaaaggcagtgtgctcttaatagttaaagtagtagaattcatcaaacctcccgagtaagaaagatgtgagtaacgtggcttgaatcagtggaaatgccatttgcagacaacatttacaaggtctttctattaaatgtgtctgtcacactaagaggtgattctgaacatgaatacagcttaattcaccatggtttattaatccctcacttgtatggataggagtaacttagaatgttttgtttgtggaatttatcgcacatgtagtatgggatcatcagggatattatatatgaggtctcctgtacagttaaagctcgcatcctgtgatttcctgtatgtataccctgggaaatccttacttgggaacgtttgatttaataaacatgaaatagtttcagacttgttggcatgagtcatttaattgcattctctttctgacatccctgacgtttcaccccttctcagacagacatggccccatgccatgtggaggtgtgctgtcacctgtgttcctgcatggggccagtgtagtctaggccacttgtctcattgtgtcccgttgtgtagaagcattgaaaacaggctgtgttcagcctcccccattttctccaagtggaattccattcctccagactgaatgagggcttccctgctgggatcattttactgtctaaagtttgcattatctagaagaacttccccctttgtgcaaactacctgtgaccctatgggcctttagtattatttctttaataat

SEQ ID NO: 35908 - DNA, 1211 bp, Mus musculus
gctccacatggcatacgtgtagaagtcaaaagataacttgcaaagtttgttctcaagtgtcgtgagttactagtattgcagttttccctagtatgtaggaaggcttagtagtgtgtcattaataatgggaacaacatacatttatgggcttgaagggctacagtggttggtggtgttatttactgactcttgttttacttctattgatatgttattaaacttatgttattgctttctagaattttgataagctaaatgtaaggacagcacactatacacctcttccttgtggttcaaatcctctgaagagggagattggggactatatcaggtaggcatgctctgtccaaacttaaagtcttttgaaactgatgctctcactgaatttatttgttattcaagggagtagtagtggcagcttagaacagctttgtcctgaatatataacctaaatatgtgatttgcttttctttttatgtcttcatgctattttttttagacaagaacaggaggtgattacctttttttcttctattttaggaccggtttcattaatcttgacaagccctctaacccctcttcccatgaggtggtagcctggatccgacgaatacttcgggtagagaagactggccacagtggcacactagatcccaaagtgactggttgtttaattgtgtgcattgaacgagccactcgtttggtgaaatcacaacagagtgcaggtttgtaaaagagagagtagggggctatacttgtttctgttcttgtttcacttctacattttggctcttagaaactatttctttagaaaaaatcttaaagcacgagtgtgaattggtttctgttgttctctgccaaaatctggtggttctttaagagtttgagacactaagcatgtggatattgaatcaactgtcctgttcctagcgctgcggcaggtcacttgtatgcttgctggttctgctctttattgtgttcttggttttgcagacagggtttctctgtgtagccctggctgtcttggaactcactctgtagaccaggttagcctcgaggattcacctgcctctgcttcccaagcgctgggattaaaggcgtgcgctaccaccacctgccatgtttactgcttcttaactcaggtcatgtttctaatgtttctatctcaagtctcctttccccattttcacccaagaaaattctgcttaaag

SEQ ID NO: 35909 - DNA, 1733 bp, Mus musculus
gcaaaatttgtttaaccccaaatgtcttagatttttgaacagacttgactgtgcaatttgtcagatttcttttgggaacagtagtcataaatgttttgtcagtgggtacattgaacttacttttactttctctttctttaggacaacgacaccaccaaaaagaaaaagaagaagaaagtaaaagtggtagaagagatgtctgaatagtttaagccacttctggaagcattatgtccagctgggaagaaaaagaaaagccttattggaaaaactttttgttgagggagaacagaggtcccagagtagaaagttctggtatacttttagctgccacttgtgacctcagtggttagctggtgtggccatctcatcccatcctgtcctgttttaaggatatgagagataaaatcaggcctttgccaccaacccctctgcttgcttgaggaagccacacctttagacatggcatggcctagtaactatctgcagctatttactaatgagcattttcaacaatgccatagatagtcctctcctactttgctttttaaaaagttggtaaaaattaaatctgctacataaaatggtatagaaccttctgtgagagaaaaaatgtaattgaactatgttcactgggggactcttatctccagtgttctatgaggactgctctattcaggtattaaccttgcctggtggtatctatgatatttaggctagtactctgtatttttgtgtacaacaggatttctctatatggctacttgtgtttcttatggaagccaaagcattcctgtaccttcctatttgttttcttttaaagaatggaattgccgggcgtggtggcgcatgcctttaatcccagcacttgggaggcagaggcaggtggatttctgagttcaaagccagcctggtctacagagtgagttccaggacagtccaggctatacagagaaaccctgtctcgaaaaaaaaaaaaccaaaaaaacaaaaaacaaaacaaaaaaaccaaaaaacaaaaaaaacaaaaaaaaaaacaaaaaaacaaaaaaagaaaaaaaaaagaatggaattgttcagaatggaattgttcattgctgaagaatgtaatttgtagtttttttttttttaaaaagtattcctgttagatttactatgataatcttggactggcaacaaaagtgagagaatatttttattaaaagtctgaggtttatgtcctattttgaatttgcttttcctttggctacttttaaatttcctaattctgagtctttcttacattggcactggggcctatctgctctcaagggagatcattactaatccagggttaagaggaaaggggtagatgcatttatattgtactgggcttgtgaagaggttggaggtactccaggtaggaaactgccagttttggtgttgactgcagagggagcagggaactttgcttaaatatgtgcccaaaaccaagaatataaacacaagttttaggggaaattgttaatagcataggcaggtatagaatgcccaaacagcccctgcttttgtaacatgttttaaaccattctcttacgacttaacaagtcctagagaagacgcctttgtgcattgtgaataccagacctatagaggcagtgacaggtaattcccagagatcttatgttaatgtcattgcttggaaggttaagattgggaatggagttacagggtcacgggtactttaacacagc

SEQ ID NO: 35910 - DNA, 1195 bp, Mus musculus
caaacattatattcttaattggttacctagcagatactaggccacaggatggatcaccaccatgcaaaaaaacagatggggaaccagttaatgtaaacttgtttaaatcttccctttgctgctgtgattaaagactgctgcttcatctatggctttcttctttgcagactgaagccctgcagcagctgcagaaggactctgaggccatccgtagtcagtatgctcattactttgacctctctttggtgaataatagtgttgatgaaactcttaagaaattgcaagaagcctttgaccaggcttgcagttctccacagtgggtgcctgtctcctgggtttactaagcttacagaattggcaaacatgtttcagccagcatttggaatgccacctccccgcaccccctcccttgcttaagccaaaagggttgcttcaacttttagctctgctgttttcttactcaggctcctaaaggggtgaagctttcctactatctacatttcaaaatgatctctggaaaattgccataagaataaccaaatgcaatgctacatagataaaccaactgtccccctgaagcctgagctcctttgctttcaactatagaatgtctttttactctggaataaatatcttctgaaaactttctaaaatgccaaaatcaaacagctgtgcaatagaatgtctgctgtagggaaaatcttccaaagcaataaaaatgctgctgtgttaaagtacccgtgaccctgtaactccattcccaatcttaaccttccaagcaatgacattaacataagatctctgggaattacctgtcactgcctctataggtctggtattcacaatgcacaaaggcgtcttctctaggacttgttaagtcgtaagagaatggtttaaaacatgttacaaaagcaggggctgtttgggcattctatacctgcctatgctattaacaatttcccctaaaacttgtgtttatattcttggttttgggcacatatttaagcaaagttccctgctccctctgcagtcaacaccaaaactggcagtttcctacctggagtacctccaacctcttcacaagcccagtacaatataaatgcatctacccctttcctcttaaccctggattagtaatgatctcccttgagagcagataggccccagtgccaatgtaagaaagactcagaattag

SEQ ID NO: 35911 - DNA, 1099 bp, Mus musculus
acgtagtaaacgggctttgggacaattcagactgtcaactcaatggcttaaaaccataaactgttcaacacagtgtatcattaaacagatagaccacagcaaggaaatgaaaaagttcattactaaatcttccttatcagattcttctgtgattaaaagcaccactcagacaaatagttctgactcacacattgtaaaaacatcagcatttccaccaatagatctcaaaaggagtccattccaaaacaaattttctcatgttcaagcatcatcctacatttatgactttaagacaaaaagttcaagaattcaagaaagcaataatttcttaaaagaaaccaaaataaataacccttctttagccattctaccatggaatatgttcatagatcaaggaaaatttacctccccagggaaaagtaacacaaactcagtcacatataagaaacgtgagaacattattttcttgaaaccaactttgcctgaagaatctggcaaaattgaattgcttcctcaagtttccattcaagaggaagaaattttacctacagaaactagccatggatctcctggacacttgaatctcatgaaagaggtctttcttcagaaaatacaggggcctactaaatggaataaagcaaagaggcatggagaaagtataaaaggtaaaacagagagctctaaaaatactcgctcaaaactgctaaatcatcatgcttgggattatcattatgctgcacagataccaaaagatatgtggaaatccaaagagaagtcaccagaaattatatccattaagcaagaggacaccattttgtctctgaggcctcatggaaacagtcattcaataggggcaaatgagaaacaaaattggcctcaaagagaaaccacttgggtaaagcaaggccaaactcaaaggacatgctctcaaatcccaccagtgttgaaacgacatcaaagggaacttagtgcttttcaatcagaacaagaagcaactgactatgatgatgccatcaccattgaaacaatcgaggattttgacatttacagtgaggacataaagcaaggtccccgcagctttcaacagaaaacaaggcac

SEQ ID NO: 35912 - DNA, 1637 bp, Mus musculus
aggtggtctgctttcagtcccagggctatggcaagaatcaccagagcaagctggctagcctgcatcgtaatctctaggtccagcaagagatcctgcctcagtatataatgtaagtgaaccaggaagacacctatcaatcttggcccttcatacgtatgtgcacatattcatatatatgtatgtacaataaataaacacattacacacacaccacataatgcaaaaacaaaaagaaatgattaggtcagaatgttggatatgtattatttcatatttctcctgaagtagtcaggagaataataaaatgataagatagccatacagaatgcctatccatgtatgtactaaaccttagatgaataggaagttttgtagtaaagtaacttagtatcaaatcttctgtttttcaggttgtatcatttgtaaagaagaatgttctagtgactggaggattttttggaggctttctgcttggcatggcatcctaagaacttcacttcattgttctatttttatagttgtttgtttcttgccagcagcttctacactccaacataggacaatcggcactcctcttcctcatcttctcctgtgccttcctccctgttgtagcaaatctgaatggctttaataggcttctcctggtgcaaggtcttctcaggccttctcaatttaacacgttggaagagacagtaggtgttaactcttccagtaccctccttacttggttggtgtgtagcttaacaagaatgttccttttcccctatgtaagatccttttccaaactcaatttgttaccttattacatgttacatgaaaaggaaccaaatacatttgcctttaagcatgaaaaaattttggtatcttggtgtatgctttctttttaaattggttttaggctatagaaagagaggtatttatacttactataattatgttgccaaaatggcagtgtaagtaccaacactaaaaatattaaatgaacttctgcaaacaatgcatgaagtaatataagtattatatatggtaggtgggtctttatggaaaccagctgtaagaacttcatgaaatacaacatttaagcaagaatttgaaatgtatttcttttacatacgagtactctatctgcatgttcaactctgtgccaaatcccattacagatggttgtaagccaccatgtggttgctgggaattggacttaggaccacttgaagagcaaccagtgctcttaactgctgagcatctctccagtcccttaagcaaaaattttaaagagatgttccaggcattcagaataagaatagcatatgtgtaataaattattttcatcaaatgcaatctccatcagaaatattgcttaatataaaaatccatgtatactttacattattccataatagctattaccatgagctcaactccaactacaaaagcatcttccagaagttaagtcttctatcatcttcattatacccacagggcttactgcttaatagatttcaaatatttttgaatatattaattgtataaagaaagcttcccgttaaaggttaggtttacctcaaatgaattcttagatatgtagatgatcctttgtgcaatagtatatttttaaggtcatacattaagcataatta

SEQ ID NO: 35913 - DNA, 1154 bp, Mus musculus
tgagaactgtcattggtaaaactctagcttttactatttttgtggataaatgaataaataataaataataaatactgacttgacactttcatcattcttccaaatctaccacttttggtctttgttatcatatactttattatttcttatttccagactgtccctcccaaaattcattcatacgcctctctatacagttacagacaaatccatttctctatacctctgtctgaactccagactcagatttcaagtgacccattatatatttctagtaggtagtcttattgatacattgactttgataaatctaaatatgaacatggttttggcctaatctatattctcttatatgtcttacctcagtgaaggaggcatccatatgcaaaaactggaatctagacagacaaccccaacatctctattaccttttacagtatttgcattgagttatagcagtttgtttgttttttggttttgggttttttttttgtaatctaatcagagttgcaatatgtagaataggtattcgtgaagaggaatgggcaggtagaatatcaaggttctcactggttaggattacttcatgaaaacataagagttccttagccttgcagcaccagagcaagaacaagatctagtgaaagttgtcctgtgtcagtatcctcagaatcagagtgaagaggagaaaatgatctcttaaactaaaatgatggagcaaataagcatgctttgaggaaaattgaagtttttttcatacttgaaacattatatacagatatgtaaaaaaaaagtataaaattattccctgtgatgttaaatagaaaaagttgatatgatcattttaaaagggaattacatatatgtatatattgagagaatgatcagtacatctatatacctccacttcttatctctccccattaagagagaatagaaatggtagttcactagctaatgagcacacctggcaccaaggtactggacttcaaatagtattttccactattagtgaatagaattgagtccagaaatgaatgcatatgtatgtgataaactgatttttaacaaaaatgccaagactatttgaatggggaaaaatagtcttttcaacagctgatgatttcagaactaaatacctacacagaataatg

SEQ ID NO: 35914 - DNA, 1191 bp, Mus musculus
gaaatccatggctgcatcccttcagcagattgtctacttagggaatcttgaaaatgtgaaggcatatctctatctctgtaacagatcttagtgttgtaactggttcccatactcccaacccacttgggagacattctctagatagagaattattaatcccagaaattacagtctggggagtattgggcaggtagaagaatctgacagcccacaaattgtaaagttaaggctggccaacaaagaacccttcataggttggtctgtggcttcaggcacatatatagcaaaggactgccttgtctgctcttagtggaagaggatgcacttaatcctttagaggcttgatgcaccagagaagggatgcccagcagggggaggcaccctctcagaggtgaaggaagggagggggtgatgaactctgggagagggaactgggatgggaggcaacatttgagatgcaaataaaataatttttttttaaggcaggctgtgcaagctagtaagcagtgttccaccatggtctctgctttggttcctgcatcgaggatcctgccttgaattcctgccctgacatctcccactgatggagtttgacctagatttgtaagatgaaataaactccttcccaagttggtttttggtcatggtattttattcgtagcaatagaaaccctaactaagacacaaaatgaacacacaaaaattagtagcctttcatataccataatgaacctgtggagaatgagatcagtctagaaaaaattccattcaacatactaaaaaacaaaacaaacaaaaacctataaatctaagcaagaaggtgaaacatgccatgaaaacttactcactgaagaaagaggttgaaggcaaaaatacttctcatgcttgtgcattgtcagaattaatatttaaacaatagggtaaatgttttgtgtatcagagaaagggcccatttttacaagttccctttccccaccatagaacacttcatccaaagtccctctctttgagtcctgagagtctctcacctcccaggcctctggtgcattctagagggtcctcccacctcctacctcctgaggttgcctgttcccatcctttctgctggctttcagggcttcagtcctttcccccacccaacacagtaactgatcatgttcccctcttcctttccctgtcctcttttccacc

SEQ ID NO: 35915 - DNA, 1758 bp, Mus musculus
ggaactcactctgtagaccaggctggccttgaactcagaaatccacctgcccctacctcccgagtgctggaatcaaaggcgtgcgccaccacgccctgctcttaacaattggtagtatagcaacatagctatcaacagtatttgccactagtatctttgtgatttccgtgttttcttttgttttagctttatgagtaaattataatttcattgttacctttggtattatattttcattttccttgacagttattgcagatatggccagggtttataattgggatgtaaaacgaagaaacaaagatgattctaccaagaataaagcataacactggcaattgaaaatgtgattcaggttttcaaacatgttaaataagccaaggtttaaagattgatctaattttcactgattttttttttcacagcaagattaaaatttaaaaacaccattttatttatttatgaaaacaaaattactttcaaatattttatgaaattaccagtatttttttcatatttccctaaaatgtaatgctgcttttgttttattttatctgttataagacaactcctaactgaaatggccgagaactgtgaggaatgctatggaagctgctgaatactgggcaccagagcagttttctttttctttattggttgatattactctcactggatatggtaaaccttttagaggcaggaaagacatacagttccaatatttgtaagcttgttctcctttagtacttgaagggcattatcatcttttgttgctgttttgttctgtaaatggggtttcatgtatttctgcctaacaagtagcttttataatactctgaacttttcagaaaattgttatttgctttcctacacagtatgagggctattgacatccataacactttgatcccaagtaagtatagtgtgtctacaatgacaatataagggagacttgatcaatgctagagagtactacccattcaaaactgtaagctaaggtaatttttatattatgtaacagttttccaaagcacctcgaacaggaagagtaacataaatataaatctgcattatttgaaaagagttgtaagcttttttattcatgataaaatttacataggacagatataatctctggaaagccattggtactgactgtggtaaaagtacttggtgatacagattctggtaaaaacacatgcatgttattccatctctgtgtagtaaaaagtatacttgtacaatgttttgtacttgtatttcatgttattaaaatagtgatgttcaacctgttgcctgacaattttttcattttaatctttgtcttaatctatatatgtttctggcaaataccataaaataggtaaaacaattatttatattgcattggtctggagacttttaagtccaattgaaatacaagggcagaaccttcatgatttactcatccccccccccccgtccccgtccccatatcgtaatactttgggggtattagacaggagaaagaaaatcccagataatatctttttgttttgttttgttttgtttgttttcgagacagggtttctctgtatctccctggctgtcctggaactcactctgtagaccaggctggcctccaactcagaaatctgcctgcctctgcctcccgagtgctgggattaaaggcgtgcaccaccatgcccagctctcagataatatcttaacatgagtctccacagtttttatgagatgcatttattgtacataactagt

SEQ ID NO: 35916 - DNA, 1146 bp, Mus musculus
ggagagacagagagacccgagctgcacaggccatgggctgggtgggaaggaagtgaggacctggacggacaggggaacagacagaggaacagacagggggacagacagacctgagctgcacaggcgaagaagaagtgaggaccaggacggacggacaggaggacagataggcaagcagggtgagagacaggggactgacagactgacggacagacagacaaacctgaactgcacaggtggtggccaaacaccaggcaggcagggtggaaaggaaggaaggaaggaagtgaggacagggacagacagccgagctgcacaggccatgggcaactccaggcaggccagatcagaagcgagggagggagatgggactgggacagggacagggacagggacagagacagagacagggacagatgggggaggcagggaggacgcactggctgggccaacacgaactcaggctgggcccgggaagtgaggatggcaagacagggagacacggagagagccccagtccctgcacttctacaggtacaacgggagcaggggcgcagatctgagccgctgcccgcccgcccggggacatcactaatgcagccacaccgctcgcctggaaccccggcagggactcgggtccagattcatccccatgaggcacagaaggaagtaagtgagggcagggagggacatacagagacccgagctgcatgggcgacggtaaaggccagtcaggccaggtcacaaggaaggaagaaggaagggagaaccgggagagacggaactgggatgcaggcacggctcgggcttggtccccggtgagaagggagaaccaggatctgggggctgcaggactcttagaagcctggatgggtctctcgttggcagacgccgatgccaggcagccccgggtggaagggaggaggagagagacagagagacagagagagactctgtccctgcttctacaggtacaaagggtacagagcccgcggatctgagccaccggcagcccagggactcagccggctcggccacaccactctggaactctggcctgggttcagggcccagattcgtccacttgagccagagaaccaggagtacagttgcattatttcgccacaaggtggcgctagagattag

SEQ ID NO: 35917 - DNA, 1839 bp, Mus musculus
gaaataactctgtttttaaaagagtgcaaaggtgttcttgctaggaaaaaaaaaacaaacatcttgatttttgtttcctccaaaactaggtacgcagtatcgatggctagaagaatcggagccagagtatatgccctccctgaagaccttgtggaagtaaaaccgaagatggtcatgactgtgtttgcctgtttgatgggcagagggatgaagagagtgtaaaacaaccaatctcaatagaaccaaccttactctccggtgcatgattaccaagtcagctagtcccaggtgaagtgctcatggcttcagaagtcttggtcatttaaaggacttttagttttgattagcaaaactaattaatcgtgacagcctttggagaaagcattttagtaaacaagcaactcctctttcccgtagagctgatctgttcagcacacctgaacatgctcacagccaaccttttgcactctcctcctagaatgctgcccttgacattccggcttgctttgtattatctatgtatcttttccctcctgggatatccatctcttgagacttgcctagatgtgtagataggaatattcttagctcatccttttgctttccacattctagcagttctttctggagaatcctgctctgatgctgtgtggagatgagtgttctttgtttactctgtagtgctgaaaatccgctgaagtaactggctgtgcagaatgtactagaagcttttctcattcttttagtcttaaaatcagtatctttttacagtattctttctacatggatattttttgtacatttaagaatattttgattacatccgacacgtctgctgatttgctactttttaaaaaaggggtcttcatgtaagtaaaacatacaaaagcataaattataggtggaagaaagtggaccctaaggttgcatttccccctcacacccaggctcaaaggaaatgaaatattttgtcttcaataagttggtccgatacatgcttgtttgtttggaaatctttatcacaaaactctttttcagtctaaaatgctgttgaacatgacacttttgaagagagggtgggctcagaatttagacgggaatttgataagcaaagaatgctaaaatgtacaatggatttttaattttacacctataacaaggagatgtggtctcagaaatgggaaagtatgtatgtcggacttgatgtactcttgctctgtcaagctctttgctatagttctcaatatcattatgttaatctaaatctgaaaagtgatgtaatctggtagcatcatagtagtccaaataaaggcatttgcataataattattctctactctcttttgttttaatgatttttcttagtgtggatacatagggggctgtgggggtgagtggggtcatttcaggggatgtctatggccaacagaaagagcattggttccccctggatctggagttacagaaagttggaatctgtttgatgaggatgctgggcatcaaacttcaaaagagcagcacgcactcttaatggctgagccatctctccagcacattgttttgtttttgagacaggtctccctctgtagctcaggatggtcttgaacttaagtctctccacttcagcttccccatgtctgccctgagtctcttcttggtgtttccgccccatagtgatgtgtcaattgtgacctgcatttcctctgttttctgttatattctataaaatcatttgtattagatttgggctttgagggctgaattggagctgtgggactaactcaagttcaaataaatgttaagtataattatttcctctaattcaccagatctccttgg

SEQ ID NO: 35918 - DNA, 1543 bp, Mus musculus
actcagagtgttagaaggaatatcacaagtctctcatgccaacaaaagatgaaaagatggaaaagggaagtgattttgcaaaggtcaaaggacttctttgtaaagccaaaattaaaagctccaatcccttcaggacaccaagcactgcattcagttcttctgctccctaagcacttgtgtgctgtgtgttcagcgcaattctttatgcagctaggaattcggagtccatttatgatcatgacctatttcattttatcaatgcacacacaccataaaattatttagaccttttgaaaaaggcctgtttcagaaggaagtttaaggacaaaaaaaaaaaaaaaaaaaaaaaggaaacatgcattactagttactaagtctacacataaagtggtctcaggaatgaggaagcaagctcaacacctagttacccatcacatcctgacctgcatgctggtaaagagatgagggaggatttaactctacagacgatataataaaaaagactcttgtgtaaaaggaataggaccatgattctactttgttggttttcagaactaaggccatgattaagagggacggccaggggcattcatattgcgctgctagagagaaattcttagactggcgtaagatggatcagagcaaaagcatttgacaagaatgtttccattaatcaagaaagaaagtcggaggtttgaagatgatcagataccgtcaaagttccgaccaacgatgctgactggcgattcagcagagttattcccatgacctgctgggcagcttccgggaaaccaaagtctttgggttccaggggaagtagggttgcaaagctgaaacttaaaggaattgatggaagggcaccacaaggagtggagcctgtggcttaatttgactcaacacaggaaacctcacccagcctggacacagacaggattgacagattgatagctctttctcaattgcgtggatggtggtccatggccattcttagttgttggagcgatttgtctggttaatttcaataatgcaaattatagcaccataggcattaaaagaaacactctactgttgaggaattctatctgaacaattagaccacctctaggccatgtgaccttggtcctattggttaacttcattgtaactcaagtgttctcaaatgtgggggtgattatagagaaggctgtgcaaggctattgtgaagattaaatgaattgctgcacataaaaacagcgaaaactatctagaccaaagaactatctagaaagcccaggttgattttaataatcaggatgagttggaattctaagaaagaaagccagacaaaaatatttagagagggcaaaaagagaaaaatagggacatatataaagtaaatcttactttaacctctgagaaaaaaattaatgaatataattatatatacatatacagatatatatgcatatatacatatatacacatatatatgtatgtatagatatggtgatattttctgagcatggtggtgcatgtctctaatatcagctgatgaaaaggagga

SEQ ID NO: 35919 - DNA, 1129 bp, Mus musculus
aagctggggtatcgggcctctgctaaaaaggctcagttatgccagatagaagtgacctacctaggatatgtcttgagagatggacaacggtggctcacagaagccagaaaacaagctgttatgcagatcccaaccccaaccactgctcgccaggtaagagagttcctggggaccgccgggttttgcagactctggattcccggatttgccacactggcagctcccttgtatccactaaccaaagagaaaggggaattcacctggaccagagaacatcagctagcctttgaaactctcaaaaaggcactgctgcaggctccggcattggccctgccagatttaaacaaacctttcaccctatacattgatgaaagaaatggagtggcaaggggagtccttacccaggttttgggaccatggaagcgcccagtagcctacttatcaaagaaactggacgctgtggccagtggatggccctcctgcctgcgagcgatagcagccacggctgtgctagtaaaagatgctgacaaactgactatgggccaaaatgttactatagtggccccacactctcttgagagcatcatcaggcaaccaccggaccgctggatgaccaacgcccgaatgacgcactaccagagcctattgctgacaaagcgagtaagttttgcacccccagccattctcaaccccgcctccttactacctgaggctgacgaggcccctgcacataagtgtgaagaaatactggcagaagagactggaatccggccagacctcacagaccaaccttggccaggggcgatgacttggttcacggacggaaacagctttgtggtagaaggtaagcggaaggctggggcggcagtagtggatggaaaggctgtcatatgggccagcagtctgccggagggtacatcagctcaaaaagcagaactaatcgcattaattcaagccttaaggctgacagaaggaagggctcttaatgtctataccgacagccggtacgcttttgccacggctcatgttcacggagcaatataccgacaccgtggactgctgacgtctgccggcaaagatatcaaaaataaagaagaaattctcagcttattagaagctgttcatttgc

SEQ ID NO: 35920 - DNA, 1136 bp, Mus musculus
ctgatgatggtgtgtggtcatgatttctgttagtaggattcttacatttgcctttcgccatctggtaatctctgaagctagttgttatagttgtctctggttagagcttgttcctcaggtgattatgttagcctctatcagcatacctgggagactagatctctccttagcttcagtggtcagagtattctctgcaggcaagctctcttcttgcatggaaggtgcccagatatctgatgttcaaacctgcctcttggcagaggttgtgttcaactcaccagaggtcttaacatcccgtggagggtcctgtgaggacattggcggtgtccgagaactccgcgcacaaggaatcccagtgctggagtgtaccagaagggacttgtgcccctgatcaggtcgggttatctgtttccctagttaatggtctcaggtcccgagcgattggattggaacaggcgctgtgttccactcaccagacgtcttaggatcccgtgggtgatcctgtgtgggtccttgcgggtgtccggagactctgcgggcaagacaaccctgtgctgcagtggactgcaagggacttgtgcccctgttcaggctgggttaactgcttccctagttaatgcagtctcaggtccctcgcgattggattggagcagatgctgtgttccactcaccagaggtcttagaatcctgtgggggactgtgtgggtccttgcgggtgtctggagactctgcaggcaaggcaccccagtgctggagtggaccagaaggctattcttactctttttaaaattgatattaacatagttcccacatttttctggatttttgagttagaaacttttgagatgtggcagtttctttgatcaatgtatcagtttcttctattgtaacttctaaacctgagattctgtcttccatctcttgtattctattggtaatactagtgtcagtagttcctgttctttttcctgggttttcatctccaggattgtctcagtttgtattttttttttattgcttctatttccacttttaggtctacaacctttatttttcccacatttttcaaatgtttgattgtttcccccctgtgtttctttatatgttttcatttcctccttaaaggcccttacata

SEQ ID NO: 35921 - DNA, 1139 bp, Mus musculus
tttggtctgtaaggactggaggactgtggtcggcagaagtgctaggaggaccacaggctgtggccctgggggacaccctgggaagtggggagagccaggggcatttggtagtctccggagatcagtcagagggaccaagttctgttaaaatggaagcttcccccttggagatcgtcaaattgttttgcctgcttgtggaggatgagaaagggttgcgtgtgtctggatcttttggtttcggtttggtgtgtttttgtgtatgtgtttagagctatgtgaaaatctagagaaacgaaggtaattctcacaggtgctttataccctgactagagagagtttatacctgagacatgagagaatgggttttgagaaaagcagtactctctgactatctggggataatttggtaaaagaaaaaaataaataaacagtatcaattggcctttggagccctgcaccggtatttaggagtctagtgtggctggagaagccatgctaggacctgattgtaaatactgttcttatagggaccaatagcttctcaagttctatggtaagttaactgatggttgtttttcctacaaaaatctctgttcttgtgattattggattcatcaggtgacaaggtgctcctcttttgaaattacagctagaaaaattaagaattttgtttggtttaaacaaacaaatgtatatagccatttcatttttgtttctgaatagtttcaaaggtataaatatgttttacatgtcttggttatagattactggttcataagtatgattatgattaaaaatttgtaccattggtaacagaaagttggcttaaaacttctaactctgggttagagtaattcagaacctgtggcatgagccaacccatggaaacaggtctctaaagatacgtctgggccagagcatcagcagcagacatcttggttctgggaacctgttgagagtattctgccaggtgagtgtgcggaatacagaagctaatagcttctgggacaggtgggagccacagagcttctaaggcagcccccttttcaggtcccagatatccggccacttttctggccagaggataggagttccgcccagccagggagcgctttgcctgagcatctgcggcagacatt

SEQ ID NO: 35922 - DNA, 1163 bp, Mus musculus
gatgtaagctctcatgctccagtgccatgcctacctgctgccacaatccctgttacgatggatagtcatggactccaaccagccctctgaaactataagtactagtgggttcttctgtaagttgctatggtcatggtgtttcttcaaggcaatagaaaaataaacaagacaattggatcagttcagagaattataaacaccttcaggttttatatattaatgtctataacttaagtttgctttagtagacagtataggtaccagaagtgtgatataggactgtggaattgtaaatggtcctgaagcctgttttttaatgttctcatgtatatgtagatgtgtttgtgcacttatgtttctggttgcatgtgtatatgtatgaaggaggtggatgtcagaaattgatatgggatgtcttcctttagttggtaattatctatccatgttatttttttcagatagggtttctttctcattcaagttgaagctcactaatttggctagactgacaagccccaaggatcctcctcagtgttggaatcatagatacagactgtagcactcacatttttacatgggttcccagggattaaattcaggtcctcgatgtactgattgagctatctccttgaacaccacttttttttttttcgagacagggtttctctgtgtagccctggctgtcctggaactaactctgtagaccaggctggcctcgaactcagaatccacctgcctctgcctcccaagttctgggattaaaggcgtgcgccaccactgctcggctttgaacactaatcagaggctctatgttttttattgttatggtcacatggtgaatctaccttgtgagggcgtttactgggaaccataactgagaaactggttacttagagcatccaagctgctgtgtccattccaaatgtttggaaacaagaggatactatgaaaaagcccacctacttgaccagttgctggaccatggaattctgtaatttttttgagcatcattttatgcatttgcaaaaatcaaaaggaggggctaatgatgtagctcagttgcctagcaatcagggcttagcaaaagaggccagccctgagttcagtccccatttgtagatgtcatttcagcgttgagagaaggtagagagaaaggttagtaa

SEQ ID NO: 35923 - DNA, 1970 bp, Mus musculus
ccattttattctgagacaaagacttcaccaggttgactaagctagccttgagtaggtgatcctcttgaatagctgagatgatgggcctgtgccacctcacctggtctgtgtctgaaatctctaattgtaaactctgggtaggtaccttggattctttccattcctttcttgaagtttagatcctaaatactgagtttgaattcaggaggtcaaagtcttccaaattaaaggatccacagaagaagtgcttccacaggtggtgttggtcacagcagtcagttcctttcaaaaataaaaacatagctattagtgtttcctgaacattggccgttgattcaaggtatttttattagttatttgatatatcatatcaaatagttatgtggatgtgttagcgatgtcatttgtaagagaggacaaggaaggggaaaaactcaacgtgtgtttcctggagtctctttgcatctgtcctcatgcacaatttttatcttttgattttaatcttattattgtttggattcactcattcactctctctgcctcccttcttctccctcctcctccctctttctttctgttctttgagccagaatcccactacatagtccctggctggctctgtagaccaggcttgtccgccattgtctcctaaatgctgggatgaaaaattccatacttggtttaattaatttatattttgtgtgtggtatatgcatgtgttcatatgtgtgcatttgggcatgcagatgtatacattattttgtgcacacacatatatgccagaggttgatttttagctgtcttccttgtagttcgtccttccattttaggagacaggagctcttactgaacttggacctctcaccattgctgggattccagatatacactgtactgggaaagagggaagggtgacagagggcgagacctgaggggaaaatcttgctgagtctctgtctccaaaggccagttccttcctttatactaaaaatagccatggaaaaagaaaaaaagtttatctttcaaacattaagaaggataaatgtttgcaaaatgattttaatcttgcttcctcgttggaggtggttttaaaacgtatttagtagtgaaagattaacagtttattgaatgtagtatacctgtgagttttttaaaggggaaaaagggtgaatctgaggtgtcaggaaacctgaggtagggatcaactgtcttggctcactcagctgagaaactgtgatgttcagtgctgagcgatcactgtaggtcacagaggtgggaaatcttgatcaggaagttggggctcaaaggggggaaccccagaatttacttgagatatctttatgcccacaggaaatgacttgaactatgtatgggtccattgtaaaagctattttgaatcgtctccctcaatggcttatttttgagcatgacctccctctgaggaactctttttcacctatagaagagagtcagtcacctcagggctatccgaggatcctaatgggaataggcacggggcctcacacttaccatcccttttgaagagagctgatttcagattctctgcaagatcagtaggtggtgttaagcactgagccttttctctagtcctgcctgcaactctttagtctcttttctcagcctctggagtgctggggttacaaacatgttgtacacagctggcaggcacaccagtgatttgggggcagggtatgttaggaaataaatgaccatagttgctgataggtacaataagagtttcagatgcttatagaaaaaagggaaaaaggatatagggtacttgaagaatggttcaggcctgtgggcatgggggaagaggggcagagaaactctgcctcccaagcagccagagcccaggaatacacgaaactttctgtttcttgctgtgtgttacagatcactagatttggctttcggtcacgttcttatttgtggtgttgattaggaga

SEQ ID NO: 35924 - DNA, 1195 bp, Mus musculus
tttaaattatagtacattttttcaaggaaagcatagtagaaagaaattggaagcttctgttcacataacatccatagtcaagagcatagaatactgatttagattcttgatagcagcacttgtaccttcaatactttttatgcactctagagtagttggtatatggtaattactggttggttgctaatgtcatcagttgcaacataagtgaaagttgcactcttgggaaggtactgtttctcaaccatctagcccttttttttttttttttttttttttttggtttttcgagacgcggtttctctgtgtagccctggctgtcctggaactcactctgtagaccaggctggcctcaaactcagaaatccgcctgcctctgtctcccgagtgctgggattaaaggcgttcgccaccacacccggcaagcatctagctcttacatgtcactgttattctcctttctctcttttcctttcctcccttaccttttatgtggaaggacaccgtttagctgagtccctgcaggagaatagggtctgctccctccctcccttattccctcttctcttcctctctcccttccttccccctccccctccccctcttcctcccagagtctcctgtatctaaggctggcctcaaactgctgtgtagtcaaggataatcttgaccttccattcgtcctgcctctaccttccaagtgctgggattatagatgtgcatcttcatgtccaattttatggagtgttgggggcatgtgcaaggcaagcactctagcaactgagccatttcttcagcccctctgttctttgtaccatgttaactacccatctgctaggctgttaggacaagcagacaggatggtgagacagaaatagaaacatcaagtaaattaggttgtggagagaggggtggggcctaggtgtttggcttcactaagaaaatgagaaatctgggtagtattttccaagcataggcctatctttttcaaatgtcattatgtcactagtttagcttatttccaactgtgttttctgtcaaagacaattgacatgagggcctggagatatggttcagtggttaagagcacttgctgcccttgtagagaacccccgattcaatttatagcacccatattgagtagctcagaactacctgtaacttcagttctagaggatctggcattctcttttgg

SEQ ID NO: 35925 - DNA, 1154 bp, Mus musculus
tgctcattgcaaactttgcaaatgactttacctgctttgtaacctaggtcagacctaatctcaggatttctctgcttcagtttcctgagttttgagatgacagacatgtgtcatcatgtctggctatccagaaattcctaatgcctggtagagaaagaattttcttttctttccttttctttccttttctttcctttcctttcctttcctttcctttcctttcctttcctttcctttcctttcctttcctttcctttcctttccttttttatctatctatctatctatctatctatctatctatctatctatctatctatgtatctatttatttatttgtttatttaggtttttcgagacagggtttctctgtgtagccctggctgtcctggaactcactctgtagaccaggctggcctccaactcagaaatccacctgcctctgcctcctgagtactgggatcaaaggcgtgcgccaccatgcccagccattttttttccttcttgaaaagttcttggaaaatcagccaaatttatttctctgtccctctctctctctcttccctccctccctccttccctcccttcctcccttcctcccttcctccctcccttccttcctccccctctctttctttaagttttgtttttaaaattgcactgttaacaaatgtagcctgggctgtgtttcttgtgcttttctttcattctttttcttttgttttgtcatgttctgttttatttgtttgttgtttgtttatttatactgatctagcttttagatgctgatttgttttctaacaagagtgtggttttaggtgggagggaaggttcggaggctctgagaggagttgggggaaagaaaaccataaatagtatattatggaaaaatctattttcagcaatagaaaaaaaagaaaattgataatcttttttgcttttgtaaatttaaaatttaaatacagctatttatttgtgtggttcttgtttgctcacacatgtgcaccattacacacatctggagatcagatgacaacataccaaaattgattttttttgtccactttccgggctgtgaatatggaactttagatcaacaggcttagtggcaaatgcctttacctactgagccatatcattacaccatcttgtgt

SEQ ID NO: 35926 - DNA, 1316 bp, Mus musculus
ttccaacccagttatgaaacagtttactagctcgctccatgcattttttttgcagttatgagacacctttcactgaaccatttgggactttcctctggaagctcatgtttattgagctcattgtgagcaaagtaggatactgtggggcatggctggtggttgtaaaggatctttgtccttaagtgcattatggacttgagtcatgtatgttagtggttatattgttcttgggttcttcatgtagaagaataattttagttagctttaaaagacttatgacaaaatacatggtgggatggcggagataaccatctcagagggtaaaggtgcctgcttccaagactacctgagttcagtcccaggctcctcgttgtaggagaacaagctcctgcaagttgtcatcagatatctacaggcctgtgagttcagacttggatgcatgcatacacaaagaagtgagtaaatgaatagaatgaatgtaatttaaaaagtaacaaaatgccgggcgtggtggcacacacctttaatcccaggcaatctggaggcagaggcaggtggatttctgagttcgaggccagcctgttctacagggtgagttccaggacagccagggctacacagagaaaccctgtcttgaaaaaccaaaaagaaaaaaaaacaaaaaaagtaacaaaataagaatttacacataccatttatcattttagtccttgccattgtctcatactccacgtcttcttctctgtcagtttctccatctcccgtctgcttcttttctacatgcttcttttgtccctcttctcttccctcctctatttctctttaactccttcctccttcctctttcctctttccttttcccttcttcctaatacctcccatttcctcctactttcctttccccattctccccactcttctctgtgtcttccgttcccccttattgctccctccagtgctgatgattgaactcagggccaaagtaagctctttctctctcatgtgtgtttcttgtcaggtgtgtgttttgtcatagccacatgacaagtagctactgtatcaggggttatgcactttgtaatacgtaacttgacaattgacattgtggaaatagatcaggttttgtttttctggttattcatttgtgggcacttggttttgttctgcctgttggcagttgttaatgctgctgctgtgagccttggtgtctattgatttgaacttgtgcttctgttgacatctgtactagctcagtttgacacaaggtagagtcatctcagaagagggaacttcagttgcctccttaagatgagact

SEQ ID NO: 35927 - DNA, 1163 bp, Mus musculus
ttgagctaggcatgacttcttagccctctgctcctacctgcattgaagctaatgtaggaattacaagatcagcttgcattgaagcatgacttgagatgcttcctatattggtattcagttgactgtgcgtgtgtgtgtgtgtgtgtgtgtgtgcgcgcgcgcgcatttgttcacagctatttgtcttcagaaactaggggcatcacatgttctgatctttctcctctcttccctgcacccagtgagggacatctcttcccccttatgtttttcccaccatatattcctatactacaaattctaaacagggctgtttgtgtcctttaggggtgctctctgtatcaggggaacagcctcggttgtcatggtcagggtgactgtgtaggctactatgtagcccaggctagtcttggacttaagatccttctgttcctgctttctgagttgggattacagttgtgtaccactgcagtctgcccatataaaattatcttatgtcataccttgatttaagagaacgatctatattttcacttagattgcttttggatgacagaggagattgtgttggcagtgagaagattgcctggggagatttctgtaactgagaaatgtcatttatgggctgctcatgaacagtctgagatcatgctaaactctgagcaggtttgtgtgaactgtttctctgtgtgatttttttttaaaagagatacaaccatcaagttgatcagtgactgcctgccacttacatggttcttagtagtaaagctacagaatgttgtgatatagttatggagcacttcagaggggtatattctaagggatgcatccttaaatttgctggtgggcacccatagagtgcttatacaggaagtaacctagttatgcaggtgatgaaagaatatgggtacactatcttgtaggtggtccgttgctgccagacacatctacacgaagtactgattgactagacttaactaaatcacttatttgcccagttagaagatgttgacaatatatactttagcatgtgttggttgacatttttatcttaccttgggtattgtatattaacaggtaattgaagatagaagaaagggctgaaaaaagtcaggagggggatttgcctatatttgcttctgagtaagtgaaatggttaaatg

SEQ ID NO: 35928 - DNA, 1121 bp, Mus musculus
agccaggcatttgattgctctttggcttcccatactatttctcctttggtgttcgcataaaccacagactgaatgtataattgtctgttgttaaggagtaggggcagggatgttggtagaatgattgcatagcattcacaaactcccgagttcattccttagtacctcataaaagtgaatatggtggtacacacttagaattctatcccatcacttgcaggaggcatgaggtcatccttgaccacatggcaagttgtgggacagcataggctacatgaaaacctgcccttaaacaaaacacagacaacttggacatagcttggtggataaagcacttacacaaatgtgaggactagtatttggatctgtagaacccacataaatactgggtaggctctcatagctctcagaaggaagaaatagcatcttaaagcaaacaggtgaactaaagtagcttgtgttttagagctctgggttcaattgagagacaccccatccatgaattagggggagagcaactgaagaagactcgtaatatcagtctctggcctccacattcatcagcgtccatgtgcacatgtatccacccccacagtaaccatacatacacacatgtatgcacattaggcacacaatcaggttttaaaaactaccagtaagcattagaggtaatattagaaccaggccctgccagcctctgcaatttgtttttgaatttagagatcccaggcctggtgttacagcttcatgatggtcaagtaaggagggatagctaagctgcatctgtgtgtccttatcattttctttaacaaacttcacttagagagaaactggaaacttaacttggcatgccactctgggcagcatctgactaggcaattaattgggaaatcacaaggagattttgactgacttgtatgctaaggtggaatttttgaacttcctatttgtaagccccatcccctgctaatcacacactctggaagaggttttggcctctggagagacacaagttgtaggtgtggtcatcggtaatgcatgcatggcctgtgtgttaggattgacattccaaattgtgccaaactagaacagacagaaaggagcacaggcctacagagttc

SEQ ID NO: 35929 - DNA, 3532 bp, Mus musculus
attctaatggagcagcagtgaatgtgtgggattgcagcacccttcctatgatgggctccaaactgtgtgaacttgacttgttcgagtctacttggaaatcacctgtccctggccacaggattattttccccctcccctaatctccatccagaagtttaaaacacaaacaaatacaaagtcatacgcatggttgtatcacaggaatatggtttccacctagaatgctcagctggggaaggatgaagccatcagctacatggtgcatggttggtttccatccagaacaggctctaatgactgaacagggaaggagaaacacaaagctgtgccaaaaaataaagaaaaggttaaaaacaatgaaaaagaaaaaatgctgtgataaaccaaaagggaggaaaaacctgccccttatggtgtttccctcctatcaatttggatactacagttgctttccaaaaagaccagtttgtaccaatgaaaatgtgtgactttgtaatcccaacgctgtattttctagaaccttctttggtggtttttctatctgctaaaattctgtggtctgggggcctcccacctcagatgcaaactgtttttggcttattccttctgtcttcccttgttgttgcccgccccttcctctgatgtccttgctctggtgtggtctcacttgtaatgaaatcctgcatagataatggccacatgcacacagtggatctttgttggacagcactctccttccctcttgccccactcccacctattgcttactctgtccctttctcatagttgcttcacattaggtcccaaaggcactttcagagcatagtaagtgctttatgtaagaaggcagggatggggactttttacagaaaaaaaaaaaagacttacttataagagaaagaacctggagtattttttgaaaaaaatatttttatgttaaaatgactttaaatcctaaaatggccatcagacatagagagttttgtgaaattcatatttaaaagactaagaagacactggcagagtctgaggtgtctaattaccccttcccttcagcttcacgaaaggcagttaggaaagccgtggattgggaaacgtcctatggaagaacaaggcgattgctttggcagctggtggggaagaaggagcccactagttaggcatcaagcagaatgctcaactgtttggtacacatttacttcagcagccaatgggaacacagtgaagaagccaccctgaccaagtgtggctcatggcacttgccagctacatctttctcacaacagtgtagctaccgatgggcacttttatcaagagcatgcttggtgaatcttgcaaaacctaagacccaaaggcctcagtgtccctcagtcttgtgaagacagtgagtctcaagggagaatttcaatcctaaaaaagaattaagacccaggtagaatgtcactgatcatttctgcccactttccaatttgtcttacagaagattaggacaaagctttctaaaaaatgagaaaataataggaaagagaagtttggctattttttaaaaacaaaataaggcatagtgtgcctggtaaagtttgccatcactaaatcaggtggcctttgtttgtttcttgtcataacttgacactgacttgttgtttctttaattagtaatgggggacagaccagaagggggttgcaagagacagtgtgcagggttcagcctgcagctgaggcaagtgttacttagagaaaagtatacatatatgaagccaaaaatcaaccagcaaggaaggtcaagtgctccctacacaacaaacaaatgttagcaccaaaacatgtattggcctcctctttgacatgtaaattatgtgagccctcaaaatctaagtgttgtggtattgagttgagtggtgagtttggattctgtcacctaaacgcttaacaaagaaagcccaagttctgtggaaattttaatcatagcagatgtctctgtgtcaaaggatatgaagtttcctgcccagagactgctttagttttaggatataattgtggaagtcctatcattgttccccaaatacatttctgttcatctctacagacgatcagctgttagatgccagcctattgtaaagttatgactttcatttgacaagttccacattgctatatggtggtaatgggtagatgacacataaggagttcatcagacaatctctgggtgtccaggctacaccccctagatgaatctaagccacataagaattattattttggagtcaatggctgtgagactaggacaaaaaggttcaatctacacaagaagaaacctaaagaccattcacttccctggccttacagctaaacatggacaggaagttagtgctggccacacgaggaccaagcagaagaatgcagcccacacccctgaagttcacccccataagacagctcagtctgcagctgtttggaagcgtccagtatttggacgctatcatttgcctgctgtcatagagcaggtgcatcatctttgtggtcaaggggtggcccatgtattatgctgttacctaacattgtttataactcctaaaacattgtgaggaatggttagtcttgtgaccaaattcaaccttgaaagcagtgtagtcacatagcagcctttccaggtattttttccttgagtttgaagtaaccatataccattcccagcacatccaggatgctgcctgtagaggaccgaagggccagatggaccttacaaagttcaactctctgaccccactcaacaccataggacttgactttttgttctgtctgactaagaaatagaccatggagccaagtgaagtgcactttgtcacatgtaaggatctgctttgttccttgttgcttttccctttttaaacctttgttatatctttccattctgtttcttgtcaaatgcataaatgtttgttctgcaactcactgaagttttgaactctggcttgtgcagtttttattgtctgtgtcagacgtacagccagacatggtcctctttcaacattttccacattctgttaagcaccatcaaaactcccctccccctctgtcctctaccccccactcccattcacccaacacgctcttcgagaagaaaaaaaatcaccttgtgtgttgtagctcatttgtttcaagagagaatcaacagatcatattcagtgtcttgaataaattgctctattttgatattagagaacatagtgactgtgtttttctttttgtttgtttcatcttgcttggaatctgtaacatctgctgacaactgaaggagagaacaatgtagatcacttatttctgtgaagatacctgacaaaacttatatttattttggttcttggtttaagaaggcacagtccattatggtggagaggttatctttcccccatctgtggtcgcaggagtatgaggtaacatttgtgtatccatagatcagttaagttgtacaaacttaaacccacaagccccaaatctaagtcagtcacctaggctacacaccctcccaatg

SEQ ID NO: 35930 - DNA, 1181 bp, Mus musculus
gtgagtattgtcaggctgtcggcctgtgccacgcagccgcaatggatccaagtttgaaacatggcaactctgaaagatattaccaggagactgaagtccatcaaaaatatccagaaaattaccaagtctatgaagatggtggcagctataaagtacacccgggctgagcgggagctgaagcctactcaagcgtatggaacagggacctgaggacaataagaagcacctcattattggtgtgtcctcagatagagggctttgtggtgctattcattcctcagtggctaaacagatgaagaatgaagtggctgccctcacagcagctgggaaaaaagttatgattgtttgagttggtgaaaaaatcaaggtcatactttataggactcattctgatcagtttttggtgtcattcaaagatgtgcgacagaagccccctacttttggagatgcaccagtcattgcccttgagtttttaaattctggatatgaatttgataacgactctatcatttttaatcagttcaagcttgttatctcctacaagacagaagagaaacccatcttctctctcaataccattgcgactgctgagaccatgagcatttatgatgacattgatgctgatgtgctgcagaattaccaggaatacaatctggccaacctcatctactactccctgaaggagtccaccaccagtgagcagagtgccaggatgactgccatggacaacaccagcaagaatgcttctgatatgattgacaaattgacgttgactttcaaccacacccgccaggatgtcatcacaaaggagttggttgaaatcatcatcatcatgctgctctgaattaatgaaaatcaagttgtatcctcagacaagaggtaaagaagaagaatgtgcaggctgattttaactgattgctatctttgtcagaagaaacttggtccactgagttacaaagatagcaggatgtttgttgagaaattgggtgtaagtataatatatccatctttatattttacttggcctttttcccttgcagcttttaatattctttcttctatatatttagtgttatgattattatgtgacaggaggactttcttttctggtccaatctgtttggtgttctttaggcttcttatacatttatatccatctctttctttaggttagggataat

SEQ ID NO: 35931 - DNA, 2157 bp, Mus musculus
gcaatcatttgtgtacattgtttatttagttactgtttgtttatttagttcctttctggtcactttaaacttggaagtcaggaagccacatgccctgcagacccttattcagatatagcacaaatgtgtggctttcctccaatcttccagtttagatgttttcagtaaaatatcccttcctaaagttaagccagaactctgcatacagcatggcacctgggtgcaaagattgcctttttatgataatacaaatgtacccacatccccacaagggaactttaaggatccaccccttaagcccctccctcctctgttgtaaatggcattttcttctcaccatcttaactttgttctcccagccatgtccgtccgtgaaaactcaggttccaggccgggaacttctatgaaagtttgtacagagctgtatttttggtgagctttctcagtgctttccaatatgcaaactaactgggttatgtacctcaaacaaacaaacacatacaggagatagaatgcaggattataatcaagtcctgtcagtagatgtttgctattaagtaggaaataacatgaaattagcataggaaatattgccttaattctaaacacacatggggagatcacacatgcgcacatgcaccctctgtgtgctcctaaagcaccttgcaatctgactccaatcctaaaaatcaaataaaaaacccttaatcaggctgtaaatcaaatgacactatgcgatgtcactacagtgacatcagacatcatataggaatcataattttctattttaagatttttaattctgtgtgtacatgtgactgcagtacacacagccaacaagtgcaccagagaccctacagctggacttataggcagttctatgccgccctgcggatgctgagaaccaacccaacctcgatcctctgcagtccatgtagttaacatgcaagaaggggtggtaaggcaaaagcagccatgaaaaagggtgagggaaatatgtcctgttcttaactctgagtccagggagagttgtgcacccaacaccttctcatgaaacaatggaatagttaataaatttcaaatttctctggtggtagcttgattcgaaccaaagtataaaagataatcactagcaaataaaaatttaaaaacaaatttctgggctggagagatggctcagcggttaagagcagtgactgctcttccggaggtcctgagttcaaatcccagcatcaacctggtggctcacaactatctgtaatgggatccgatgcccttttctgatgtgtctaaagacagctacaatgtacttacatataataaataaataaatcttaaaaagcaaaaaaaaaaaaaaggaaatcccctcttttaaaaaaaaaaaaaacaaatctctatgctcttcaactaagactgactttaatgtttagtacagataaagtactacgtgctgtggattggtgcttgtctcactaaactagctgttacatgttacactgtagaatgtgatttgatggcttaatactgttcacaggaccctctggctgtgcaaatatcccaacattggaccaaaacataccaatcaccactgtgttgctaggtgaaccctagtgaaaatttagcattgtgtgggtcttgatgttgaggtgaaaatcacagaaagggtctcacttctgactgtagatttgaaatatgttgatttcctgggatttgtttgtttgtttttgttattgttttggatgaagctccgtaggaagcatttgatgaacattcaacacctgtcattcttatttgtcagaacactgtaaaccacctgaaacttataatgcaaagtcaaggtttatgtgtgagttggtgcccccattaggttgtgtttgttcccatcagtttagggggaggatctgcttcccaactgttaaatgttactatcaaatctgcctttgagtctcacacccttgcatctggcctcacagttatttgggagagggaggttgctccagttggttatgtaatagacatcatgacatcattatctgtgtgacttagagaaagtgagcaccccagcgctcctggtcctcacatgtcagactaaaaccccttgtcacctccgttcttctcagagtgtggggctcatcacttgacctgctataacacagg

SEQ ID NO: 35932 - DNA, 1178 bp, Mus musculus
ccctccctatatggggtgtagaaggctgatgcaaagaaaaggaagggtgcctattcatgctttgctggatgctggacgatgagagttttgttaaagtttctcttattgtcctatttattttttcagccttgtcagaacactgagttctatatgcacagtgaagttttcaatctgtgtctaaagccttagctattaattgagagattttgactatgaaagctgggccattattggaccccattactagggggaggctaaatcagagaaccagttcctggaggagctttttagctattatttgagcaatttctatttgggtgaggaacacttttactcacctggaaaaggtatttttaaaaattagcaaattattttgttcttccccagatggcttgatcttggtgaagtcgttttttttttttttttttttttttttttttttttttttttttttttttccagagtttgtggggatgttgctctctcattctgaccccatcctgagtaagggctctctgctttgtatttagctaagggcacacctggcatcttgctgagacatctcatgatagactgtccagtcaagggataacatatcttggactgaacaactcagaatgtttgtggaccccggataagtagcctggtgaaggttagttcccaaaagtcctgccaattctttctaggagtatgatcttcccctctaatgtcctccattgtggcagtttgaatatgtgtggccaagggagtggcactattaggtggtgtggccttgttggagtaggtgtggccatgttggaaaaagtgtgtctctgtgggagtgggcaatgatatcctcctcttagcaatctggtagtcagtcttcttctgtttcccttaagaacaagatgtagaactctcagcatctctagtaccatgcctgcctggatgttgtcatgcttcctaccatgatgataatggactgaacctcaggacctataaactagccccaattaaatgtcctttataagagttgccttggtcatggtgtctctttacaacaatgaaaacactaagacatctatcaacctgtgggtttgagctgttgtaatcgtttatatatgcttgggccggaaagcagcactatcagaatgtgtggccttgttggagtaggtgtgtcactgtgggtgtgggcttta

SEQ ID NO: 35933 - DNA, 1245 bp, Mus musculus
ggctactgctgcatcatattcctccttggagaaaagttatgagcttcctgatgggcaggtgatcaccactggcaatgagcagttcaggtgttctatggcatccatgagaccaccttcaactccatcatgaagtgtgatgtggacatccacaaagacctgtatgccaatacagttttgtctggtggtaccaccgggtatccaggcattgctgacaagatacagaaggagatcacagccctagcactcaacacaatgaagattaagatcattgctccccctgagcgcaggtactcagtctggattggtggctccatcctggtttcactgtccaccttccagcagatatggatcagcaagcaggagtacgatgagtcaggcccctctatcgtccactgcaaaagcttctagatggactgagcattttccaggcaactgcatgagctgattctgaagtatcactttttcctggcaaatgtacacaccttatgctagcctcataagactggaataagcctttgaaaagaaatttgtccttgaagcttgtatctgatatcagcactggatcatagaacttgttgctgatttttaaccttgtattcaagctaactgttccctttgtatatgtttaatatcctgtgcatatcttgatttagtccttagttcatgtggcttggtcacttggtggctgggtagagcacactgcggaagagtaattcccagcctagtggatctccgtgagcaccacatagtgatctgtgcagggtattaagtgacagcagatatccaggatttcccgaagctggaaagggttcctgaagcagttaccacttcttttttgccagtctaacagggtgagaaagtctgagccttaggacccagtttactgttctggttatttccctcctgaccaccatgggtttttacttaccctgagttggaaacgtttgcatctacacctgtatatgtattcacccttttaatttatgtaagaatttttgtactcaaatctttaagaagtgacaatttttttttttttttactgttcactgagaatgttaggccctagcaacacatcattgtgtaaagaaaaataaaagtgctatggttacaaaacatgcaaagtgtttctttaaagaatagtggaaactatgaccaaacatacaatgcctattagtcatattacataagtgaaaacctttaagcttataaagactagactcacaatcattcttaaactaccataca

SEQ ID NO: 35934 - DNA, 1210 bp, Mus musculus
gatgaatgtggccgagagccctgaactggatcctcactccccagaggatgaagagcagccggcactctcagatgatgacattctgagagaaagtggatctgaacaagatttggatggagctggggaaagggcttctgatttggaggaggaggaaaatgcaaccagggtacaaagccaggaggaaacttgctcggatgagaaagaccgagccagtgagcccaagtcccaagatcaggattcagaggctcatgagctgagcaggggcccagagggatccccatgcgaggagggggatgatgttgaagaagatgggacaagtgacctcagggacgaagcctcctcagtgacccgggaactggatgagcataaactagactatgatgagggggtccttgaggagccagctcctgctgcccaggaggaggaggctgagaaggctggggctgaggagaaggaggagaagggggaaggggctcccggagaggaagggaagcctgatgtccaaagtgtgggagaacaagaacccacagaagctgccaaggagaagaagaaagaggatgacgacggggagattgatgatggcgagatagacgatgatgacttggaagaaggcgaagtgaaggaccccagtgaccagaacgtgaggcctcgccccacctgccgattcttcatgaaagatgttgtgacaccattatccactcttcttccaccaataccaaattccataccactcagaggccaggttaaaggaaactgcacgtggggaatgagctgtaggtttatccaccctggagtgaatgacaagggcaactactccctcatcaccaaagcggaaccttttccaacaaacggtgccccgcctcttggacctcacccactgatgcctgccaacccttggcgtgggccagtggttgatgaaattttgcctccaccccctccagagcccccaacagagagcgcctgggaacgtggactccgacatgcaaaagaggttttgaaaaaagcaaccattcggaaagaacaggagccggactttgaagaaaaaaagttcacagtaaccattggtgaagatgaccaggagtttgagaaggagaatgaagtcttccgagattggaattctcgagtcccgagagatgtcagagacacaacacttgagccttatgcagacccttattattactatgagatagagcagttttggcgtggtgga

SEQ ID NO: 35935 - DNA, 1279 bp, Mus musculus
aaagacctgaatgacagtaacttcaattctctgaagaaagcaatcaagtaatctgtcagaatatggagagatctcccttgctcaagaattggcagaattaacatagtaaaaacgacgatactagcaaaggcaaccaacaaactcaatgtaatctccaataaaattccaacacatttcttcaaatacaagtaaagagcaattctcaaattcatctggaaaggcaaaaaactcagaataacaaaaacaaaacttaaaaatggaagaaaagctcctctccagctccggctccgtagccatcatgaatgacacagtaaccatccggaccaggaagttcatgaccaaccgtctgcttcagaggaaacagatggtcattgatgtccttcatcctgggaaggcaacagtaccaaagacagaaattcgggaaaagctggccaaaatgtacaaaaccacaccagatgtcatctttgtatttggattcagaacccacttcggtggtggcaagactactggctttggcatgatctatgattctttagattatgcaaagaagaatgagcctaaacacagactcgcaagacatggcctttatgagaagaaaaagacctcccgaaaacagcgaaaggaacgcaagaacagaatgaagaaggtcaggggcactgcgaaggccaatgttggtgttggcaaaaagccaaaggagtagatctgcggtgacttgatgttttgctgtgatgtgcagatttctgagaggacaaataaactaaaaagcttctacaaaaaaaaaatggaagaaaggctggggaaatctctatccctcacatcaacctttactacagagcaatggtgattaaaaaaaaaaaaagagcatggtataggtacaaagaaagacatgttgatcaatggaatagaattgaagacctgcatataaaaccacacacttatagatactttatctttgacaaagatgccagaaatatacaatgggaaataagcatcttcaatatatgttatctattagaagagaaagtggaaaagagccttgaactcattggcacagggggaaatttctaaaacagacctccaatggttcatgctctaaggtcaagaattaataaatgggacctcgtgaaactgaaaagcttctgttaggcaaaggacatagtcaataagagaaatgggcaacctacagattgggggaaaatcttcattaaccacacatctgatatagggctaatatctaaaatatataaagaacactaaaagcaaaccaccaaaaaattga

SEQ ID NO: 35936 - DNA, 1176 bp, Mus musculus
aggagaagaacaaaaagggcacagcacgctgaagaggagagcagaggatgtgttggaggactcccctaaacgtcccaaggagtcaggagaccatgaggaggaaaacaagaagatagctgccatggagggtgagaggcccctgcctgtagagatggagaagaacagcaccccctctgagcaagactctggccagggacctcttgcaaaagaagaagggaggaagaggctgccaaggaagatgctgaagcccagggcatcagggatcatgagagcctgtagccaccaatgtttcaagaggagcccctgccttgttcctgcaaactgggaaccctttcccaccctactcaccctattccctccctcactctctcctctaagcccactgctggagagtgtcttggccctcacctccagttcccttcctatatacaccctgtgccccaggatgacatgaggcctttgtatctccttacatttatttcctagggtttctgctggggtctaggctgctatttccacctcttgacacctctgccttgctgcaggcattctagacctttggggtgggtagtgggcaggagtggaggtgaaagaatataaaggagtgtgggttcatggatgacatcgtctacctgagctcttgtctccagcccccacacctaaattcccatgtgcctacattcaagaaacgggacactgtgtgggagagaggctaccatccatccacaaatccttgttgatttttgggaacacttatccccctgatgccagggttcaaggaattgtagtttaagcatctagactttggagtttccaagtttgggctgagggagctgagagctgaagaatcaactgatttgcattgaggaaatgtctttttagatctcagggcagaaatgataacttggagagacctgctgccttcatctacttcccaatgcttgaggccagcccatagacagatatttcacccagacataaaggaaaaaccatttttttaggaaatgtttttaataaaagaaaattaccaagaaaaaaaaacccaaccaacaaaaggaaaaaaaaaaaacaaatgaaaaaagttaccctgcccctttgtgtgctcccttttctgttcctttctccccactgctgacccatttttgaggtacactaggacagaggctcacctctgat

SEQ ID NO: 35937 - DNA, 1178 bp, Mus musculus
aactagtttccttggacacttgtagtatgctgtagaaatttgtacccttgcaaattgttcttaccttctgtagtggctattcctggttgtcaacttgactatatttggaatgaactacaatccagaattggaaggctcaccagtgacccttatctggaggcttcgagatccttatctggatcttggtttgaagatcttgagccatagtggctatggattccagaagattgaatctccgagtttaaggaacacacctttaatctgggctatgcctttcatctgggattaaaggtgtggaggaacacacctttaatctgggctacaccttctgctggagacaatataaggacattggaagaagggagtctagctcttgttcttgctcctttgcctgcttgctgcgtgagactgagtaactgctagatccttggacttccattcacagctgcgactgaacaattgttgggaattgggctgccgactgtaagtcatcaataaattcctttactatctagagactatccataagttctgtgactctagagaaccctgactaatacaccttcctctgcttaatcttccatgcaacatatattaaatttcccaagattctaaaaataacaataaaattctgatgttggcagtcgtcttctttgacatcataaattctttaaatactatcttcactatatattagaagtttcttctcatctgactagcaaacaacaacaacaacaacaacagcaaccgaagccttgagatttctttccttaatctcagaatgtcttggaaacaaaactatttagagtttctcattctagtaatacatgttttctttcctctgctttatttttttccatttctaatttctcttttgttcactatttatcatttagaagtcagttttatccaaggaccctcctacttttgccctcctggatgttcttatgcaagtctgtacttcttcataacttttatgtgttcttattaaataattatagcataatttgccactctttatagcaataaaatttcattaatggtaggaaattgttaatccagctgatttattgaattctgcatatctatcatagcactttgcatgaggaaaatgttccagaagcttgtccagaatcagcaaacatgtgaaatctgctcgtgtatttcaaatgagactt

SEQ ID NO: 35938 - DNA, 1194 bp, Mus musculus
tccaaggaagcatcatcagcatcaccaccagcagcaccatcagcagcagcagcaacagccacccccaccaatacctgcaaatggccagtaggccagcagccagaatgaaggcttgactattgaccttaagaattttaggaaaccaggagagaagacctttacacagcgtagccgtctctttgtggacaatcttccccttgatatcactgaggaggatatgaggaaactatttgagaaatatggaaaagcaggcgaagttttcattcataaggataaaggctttggttttattcgcttggaaacacgaaccctagcggaaattgccaaagtggagctggacaacatgcccctccgtgggaagcagctgcgagtgcgctttgcctgtcacagtgcatcccttacagtccgcaaccttcctcagtacgtgtcgaatgaactgctggaagaagccttttctgtgttcggccaggtggagagggctgtagtcattgtggatgacctaggaaggccctcagggaaaggcattgttgagttctcagggaagccagctgctccgaaagctctggacagatgcagtgaaggctccttcttgctgaccacgtttcctcggcctgtgactgtggagcctatggaccagttagatgatgaagagggacttccagagaaactggttataaaaaaccagcaattccacaaggtgagagaacagccacccagatttgcacaacctgggtcctttgagtatgagtatgccatgcgctggaaggcactcattgagatggagaagcaacagcaggatcaagtggatcggaacatcaaggaggctcgtgagaagctggagatggagatggaggcagcacgccatgagcaccaggttatgctaatgaggcaggatttgatgaggcgtcaagaagagcttcggagaatggaggagctgcataaccaagaggttcagaagcgaaagcagttagaactcaggcaggaagaggaacgcaggcactgtgaggaagagatgcggcgacagcaagaggaaatgatgcgccgacagcaggaaggattcaagggaaccttccctgatgagagagaacaagagatactgatgggacaaatggctatgggaggtgctatgggcataaacaatagaggtgccatgccccctgctcctgtgccacctggtactccagctcctccagg

SEQ ID NO: 35939 - DNA, 1793 bp, Mus musculus
gttcaattggggttatggcctggcctggggtgcaactatattttcatttgggggtgccattctttattgcctgaaccctaagaactatgaagactactactaaaatcaagtctgaaaaacaaacacacatatgcacacacacacacaaaacatacactacacacaccacattacacacaaacacacacacacacacacacacacacacaccacatgaaaaagagaaactaaccatccaacaaaagatttgtgttgacatcttttctaacactattttctaaaacacttgtggagcctcaagcagtttgctcagttgatttaatatccttgcctttgggtgtcaacatcataaccagcttttatatccattttagggacctgcacaaattaagaatgctgattagatataggcatatgctgcaaacttccaatatgcttatgccatttctcttgacatgtgaaggatctgtatgacagcaaccattttgagaagctagttggaatgagaattgccagagtctctttttgcctgcagggaaacagctgcataagcaacatgtaaaagttccattgctctgacatttctactgttggagcccttatcacctgtttatattgcgcagtggctatattggttattggttactttgctttggaatttgaaactgccatttgggcatctaatgagaatcatagatatagccatttaattctacctttaaggctgttctttttaatagcaaattatactttaccaattatcatctcttgggaaggaagtcaacgtttggagacatgtgtttttcattatgtagttataaaattgagggtgtctgctttcccctggggcaatcagaaagaaatgtgcatgagttgcttttgtacccttaaaatcctttaaaaattttgcagcaaacaattgtccatatgtaacaagcttattcttctacaccacaagccattaccatactggtaataagttgctcattaatagtccacatacatgtacctatcattcatataatcaatacttgctctagtgaagcaatttgaacactaaccttgtatgcatcaacagactcagtattcacagttacttaccatacaaaagttcatataccttaaagcttttgctctgtgttctctactgattcattggaaagtattaatagaattgcctaagaagtaaaattgaaatgttgttaatctgaaatttaatgattcttttataagtattgtagttcaaaagagagtaggaattagaatgatcactttgtgtaaaattcattaaaatacaaggctgctatttttgcaagtattttaaatgtcttcattttaaaataaaggaatagtgatagatttctataaatgtctaaaagtctcagtagatgagtagtattccgttgttacctggtcctctgaagttaaatgatgggctaactgatttgtgcacacaagtgtgatgaatttatgttagggaaattattcactgactattccaagggaagaaaacatcaacaataaggaataagtttgcaattgatctttactgcaaacttgtgttaattctgtttattatacaaatctggatagtttaagtataagcctatttttatataaaatatacaattctgataggaaagttataaatgattatttttgttaacaaagacattaaagcaagttttctctcatttgaccctcttgaagacagaaacattggggaagaaaacattaaaaatgtatctatttactaatatattatacaattcactaagaaaaagactgtgtca

SEQ ID NO: 35940 - DNA, 1432 bp, Mus musculus
cagatatttgtaatctactgaaaaatagattctttctgtaattttctcccttcccaattaacgagccctaagctacatttttaccatatttggaactttttcattactaagaaagcttagtacagtggggaaatcctttttttcttgtcctaagtaatgtgtctatctgaataaacacaagtgataatttcagctatagtagcatcatttcttctagctttaggttggattggtgttttcttaaacagagttgttagtcatgaacccatccatggttaccttagagagatgatatacacacagagaaaccctaacattattcagcagggctagctattcagatttcttgcacaagtatttagctttttgtaaggtcaacatgtaaattttaaagacaaatatagagagacttatgtgtttgaaatataaatgatatatatggataagcatgtacctgtatattattaaacatgcagtgaactgactggtaagtgattgtctaattgtatggctagcaatgtaatttattcagactgtatttttgtacagagcagcgcacactaacctatgcctctgtgtcctccttaatgcctaaaactgtgcctagaaatttcatctgtcttaaagaaaataaaatatattccatgctgttttatgataatagtttctttcctgctattctgtatttattatttttaaatatctgacatgtttactacttaaatatgagtttatgttatcctgttcttttcttttcttttctcttcttttcttttcttttcacttagaagtcatctggggaaatctgtttgtcactccagtgatgcttgagtgtgcagtcccattatctgttcttcatttaatgatttttgtagttgacctaacgttatctatgtggaaaaaaaattaaaaaaaaaagtggtttcactaacaatgctcttactttgtgtcttcttttttgtgtaaacctactagagaaaaatttctagattgcatatcatcagttcattttctatattaaaatatatttaaaaactgcatagtgcaaaatgtgtatagttttattttcaaatcattagtatttattgcataaagcaaaggatttcatagtgacatctttgttcaactacagcactttgactctattgtcatgctttttttttcttagttcttccttcctcttcccaaatcaccatttttttcttttaattttatagtgtgtgtgtgttgtgtgtgtgtgtgtgtttatttttgctatgctatccattgatcctacataaggtaggcaagcactctactaccaacttacaccctctgtcccaaaaaaatacagtttaaatttttcttacttggggtgggaacatcctcttggagacatggtaggaggaatgggatgaggaactgtcagagggcagaccaggacaaggataac

SEQ ID NO: 35941 - DNA, 1178 bp, Mus musculus
agagcggacgctgacggatacagtaatagacagtggagacggagtcactcatgtcattcctgtggctgaaggatatgttatcagcagctgtattaaacacattccaatcgcaggaagagatataacatattttattcagcaactgctgcgagactgagaagtaggaattcctcctgagcagtccttggaaactgcgaaagcagtgaaggaacgctacagttatgtctgcccagatttagtaaaagagtttaacaagtatgacaccaatgggtcaaagtggatcgaacagtacaccggagtcaacgccatctcaaagaaagagttttctattgatgttggctatgagcgattcctgggacccgagatctttttccatccagagtttgctaatccagattttacaacaacctatctcagaagatgtagatgaagtcattcagaattgccccattgatgtctggtgtcctctctacaagaacattgtcctctctggtggttcaactatgttcagggactttggacatcgtttgcaaagagatttgaagagaactgtagatgccaggctgaagttaagcgaggagctgagtggtggtagattgaagcccaagcctattgatgtacaagttattacacaccatatgcagtggtatgcagtctggtttggagggtcaatgctggcttccacgcctgagttctaccaagtatgccacaccaaaaaggattatgaagaaattggacctagcatttgtcgtcacaatccagtgtttggagtcatgtcctaaagttgacttcttgtttattggggtcagggagatggaaatgagataatctttctgatgacctgtttttgtctgaatggatggttctgaggtttttaaccaaacatgatcatacaggaatatttaatgagtgtgtcaacatgcagatgtagaagagagccaagacgattgttttcctttaggttgaatatttgaatcttatgtgtatcaaaaaagaaatgggttttagttctttctgtgccctgatattttgtatattattgacttacccagtgtgctgggctcagtgggtgtgtagagagctctgtaatgcctgattgggcactgctgagtgggtagtgcctgagcttgtttatatttcatacttttttatactttgagggaaaaaagtcaaagaaa

SEQ ID NO: 35942 - DNA, 1126 bp, Mus musculus
cctgactaatgaatggaagggtccagatccagttctaatttggggtaggggctcagtttgtgttttttcacgagatgaagatggagcgcggtggctgccagagagattaattcgtcagatgaacacagattctgactcttctggtaagtatcattctaaagactaaaattccttttgtgcttaaaattcagctgagagcaacagctctcaaagctgttctccagctactctctgaaccagctcccgacaggaggccggagacgagcctcagctttacaatttgcatttgaataaagtacctagacttccccgaaagaagttctgctttcctactttctcactgtctttcaagattttgtctttcaagcaggtaaatcaacattctcgaggcagaccagtggatgtgcatccccgcccccctagagcacacaggtggcagctgttacccccagtctcaggacatttccagcacgtggttttcagtctgagttaaaaatttaggtttacctagagggctagaagagtagatatttccatattaataaagattggtttttattttgatagataggcttagccccttagctgacctctggcttttcacccttgctgttactgcaaggtgtccttagctcaataggctgtgaaaaaaacagggatgaggaggaacgacttccagctcctattttagccacaaatcgtggtgttactaatgacataattcttgcttaggctttgctaattctgaggttgataattctcctttaggagctgcacagcactcagaactgtgcatactggtttgtgattgtacaaattcagtatgggcaccgcttggtgcagagatacttactgcaagggaaggtccggcttgaccatttctgagtttcctgtgagataaacccggtttgaaagaggttggtaccaacttttggttaaaaataaaaaatattctccggctctacctcgcctccccaaaaggtaccgagagccacatgtgtgggttttacccacgggaggaattgggtccatgtccacccaagccaaggttaaaagcccactcatctacggatgagaaaatcatttgatcacctcagttaagcgttgccttatttaacttaattaa

SEQ ID NO: 35943 - DNA, 1160 bp, Mus musculus
tatccttgcatgatgccttataagtgtggaaggaatctgtgctgcagaagatgtagtagttgtgattcttttattttgagtttctttttccctttaccatactgatgagacccatccatgggttgactttagcaggggttctgccaactctggatttgagcctggtttcatcagcatttgattgaaaggcttaaagtgacaggctcctgttatatcacaaacaaattggatattttatgccttcagagggtctctggataaagcaaggtagctgatgcatggcctcattcccttatccaaatattggcctgtagcctctgtgaaattatgtgactaaaaaacaaatactaaaattttcctcccaaaaaactgggaaatggttttaattgtcacaggaaagcatttcttactctatgctctatttctttttcttccactcattttctgtctctcactctctatgtcataatgagatttgttggagtttacctacattagtcattgctgctagagcagaacaatatggtggtaagcaaatgtttggttacaatctttccaccaaaaagaaaaaaaaattctggaagacagactgtgttaagaagaggaaggataattgaaagcagaactccaaaatgcaacttccaggatgcttacatccatcactaggtgtaaatctatagtttcctagatgaacacacctggtttggggtcaccagtgtccctatatgtaagtcctcatttgtactctgtaatctagcccaataaagcctcatcgttatgttaaggattggcttccatgtgtatctggggttaatgcactttcacttgcttttcccaggaagagtcaatccaacagtgtttcaaggtgctggtatgtgacagtttactgctaaacttgtatttaattgtctcagaaaattagtcactaactgttaaaaattacaagtaaagcatgcataaataaaactgccagaaataaaaaggacaatagaataaaacttgtacataaaatatgccacctacagggtgtattttgtgaaggaaaaataattttgtctcaaagtaaagcaactggtccttccagaaggaggaaggaatatgtggtactaatctcagtagacttatgttcatagagaaggaatctttttttattttttgag

SEQ ID NO: 35944 - DNA, 1098 bp, Mus musculus
ttgattggcttgcccaccacacaccacagagctctgcctgtctcccaagatgcctgcttgaaccaggggtagaggatgctttttctttcttttttttttaatgttaatttttattagatattttcttcatttacattttaaatgctatccattttcctagtttcctttctgaaagtcccctataccttccccctaccctgctccccaacccacccactcccacttcctggacctggcattatcctatactggggcatataatcttcacaagaccaagggcctctcctcccattgatggccaaccaggtcattctctgctacataggcaactagagacaaactctgtggggtactggttagttcatattgttgttcctcctacagctctgctgcctcctaggagtctctaactggggacacgcatttccatctgcctcctacatcaatcataacagctaacacaaaagacagccagattgcaaaaggcagtcacaagaacataacaggagccaaggaaatatggcaccatcagaaccctgctctctcattacagtaagctctggatatcacaacacacctgtagagcaagattctgacattaaatcccagcttatgaagatgatagcagcctttaatgaagatataaataacttccttaaagatatacaggaaaacacagacaactgaatagaaccctttaaggaggaaaagaaaatatgcttcaagaaatatcagaaaatatgatcaaacatgaatgaaataaataaaacagtccaagacctaaaaatcgaaatagaaacaataaagtaatcataagtggagttaaacctgaagatggaaaacctaggaaaaggaaaaggaacttcagacaaatcatcaccaacagaatataagagatggaagagagaatatcagatgtagaagaaatgccaagtgtaaaaatttcctaacaaaacatccaggaaatttgggacacattgaaaagaccaaatctaagaataataggaatacaagaggatgcagatttgcaattcaaagggtcagagaatatcttcatcaaaatcagaagaaaacttccctaacctaaagaaagagatg

SEQ ID NO: 35945 - DNA, 1154 bp, Mus musculus
gctctgagccccatttttaatggggttacttgattttctggagtccaccttcttgagttctttatatatattggatattagtcctctatctgatttaggataggtaaagatcctttcccaatctgttggtggcctttttgtcttattgatggtgccttttgccttgcagaagctttgcaattttatgaggtcccatttttagatttttgatattacagtacaagccattgctgttctattcaggaatttttcctctgtgcccatatcttcgaggtctttctccactttctcctcaactgccactgtgcttccctgggatcctgctgcctgctgagacacctttgagacaatccaagttgagcagcttctttgggctgagtccaggtcctgcatggactggcaggaggatgggcctaccccctatataagcttagactctaagtaaactttaaggtgccttgaacagagtacttttgtcttgacgtctttatttctcttcctgtctattctctttcagccccagcctgcctttcaggagtacccggttcatgtaggccgcgggcggcttttaactacacagaagagtggagcaaagcaaaactgtgattgagattcattgtatgagagaaggatctatttacaatgataagaaaaaaaacaaaaactgccctgaaatttcctatttcttctggagaaaataatctttcttgattgaaaaccaaatttttattgaacacagcaaatgaaaggatttctaactgttcatgctctatgttttcatctgatttattgtgaatatcctccattcctttctcttgtttacagtgtctgtagtgtcatttattcaaatagtctttttaatgtaatttattaatattggtattatgatcattaaattgattttaatttgctagaactttaaccacagaagaatattttcaatttttgagtaagttttcaacatttgatacacattatgggctagtggttttgggtttccatagaataaagatgtacataaaactgaaagtaactctgacatatctctgaaacaatttgcaatatttattttgtttcaaacgaaaatagcatatctctatgcaatccagaacttctgttgtgaccatgtgggagatggacatagttcctgaagt

SEQ ID NO: 35946 - DNA, 1148 bp, Mus musculus
caaaagtgttcctatcattaagagtctatgctgtatattaataaaataagaaactgcctacattaattccatagaagagtgatcagtgctcttagggaccactgccagaaagatattgtgcctggcatgacaataattctttcataaaagtagaatagttcccatttcagatcagaacaagacacatctatttacagaacctggtttccttataggactctgacaactacccattctcccttaagtagctcaactgaaaaatattttggtatagtgaatgaccatactttgtaaaaaaaaaaaagagagagagagagagagtaaaaatatatttccccaaagaaataaagaaagagcatatggttagcaaggtcaaactagtttaaaagtagaagagtggatttttcatctgtccatgttttacttgtgtgtgccatacattaccaatataagtctatgtactgtgaaagagcatttctggaaagaagctgtgtctgcaaagactgattaactgattagaactgcagtgatgtgaagagggtgcaaggcagcaggttaagagcctaattatctcatggtgtgctacttttagccacttaaatatccgtcccttgctcacctctgtgtcagaactaacatcctgtgactaatagataaaaactttttagaatcttttaacttagcagaccactagcttccaacaactccaaagctaaacccatcaagatagcatctgaggcctatagaggagagcctaccttattttgttataacctgcttaccagatgtacctatcaatgtattttaatactgccttgatttatgactttctttgttctgctactataatactttttgaaacagcttccatgtgggaacatggaacctgagaaaacctatgcatctctgtgtttcctggcccatggtcactcaaatttgactacataataaagatgtctcattccctttgaaaagagatctgtggtttttgcatcaacagcatcctagtctaaattacatggacattttacatttgagagtaattatcttaaaccagaatcatgttgcagttgttacacttggccaaggaaaggtagtttttaatgtgggtttgtcattttaatagagtatggagtagatagaggact

SEQ ID NO: 35947 - DNA, 1146 bp, Mus musculus
accacagctatgccagtgattttagctctatttaaattagactgatctggaggaatactgtgatctgcccttattagctgtgaagccagggtgtccctatccctcctttgaccataatctgcatagtaattggatgtctctccagtcactatccagcttttttgtttttctgtgtgtatgacagagcaaatgtggtaccaccagtccaccccatgccctacccctaccccacatatacatacacacatccagccctccctataagtcttatagtaagagctaaggtttgtacttttttcctactgtctatttgatcaatatactaccattcttgttcattctgccttttcctgccccattgattctttctgtcctttcttttcttcttcttctcttcctcttcctcttcctcttcctcctcctcctgctcctcctcctcctccttgtcctcaatgcctaagcacttggctatgatagctatgtaggctgtttctatttttgataaagtatgtagtatcaataggtagtgctatgatgaacatcttcacataattgttgcttttctttaaaatcaatctctctctctctgctctctctctctctctttctctctctctctctctttcttcctccctccctagctccctccctcctttttgccttccttcaccccctccctccctccctgtgtgggtatgtctgtgtctgtgtatgtgtgtgtggttttcttctaggtataaatgtgggcatgtgtataccacagaggataaccttgcatataagtcctaacttcccatcttgtttcagaaagggtctcttgctctttgctagtatatatgcctgaaaatccggcccaccaactttcaggggttctcctatatctgcctattcttttgtcataggaccagtgagattatagacatacaatgtgttgcctggctttttatagtttctagagttctgagttcaatcaagtctttatacttccatagcaagcacttataccaccaaggctccccagtcccatttattttctctgacattgattcccttggataaattctccaggaatataatgatcagattcaaggctataaatattttttgtggcttttgattcatattaacagatggcttttcttcaac

SEQ ID NO: 35948 - DNA, 1178 bp, Mus musculus
ttaattactttgacgttcttttcataaaacattttgctgaatgtactggcaaacattgacccagagttgagttgagcagaaattgtaatctagatcaaataaaagtgattcattaccccgtacagagcaatggaggtatcattcccaatcgaacatatttgaaaaatcattgtttggaaggacattggtaaactgagatgatgccccatgaagaagaaataaaaggacctgggagcagttctgataaaccttgaaaaggctgcttaaaggtagcatgtatgaagccttgggttctatataggtttccagtcagatggctgatgctggcaatgataacccctgcaaaaatgtttcatgctaaatgccaaacactgacacaaatggctttcactttggtggctcacataatcttgaaacagccccaagaaacaggtaatgttaaaaacttcagtttcataacagaagaaggtgaaggcatacagataaagatattttcccgaggctgcatgggcagtgagtagcaaagctgggctttggattctagggctgagctttcccatcctttgcttgattgctgtgatttcagctcagcatgatgaaacatttggcactagggtccattacacagatgttcaggatgctttctcacctgagtgatacttttctcacctggatgatacttagacagtggctgtatgagtgaatacactggcactggctaagattttggactctgtgattcagctccatgatgccggtcctttgaaaacaatgaaatgacttgcatgatctttttttcatctttccattaagaatctaaatgattccttaaaaaaaatcccagtttgtctgtgatgactctgacataggggaaagggattggcagatctttttgatcagtggattgcatcaataccattttgtaacaaggcaatcccaaggctaaaaagctcattaatttggtgttacatttgtcattaggagttagtaaggactagagtactgctgcagtggggtcaagtgttacaaagtaaatggagccttgatccaattctacttgtcattctgacatgatgtagctagatcctttaatagcaaagtatgtgctgaaaggggcaggatgtgatggcacttcacttagtagctgtattctactaaagatgccatgcaatatattc

SEQ ID NO: 35949 - DNA, 1183 bp, Mus musculus
aagcatgagtcaaccctatgactgtatctcttttttccttgggtcctaaccgaattttccttggcattcccactattttgtagaagatcttaatgtaataacatgatggcagtcccagatacgctggagccggaggggagaggatctatttgggatatgactgagcaaaagagtgacaccacagcttctaacagcccctcaaatcagtattaactcacacacagactacattgttctcactcaaagcctggtgtaggaatgcatacttgagatgattcattgcctagattaaagagagacaaaatgtggaactcagactacaagggcagaaatagggttgaaggtagaaatgtgttactgtggaagatcaagagattaaggtaaacatgggtgtgggggctcacatttgcaagcccaacagttagaaagcagaggcagggtgatcgttgcaagttctaggccagctgggttcatgtagtgaattctaggccagacagggctatagtgagacaacatctcaaaaatgaaggggtggagagaaaatgagaatggatagatagaagtcagaggagtgagattgtgatcaagaaagttgaacaaatggggtattaggaaggatttcaaattcttcctttatttaagcattgacagtgtaggttctcactcaacttggaagcgtggtgcacgtggagatctcggaaaaggttagagtatgtacagttcctgctggagtagagccaggattgagcaattcaatcagcaggatactgagatcattgaagtgataatggagattcacagatgccgaagaaggtagatgagggttctaagaagataaggatacaggaggaaagagagaatagttgaaccaaatccagtgatgttcaaaaatctccaccagagtagagggcacctccaggtcccaagaaggcaaaccttataggaaagccagggttcatttgttctcaaatagaagaagatatgtttttggtggttttctttactacatgtcagagatttagggcaatctccatcagaattgttttgtacataagatctgaatacagctaatggactgttggaagtgaaaatgacatcatagagcacgaaaacatactgcacacctttgagaagtcaatgaattctgaaaacaaatgagctttagtatctctgttatttccta

SEQ ID NO: 35950 - DNA, 2392 bp, Mus musculus
agaggattagacagtaagagtttacaagaaataaaatctatatttttgtgaagggtagtggtactatactgtagatttcagtagtttctaagtctgttattgttttgttaacaatggcaggttttacacgtctatgcaattgtacaaaaaagttaaaagaaaacatgtaaaatcttgatagctaaataacttgccatttctttatatggaacgcattttgggttgtttaaaaatttataacagttataaagaaagattgtaaactaaagtgtgctttataaaaaaagttgtttataaaaacccctaaacaaacacacacgcacacacacacacacacacacacacacacacacacgcacacatacatgcacgaacccaccacacacacacacacacacacacacactgaggcagcacattgttttgcattactttagcgtggtattcatatggaattcatgacgtttttttattttcttgcatacgaaccccaccaaatgactgcttcatattgctcttttgagaattgttgactgagtggggctggctatgggctttcattttatacatctatatgtctacaagtatataaatactataggtatatagataaatagatatgaagttacttcttcaaatgttcttgccacttcctaatggaaattgcttctagtcatctgggcttatctgcttgggcaagagtgaattttccctggagcccaaagccaggagactaccgccacactaaaatattgtctagggctccagatgtttctagttttaaactttccactgagagctagaggattcatttttttcaaggaacatgcgaatgaatacacaggacttactatcatagtaatttgttggctgatatattcaacttcctactgttgggttatatttaatgatgtttctgcaatagaacatcagatgacatttttaactcccagacagtaggaggaagatggtaggagctaaaggttgcggctcctcagtcaatttatatgaggggagcaacaactctgtaaaagaatggatgaatatttacaactatacatataaacatctctataattacaactaaattgttctgccctcttcataaactcaacctgaagtgggtggttttgttgttgttgttgttgttgttgttgatgatgatgatgaattttagattttagattttttgggtttttttttcttcattgtgatgatttttttttttaatgctgcaagacttaggattactgttaagaaagtaacccaatcacattgtgaccctggtgaatatcagtccagaagcccatgaactgcatttgtctcctttgcattggtttccctgcaagtaactccacacaggattgtgggtgagaaggcacagtggttggaaagttttgagagcaaaagcgtctccaaactctctggtctagttgacgggctgaaatgtctaaacaaatgcaagtcattgaaccaggagaaaaagtgcaacagaaagctaaggactgctaggaagagctttactcctctcatgccagtttcttcttcttagcatttaaagagcattctctcaatagaaatcactgtcctatcattttgcaaatctgttacctctaacgtcaagtgtaattaacttctagcgagtgggttttgtccattattaattgtaattaacatcaaacacagcttctcatgctatttctacctcactttggttttggggtgtttctagtaattgtgcacacctaatttcacaacttcaccacttgtctgttgtgtggacaccagtttccttttttcatttataatttccaaaagaaaacccaaagctctaagataacaaattgaaatttggttctggtcttgctttctctctctctctctcctttatgtggcactgggcattttctttatccaaggatttgttttcaccaagatttaaaacaaggggttcctttcctactaagaagttttaagtttcattctaaaatccaaggtagatagagtgcatagttttgttttaatcttttcgttttatcttttagatattagttctggagtgaatctatcaaaatatttgaataaaaactgagagctttattgctgattttaagcataatttggacatcatttcatgttctttataaccatcaagtattaaagtgtaaatcataatcagtgtaactgaagcataatcatcacatggcatgtatcatcattgtctccaggtactggactcttacttgagtatcataatagattgtgttttaacaccaacactgtaacatttactaattatttttttaaacttcagttttactgcattttcacaacatatcagatttcaccaaatatatgccttactattgtattatattactgctttactgtg

SEQ ID NO: 35951 - DNA, 2091 bp, Mus musculus
aatcgtaatggtgggaaaacaggcgcaaacccatggacttggaaagggtgaaaggcttgtaaggtgggtttcctgtcgatccccagaagcagtctagcagtcctactgttcttaaaggtgcccttgcctttgtgtagtttttgtctcccttagagatggacaactccacttgctattatgagacaagttaggaggaacatatacactacttgacatatctgactaaaggtgtcccagtgttcgtaataagatgctgaaataccgacagcatgacacttgtcagttgaccatgaaagaagcatgtgtgaaaagtctgatgctttattaaaactattgcatgaaaactcaccaaggtcaataagctgttaacatacagtagatgcatggttcaggccttcgatgatgtatctagtcactcatggctttcatctgccaggaaaaaggaggccccagttcatttgcttgctatggaagttaggtatgagacatcaggggccattaagaaagctttggacgtggtaaggtttgaatgcccacatacattttattcagttcctaaaaacaatcaaaacaacttgacactgatgaacttgatacatttgactgtatcatatatagacccatatatagactgctccttatctatgaccactttgaataagaattcattgagccgtccaggtggttttgtttcttttttccagaatgttctcctgctcagattggcatccataagcaggtggcatatggtggatactactatggaagttgctggatactgatgtggaggtgtccatgccctttgggtcagttagtgtacgcttatgttcgtgtgagaggcttgctttcttaaactgctagtttgatgtactgataaggcagacctgactctacattttacatttctttttgtaaactgggtctttagaaagcatgttagccattgtgttaaaagaacattgttcccgtaaaatttagaggtcttaaagtttaaaatggaaagaaaggagccacaaacttctaaggattgtaaaatgtttggattgattctgatctagtttgggaaacagtggaggcaggggatattaaagaaacaaaagaaatgcattgtacaaatatgtagttttagtgcaggttaatgatggtggaggaaagtgttgctaatttgtttatttcccaggatggaatgggaagtgtgatatgcagtttaatttttaaggagctggtctcaattttagtactctctaattataaaagaaatcaatgtttcgttaaattttgtcattggtttgtcacaattatctaggggttcatatccaactctctgtggcaactcaattttatataatcttttaattgtttatgtatttctgacagtatgaagagaaagcatatgaggcatagaactgtcttttagaaatatggatgatgtatcctggaatgtgaaggtgtccctctaagatgaaaaatggaattattttactgttgtaccattgttagaccttgaatgaatccatgttgcagtgtgtgtctgtatatttgtagagaaagggaaatgacaattgaaaggttactttaaaattttcaaattgggcactgcctgtgttgcagcactactgtatctttgttgagcgacctaacagtatttccctgttgtgaaagttaattctgatgatgtttcacattcaccagctttttttctgtactatttgcatccccaaatacttagtacaagtagaattgtgcatggcttgggcattcaaagataagcgagcgatgagtcagtctgagtttctaaagccatgaaaacttgctttgagactgaatagttctgagttatttacaacagcaccaattgtccaagtttctttccctactgtaaaagaattgatcagtttcttcattaaagcagcaagaaattaattaaatttgtacataccatgtctcttagatttctgtgtatgttgtgaaggacattattttgagaagaaatgtacaaaggcatattacaaggctatgcatgcaccgtccaagcagtacatattcagaaagtcaaagattcctgcaaaataaattaataaactaaaaaca

SEQ ID NO: 35952 - DNA, 1209 bp, Mus musculus
ttaagtatgtattcagtcaattaaaatgtactatattgtaatttcaactatatttcttatactctaccatttaattatctcagctggaagaaaagcaactgtggcatgtaacagtaaatactcttctcaaacatgattctagtccaaataaaatttttcctttgaattgatgttttccatatttgagctcctattgaagaattatcaaattcaaaagctaaggggaaaaatatgtgtgaataaagccaataatgccttttaaatgttattacccattaataagatgttcttattttctggtatgatagaaaattatgtctacttaataactgacaaaaaaaaaacaagtatcattgcaaatgcctcacagtataaccagtaacttctcaaatatttagaaggattggttataactcattaacctagcttcctaacatcaattttaaaatgtatttgttttatagtaaaaaaaaaagaaaaggatactttataattgttttgttttgtcattttggaatggaaaatattgatatcttaatagaaaaagttttatttggaattaatggtagattgtccttcccctctgcatgtgctgctcccaatgactgaagctgctcggtgtcactgatacagctgccacttacgtgacatcaatatagaaagatcctgtgaagttattatggcagtgatacttttaaacttagttatatttctacaagggcaggttgagttcattgtaaataattgtgtaaatcactgttctagtaatttaaaaataacattaatttttctacaaaatgcgagatttataaatgtttgaaattgtacctattgataattaatggtaagtttacttaaaataaatgtatcccttatttcttatctgcatttctcatttccagatgaaagtttagttatcagagatgtttcagcacacacaaaagccacttttcagtacttgttcacatgcactgacgagctaattagcagcagaagtggtttctggaatgatgaacaccttaatcattctgttagaacagattagacagttcctacctcagcattttcagaaaacacactttcaaggccaaaagccatcatcatcagtagagtctccccttgctgagacctaattatctccggggttccatcctttacctcagcttctgtctagctgggttagtcagtgaggcctggaacactgttgct

SEQ ID NO: 35953 - DNA, 1571 bp, Mus musculus
tggacctctagaataatagcacacgagtcacagtttatggctataaagagtacaatctaatgactggacagtccgtgtaattgtgggaaagaatggcaatataattgtaatatggcaaaacttattatcaaatgatataattctcaaaggtatatttcccttgaaataacatcaatatctttatattttcacagaacatgacctggagctgtgatgcatcaattatattctattgacatgaaattaagtgtgccagtgtttgtgcacactttagtgtgtccagtgtatgtgcacacatcctttcatccttagaagtgttgcttctgaaaacttagaacttatttcagtccattattttaggccccagaaaacccttttaatcaagaagctagggttctttttaatcgggatgggactaaaaaaaatgagtttggcctaaaccataaagatcctgtggtgagctgttttaaaataaagttttctcctttcagacctgcctggcctgcagtgcgtgaaatacattgagggtcttcagtggagaacccagcagatccttactgagcacatccggatgatgcagagagagtaccagatcagatccgctgaactgaacagtgcccttttcctgctgagattcatcaatagcgatgtcgtcactgaactctttttcaggcccatcattggtgcagtcagcatggatgatatgatgctggagatgctctgtgcaaagctgtgaaggcatatgtccactcaagtgcattttactatagatggagaaagcggtcgtagctgtaggcagaagagtgctaaaatttgtgaaaccaaactttcttgtatttttacatgcatagtatatttgtattcaattgaagaaatactttagttacaatgtaaaaatccctctgctccatactggcttcttgtgaaggaaagcatttgcaaacaaatcactatttctgtatatctctaagagtgtggtactaggctaacaagctaatttcataaaaataacatctctttccattaaccccgccaaataaaatttataatattaacttttaataaaatttaaggtactaaccgttaaacggactggagagttttcttggggtttacagcttcaaatactttcaaatctagctaaaataactgaagatacaatcgtgagtaacttcatggaatttaatgctacagtatgtcactggttaaaaaaaaaaaaaggttattttgcctggcttcactgcttccattaacagtataaaagattgtcttcattcctgcctggaactcaaaaaacaatctatgtcctaagagtgaaaactatttccagagtttgaatttagaatttttctgtatacaattatgaatttgaactaaagttccatcataaatccacataatgccagggggcattatcatttcagaaagttcaatataaccataaaaccctcgctatgtctcaccttttaggtacactgtttaggtaactgtcaaattaaacaatcctgacatgtgagttactttctgcagcccctttaaatacaattcagaaaaagatttcctcattattg

SEQ ID NO: 35954 - DNA, 1227 bp, Mus musculus
aaatcgatccatttttatctccttgtacaaagctcaagtccaagtggatcaaagacctccacataaaatttgatacactgaaactaaccaatggttaagagaaaatggttaagagcctctaatacatgggcacaggagagaaattttactgaacattattattataagatcaaggatcgacaaatgggacctcatgaaattacacagcttctgtaaggcaaaggacactgtcaataggacaaaaaggcaaccaacagtttgggaaaagattttttttaccaaccctacatctgatagagggctaatatccaatatatacaaagaaaacaagaagttggactcaagaggaccaaaatggaatacagagctaaaaaaaaaaaaaaaaaaaaaaaaaaaaaaaaaaaaaaaaaatagaattcctaactgaggaatacctaatggctgagaagcacctaaagaaatgttcaacatctttagtcatcaaggaaatgcaaatcaaaacaactctgagactacacttcacatctgtcagaatagctaagatcaaaaactcaggtgacagtatatgctggcaaggatgtggatgcaatggtgcctcagtcggaacgggacgggagcggccgcgggtgcgcatctctcggggtcgggggtgtgtggcggggccagggccaaaaagggggagtgggtgggtaggggattggggggtgggtatgggggacttttgggatagcattggaaatgtaaacgaggaaaatacctaattaaaaaaaaataagaaattccctcttccagcagtcatgtagagtcatacacacatgttaaccaaaattgcacttacttcacagataaacatgtgatgtaaggatatctttaatttctattattaattagacctatattaaaagtactgtgtaaagatagatgattctgccaggatttgcattatattctacttttcctcatgtgggaaagaaatgagatctataactcagagtcttttctcaaaatttacgaggcagattatataccactttagacatggcataatggctgcatacttaacattgctcttaccaattattttatatagacaaactgtttttatcttgttttctggcattgtgaagcataagtcttttattcacatagacttactcatcacctgtcctcatgtcatctagcactgttctaggtatttttgatataggaagaataaaactaagaaaa

SEQ ID NO: 35955 - DNA, 1408 bp, Mus musculus
ccaccaggtgaaatatgagacttacacaacaactgggcttaaagtcagggcaaggccaggttccttccttcttccaaagattttcatattttcttaaagatttatttattcattatatgtaagtacactgtagctgtcttcagacactccagaagagggcgtcagatcttgttacggatggttgtgagccaccatgtggttgctgggatttgaactccggaccttcggaagagcagtcgggtgctcttatccactgagccatctcaccagcccctggtttattttttaattattatttgctttttgtttatcaagacagggcttctctgtatagctctaattgtcttcgaactagctctgcagaccagcctggcctcgaactcagagatctgcccacttatctttgcctcctgaatgctgggaccaaaggtggcataccaccacacctggcatatatattttttatttctatttctatttttattgatgccagagcaaacctaggacttagaacatgctgggcaccaactcaacttctgagctctatttacaactcggtgtgttagtgtatttgtcttagttctgaatttgtccttttttagtgttaactctaggctttggagacagtgaggtgcatatactctctccttctcaagaataagtgcttgaacaccctcacccacgcccacccacccatgctagtcttttttcttagaagcgtgggtcttggtatacactgtgtgtcattttgaggggtgaggtttaaaagtatatacaaagtataacgatatggtggctactctcgaggatgagacagaaggaccaggagtttgagggtagttcagatatgcaataagttcaaggccaacctgtactttgtttaaatagtaagacagcatctcgataaaataataaaactaaagtctcaacaaaataaaagctttcacctgttaaggtgcttgattgtccttggagtcctccaagagtaactgctatgttaatatctgtagaaagatgtttatatttgactgtaccatgatgaaccgatgccaggtgaactcgtttaaacaaaataaaacactaattttaccttaaaaaaaaaaaaacatccagtggaaaaaagacagcattttcaacaaatggtgctggcacaactggcagttatcatgtagaagaattcgagttgatccattcttatatccttgtactaaggtcaagtctaagtggatcaaggaactccacataaaaccagagacactgacacttatagtggagaaagtgggggaaagcgtcgaagatatggtcacaggggaaaaattcccgaagagaacagcaatggcttgtgctgtaagatcgagaattgacaaatgggacctcaaaattgcaaggcttatgtaaggcaaaagac

SEQ ID NO: 35956 - DNA, 1460 bp, Mus musculus
atttgaatatctaagaagcatttcaaacttaacaacttgaaaagtaaggccttcatagcctcatattccactgcctttcctagttttttcagatcagaagcaaaccttttttgtttggttggttggttttggtttttttgagacagggtttctctgtatagccctggctgtcctggaactcactttataaaccaagctggcctcaaactcagaaatctgcctgcctctgcctccagagtgctgggattaaagacgtgtgccaccacacccggctgaagccaaccttttaatctacaaggagaccagacgttctcaaccagagtcgccatggtttcctgcttcaacaatgcttgaactgaacaggtgcttgactgaccccctccaacccccactggccacttcgagcctgagccctttgcaacttcctcactctgcagctccagtgtctccactcagcctcaccccaccaccaccatgaccaccatgtctccctcgcaattgttccagaactaccaccagaacgcaaaggctgccatcaacctgccagatcaacctggagttgtatgcctcctacatctgtctgtctatgtcttgctattttgacagagatgatgtggctctgaagaactttccaaaatactttctccaccaatctcatgaggagagggagcatgatgagaaactgataaagctgcagaaccaacaaggtggccaaatcttcctgcaggatataaagaaaccagaccgtgatgactgggatagcaggctgaatgcaatggagtgtgcactgcacttggaaaagagtgtgaatcagtcactactggaactgcacaaactggctactgacaagaatgatccccacttatgtgacacattacctgaatgaacaggtaaatccattaaacaactgggagaccatgtgaccaacttaagcaagttgggcacccctgaatctggcatggcagaaaatctctttcacaagcacacagtaatgagagctaagctcccaaagccacttgactttacttatcattgaggcagtacatgcatgtcaggctgcctttatcttttctataagttgtaccaaaacatctgcttaagttctttaatttgtaccatttcttcaaataaataattttggtattcaatctgcaaggaattacatgatctgggtctgtgaatttctggatagtatgtgtgttttcaattattcaacttcagtcaactgatattttccctagtattaaacctatgagacagaaacaagatagcagaccctagtattcaggcacaggaatgagatttgcctctagagttcagcattattgaatctcattctaaggctaagcattaaatacagttctctgatgctcataattggactatgttccttccattcaagtgtcactgatactatttagagtgctaggaatgtggtcgacactaataggttcatgtgg

SEQ ID NO: 35957 - DNA, 1164 bp, Mus musculus
cccagaaccgttttcgggaacttagaggactcgggctttttccagacttagtggtgtgcaggtgctcaaatcctccagacacacctgtgaaagataaaatatcaatgttttgccatgtggaacctgaacaagtgatctgtgttcatgatgtttcgttcatctaccaggtacccttattgttagaagagcaaggggttgtaaactactttcttcagagacttgatcttcctactgagagagtcacgaaaaatgctgatgtaatggaaagagatggcaggcagatacgatcacttgctggagacctgctcttgtgggtaaatacactaaatctcagactcctatgcctttgtcattaaatctctagaacattctgcactggctattaacaagttggagatcaagtacacagattccacagacctggagccaagtaccctgcagaaaaagcctgtgcgctaccttgaggcatggcagaagctctgcagtcctcatggagtgctggttccaggaggatatggtgtttggggaacagaaggaaaaattcaagcaattgcttgggcttggaaacagaagaagccttttttgggtgtgtgcttaggaatgtagctagcagtggtagaattttcaagaaatgtgctcagagggcaagatgccaatagtacagagtttgaccccaatactagttatcgtgtggtcatagacattccagaacataacactgggcaaatgggtggaaccatgaggctgggcaagaggagaaccctgttacggactaagaactcagacatgaggaaactctatggagacacagactacttggaagaaaggcaccaccaccgatttgaggtgaacccagtcctgaaaaagtgcttggaagagcaaggcttgaagtttgttagccaagatgttgaaggagagaggatggggatcatggagttggaagatcatccatttttttgttggagtgcaatatcaccctgagttcctgtccaggcctatcaaaccctctccaccctactttggcctcctcctggcctctgtggggcagcttccacattaccttcacaaaggttgctggctctcacacagggacacttacagtgacagaagtgggagcagattccccaactcagaaatcactgaactaaagtttccatcaataag

SEQ ID NO: 35958 - DNA, 1869 bp, Mus musculus
ccgaggagcacatggacatgcacctgcagttcacatcagcagaggtgacctggcctggcctggcttggcctcctaggcagttgggttctgaaaagggcagtgtcaggttttcacagaaaattctgagataccattgactttggactgtctccagggtcgaaagaacacagaaaggcccattaggttatcagagacatgcagctgctatcaaacctgcacctttctcggaaaagaaatattgaatgtctttgaagaaactatccgagagagtcttctaatccttttatttttatttcactttagataaattgaagaagcagtttttccctctccgagttcttcaggactacagaaaagtcaagaacatagcagagcagttcttgtcctggagtggctactctgaagtgaacctcagcaagctcttcgccaattacgctgggaagtcctgagagagccgggaaggatgcaaggaggccagctgcccaatctgagctgctgaggcctccgcctgccctaactgctgcaccactatcttgcttttcttttgaggactgcatactgtgttgatgttgatgtagatgtggaccagggtgggagtatcaaaatacttaacttaccaaatagtttttatagcactatgtacaccaaaccctttcctaagtatctaaagacctatatcttactgcagggcagaaattgctactttaattgagaatacctaagatgtaagtgaccttcagtttaccctggggctttatcagagacacccctaaaaagagttttatggggtctaatggaagttctaacattttgctttttcacatgtcagttaaacccagtctgtgtctaaatacttgttcagctactggctacaagcatggctgatttcagtgctgtctttcatataagtggtgcaggtggtagggaggtggtggtggagggatttagaaagtttgcacttactaaatacaaaaagcaagtttgcttattgaattgttcaaagttcaacattcaccagatgtttcactcacattccttctattttccctttacacagaatgttcaaagtgtaggtttatacagtaggaaagcacattttaaatactttgtcctaacatttcacaaaatttatggtgaggttgtagtaaggatcactgttccattcagaagaatgggacacagctgacaggatccagtgcttgctagatttcatcagttcttcagaatagtgtctctttgaagtgataaacaatattacaatatggcagccttaaatacttatctatttgtctttttataaagaaaaatgtattgtgatctgtacctaagaataaagtttcctaaaggaaaaccagttactgtgttttgttttgttttgttttgttttctaaattgggtacagtaagttgacggaaagggatgaaagcttgattgaagaagaccattcattcccttcccaaacctcagctggcatcccttcataaccctccgagtcagaacccagtccgaagatgttgagcaagatgtctggatattgaaagtactgagaagtcctgtgaattttgagtcctttgatctattaagcataaagaagactaggggtggtagttttttatccagaaagagagagagagagagagagaagggacactaaagcgatagacaagctcctgactcccaggagagagctatcccagataggaaagaaacacttggcaagccgtggatgtgaagaaatacttgttaaaaccgatgaagtcttcttttgtctagctttgccatttcttttctctccctcgtctcctcttcaggctcttaagctgctcctctttctcttacactcaaattttaattagaaacactgggttt

SEQ ID NO: 35959 - DNA, 1187 bp, Mus musculus
tctgccacatgcttctggtctctgtggtcacctgtgacatacacatattatatacataaataaaaataaaactttttaaaatgtgcttcctagccaagttagttctttaggcaaccttgtgcaagtcctgactaatatgcctatttatataacatgagccaaaaattagccacagggaataataacttatcactaaagaggaaaaccaatcagcacgctgtgaaacaaataccttccaataaactttacaaagtctctcagcacatcactgtcccattgtggatagtattgattctgactctgctttggttgcagtgttttggcttcaagagttctgatgttgtgattagcctcctttcttctatctcttctaaaatattgattaacatgttgaagtgtgtttatgcacatgtcaatggaaagactctttcttccaggtagatactgctctattttcatcagcatcctttgtgtagaaatgttctaccagttgctaattatatttgcttctaacttgtaattgtcctcaagggttttgctcaaaggtttttcctaaagaaaatctgtatcattttgatcagatactgatggtgtcatggttttataattactttggccctggactgagaaatcatggaatctgtcccctttgactggtcatttaaacagcattttaaaaagaatgagtctttttactcattttactctagaatcaagttgctcaagatgatgaatcataaaatgtatttacataatttgtaaatcgtgctggctggtaagagcaggtgtgactatgtaatgatcctggtcagaggcttgactaagtatcactcctacacttagtactaagtcatatagtgtggtgtacattgctggcaaagtttaaaagaaagaaaagaagctctcatgaaattttatatgaggaattttaatctctcatactggaaagaaataggaaatcattcttcccacaaagtaggagatccagacccggcttcaaataggtctgtattctagtggaggagctagggtaattcaaccttcctacactccagtgctcaaagaggaagggaggcccaacagctttattatcttagagttcctgagcaataagacgagatgatggagagataaagggatcactattagactaaagcattgatttttttttttcaactggggtatct

SEQ ID NO: 35960 - DNA, 1242 bp, Mus musculus
ctttcctaaataattttaattcttttaaggcacaagaattttagatttgctaatcttatgataaatgagattgctttattactcttgcggtacagtacttttacgttttagatttctctgtctaaatttcagttgatgtagtaacagctaactaatgttgtataaggctcggtccttgctttatcttcaagtttgtaatgaatgactgcagattagaattattgatcagtgtctctaaaaataatgtttatttttggtaacatgatttctgtgctattttcaaagaggaaatgaccttctctgtaagtcctgtcttacatgggatgtaaagtagtgagttcatggatttccatttgactttgtagttcattgtgatgatagcaaaagaatagataccacgtacttctaattagggtcttaaagccataaataacacataaagtatagttaaaaactcttctagaaaagtgttgtgtgccaagaaaaaataaagtaagtttgagccataacattgtttctggtaataaccttgtgtgtacttgtttatcctggcttctatagggactggatatggaacccagtttgtatcgttgcagtaatgttgattgtaaggtttcaccgttgaccttcatggtacagctgagcaacaaattgatcatggacattagacggtgcattaaaaagtactatgatgtaagtatctgtaataagacattacacactccatttactgaggtttaataattgttttatagtttttattgcagttgagaacacttaggaaattcacagtaaaatactactaataaaatgtgacacacttcaactttaaaatctatctatctatctatctatctatctatctatctatctatctatctatctatctatctatctatctatctgtggggtggtacaggataatgcctgtatggaggttacatggagggagttggttctttctctgtttccatcaaattgattcctagggattagaattaggtcatcaggcttggtggtaaggccttaatcaactaagctatctcacctgctcaaaaaatttgattttagtagtatgatacaaactttgatttttctcataaatgtcatatctctttaattattggagtattaagattgaaagtttgattagttttctgaagaagttaaaagaaccatcttttaaattgaagtgcagtttgagatcaaagagaatgtctcattttcatatatgtacaataa

SEQ ID NO: 35961 - DNA, 1257 bp, Mus musculus
tgagaacatgatgttgtactttgtctaagatgctgctactgaattataaccactgaattagattgcaacatacatgctgttaactattgagccaagatgaaatcgaccgctgcattgaaatcaaggtttgcagttgtgtctgcatttgaaggagttggaatggcagcgaacataatttctttaatgggatttttgttctgttttcagttttaatggttgcactatattttaagagtatatattagtaacaggatataattatttgagttttttatgtaactggagaaaaaccctatgaaatgctttggagcatttttctacatgttgacatgtttctacattgtgttgttagagttacttgtttgattcatattcttataaacagagaagtaatttgtccacgtgatcttgagttcaagtggtttttatctgtgtatatacaaacttggaaaacgttcttttgtaagaatttactttggggatattttgttttggatgaatactcttaatatttttgtttgtttgtttgcttgataggacttgactccactcaatttagagttcatcagtatcacaaagatgaagagaatgatgccctccttggtggtccagcacagctaactgatgaagagaaatacaaggattgtgaaaaattcaaatgcctttgtccttcatgtggaactgaaaatatttatgataatgtctttgaaggctcggttagttattctgttttgtttctgtctttcattttgtttggaaaccaatacagtacagagtgcccttccctacactttagagaacacacagacacacacagaatatatataggtaatctagatgtttcatttatgtctttaaagaattttagtaatgtgagttctgctttcataacttcatttccgctgagaaatgtttaatcgaatgtgctttaataattgttttttgcctccctagagtgcttgaccttttttttttaaatggactcttttaaaaattctcattatctcaaaatatttttattagaactccttaattagtaacctttgttttcctattaccagctcccacttattaaagctgagcaatacctgggtttctcttaaacaaacaagtattaggtttgtctttacatgagcgtcccccccacctctttgttgttgttgttgttttgttttttttttttttttttgttttttttgtttttttttgacaaaggtgctttttagttttttgttgttgttttttgtttggtggttt

SEQ ID NO: 35962 - DNA, 1126 bp, Mus musculus
tttattgttgtatctattttatacatacattataatttcattctttatgtctagaaaattccattatgcataggtataatgaatgttttttatctgaacctctgctggacacctaggctaattttataactaagttattatcaataatgctacaataaaaatttatgaaccaatagttctgtgatattctgatgtcgagtcttcccagtaaatactggaaagtgatgttaagttctgatttttgttctgttacttaatcttaatgtttttaagttgtgcactaaataaatctatgttatataagttgaataataatttttaattatgtgctttcaagttttattgaagaaaactcaggaattcatagcatgttcatcttttccctgttaggcatttgaaaatctgacaatagtatttgaaatttttacaggtaaaaagtgaagtgaataaattgtacaaactgcttgaaatagacattgatgctgttttcaagtctctgctgttgctgaagaaaaagaaatatgctgctctagttgttgaaccaacatcagatgggaattacattaccaagcaggagctgaaaggattagatatagttagaagagactggtgtgatcttgccaaggacactggaaagtgagtttaacttttatttacttttgttgttggtcttttgaatttttgtttaaaaaaaaaaaaaaagatccaagggcaggggctggagagatggcacagcagttaagagcacttacggctcttccagaagaactgggttcaattctcgccatccaaatggcagctcacaactgtctataattctaagatctgacaccttcacacagacatgcatgcaggcaaaataccaatggatgtaaaataaaaagaaataaattctttttaaagaattcaagtgctattgaaatgtctatgagtctgccaagtataaggatacaacttccctctttgttgttattgttactattacatattacaaataaaatttaacagattaaaagttagataatgctaaatttgcacaagaagagacactggttttaagatagcatctcctggtgagaataaatctttacacctggatccttagagagctgattttgttgatagt

SEQ ID NO: 35963 - DNA, 1201 bp, Mus musculus
cttatctgttgtacctgttggaacatatctggaaagatgccagattcattttgcagatcatgtgtgagctaaatgttcttccattagcattgcagatcactaacatcgctgggaacattatggtaaatttaacttagaaatggggaaaaagcatttcctgttggattcagtgtttgcttggggtagttgttatatgataatgagtctaaatgcatgcttataaaatgaggaactgggattctgaaagggcttcttttgtaaaaggaaaaatggttgggagaaagggaggaatgccaggtgcagtatgtggagatttgggttaacataaggactttatctctaacatctggatgtttctggtgcagtgatatcgtttggactaagaaaataatcacacttgtcagtatttgaagctccttttaccccctaaatgcttaaagagaaagttagaaataatttagtaaaagcaaccttggttattgtgagttgctgaaggaggtgccatggttaaattaactgactcaaagctgattttgtttgtggttgttttgagttcaaaaatttaaaaattctgtttaatagtctaggacactgatgggtggacgatctgagcgaaatgagtttttgttgcttcatgcattttatgaaaacaactatattgtgcctgacaagcagattttcagaaaacctcagcaaaaactggtgggttcaaaatcatatagtaccttgccttttcttttcccttttttttttattacctagatagcctttagaaatattgctttaacatatgcttctaaaataattaatcccctctaaactatgaccattctcaagtttgctgcattgtgtctgtatggttgtttttgtctctactttctctgtaatgtcaatattatttgtgaaatgtctttgaggactttaatagacttctttgatgaattaccatatatggaaaatatttgcctccactcagatttacccaaaggtaaatgttaattaagtcttttgtagttttaacctttgagcttttatgtttattttgtactatctgtatgcatatgtatgtatgttgaatatccctaatacataatgtttggaattggaagtgcttcagatttacttattttattttgaaagatttgtatatatgtagtgggaaatcttggggtgaggatgtgtgtccaaacactaaattcac

SEQ ID NO: 35964 - DNA, 1183 bp, Mus musculus
tgacttcctgggtattgggaaagtggtatcaggaaatattcagagaggacagtatgcagcattatcattgtgaagttttatctcttaaatgagaaaccaaatagagatagcagcctggaaaatacacggaacataacggtttttagatcatttcagcaaacacttatttaccctctctgtgaacgtcactgtgaatgcctgctatatatgggacaagccttcagcttccccttactgggaaggaagccttggtctactgtacagcttagctttgagaaagtggaactaatttcttctgttgtgttgtggttgaagctttggtggtaattggatttcctttgggaaaacttatcatgatctttcattctaacttggaaggcaagtttttgattaaagcattctgtacatttgtagatgtataaggatctcggcttgactgttgttttgagatccagcaacacggctgattgaagatctaggccttcttaactttttagggctcacaagaaatttatatttaaagcaatttctatttagaagcatgtagactctgcaattggactaagatgagtgatagaatctcatttttccttcctatagttgtgtctaaaccaaaggactgtattttcccatgtgatttcaaagaagtgatttcgaaaaaggtaaatactcattccctttaaatattgaatatctgtttggaaagagaataggagaatggaatggactagtagaaacaatctattctgtattttaataaaatctattcttggtacattaaattgataaaatgcattaggaatataagattagacctgtaataattcttaagttagtttctgaagataatgaaattatgacatggatacattcaaatttcccttcagttagcttatatggaagcttttccaaagtgatcatgtattttgggaccatattgggtagagctcttacccaacttgagggaaaccatatagggctgggaatactgtgggtgttaaagggccatgtaatgacagggttgatatttgctgacctaaatgcctcaatatttttttttaaactccaaataagttctgtgaagttggtatcataatcccttaacaaatagcagaggaaacagtataatgaactcagttcttcacaaaaagtaaatgtatttgctctaaagaatgtagttttt

SEQ ID NO: 35965 - DNA, 1197 bp, Mus musculus
aaatgcaataattttcttcctggaaacaagtatttttttgtataaatccaggtaacagtaaaataattgaagccattacattaataatacataaaatctttttataagtgcgaactgtcattatctttggtcagggcaggacagttaagtatttttagtatgcagttctaactgactaaacacttaaaaacatttacaggcaattccttcaggaaaacctgcttcccctgtcctcaggaatgagcctctgttaactcccattcctcttaaacgtgctgaacttgctggtaagtctcatgttaggcaaaagtgcaagttgttgagcaacaactgccacacatggaagcttggtgatacagggtaatgttgaaggtggcaatctaagcatgaaaggttgaatttatagtagtaaaagttgaaagcatccaagatgaagagtaaagagaaatacaatataatgtaggaaagggctgttatttcaatgttggaccagctttgtaacatgtgatgggaatatatggtgatgtctacaggagagctggctcagccagaatgtccagaagatgagcaggagctaggggtaatggagtttgaagacggtgactttgatgagtccatggacacagagaaggtagatgagaagcctgtgactgctaagacttgggaccaagagactgagccagtagaaagggtggaacatgaggcagatcctgagaggggaaccacatcttacttgtaagtgcgttttatgattgttctgaaatatagtactctaaatattctgttggcttttataaagtttttgaaaatgtgatttctacagagaaaattttctgccagatgtctcttgttgggacattgatcaggatgatgaaagcatacctcaggaagttcaagtggattccagtaatctcccattggtaaaaggggcagatgatgaacaagtgtttcagttttattggctggatgcttatgaagatccatacaaccaaccaggtaatcatacctaaggtaatcttagacttttattacacagtgtagtgcctgttcccttaaatacgttagtgataccgattgcctttgtttttctaatagaatcagacattaatttgtctcttttaaagttaattaacagtttcggggtggttgttgtttgtttgagacagagcctctctattatgtagctttggttgtcct

SEQ ID NO: 35966 - DNA, 2961 bp, Mus musculus
agacgcagcttcgcgttggtcagatagaaaagtgtgacccttaatctctcactcaaaggacagttgtgtcaaggtgaactccacccaaggcctgccatgcttctggctgtacattttcatctttggcatgaggagactgttttccagaaattacctgaattgatgggaatcacagcaaggaagcccgtcttatctaaaaaagaaataaccacacaaaccttcttagcaggagctgcgctgctttggctccatgtatggaagatgaaaaatatctcttggagcttcttaaaggatcagctctttccatttctgaccacatcacagttcatagactcgaataacagtttgatgtaacaaacacttagtataccgatagggggtgctacctgcacgtatctgttctatgtatcctccaatatgccaccccagggtgtatcccatatgcaatatgaatctatggtggtggtgttggactctagatccctctcctgctctcccccatgacaccctgctgaaatgcttgatctcaagaaccgcctggttccctcatgacttgggcactttgtcaaaagctcaatcaaatgttagattccggtagaaatgttttgtcccagaaaattcctgttgttcttcacccatgacattttgggtaaagggaaggctcaatcttttgaatggtctgagagacactgaagttatttctggcccttgcttctccaaatgggatagagactctcagatgactggagaactacatggggccgctgttccctaatcacatgcagggaatgagcaggtccagtcaaggtttagagctaatctcttaggtacaaatagaatttcctgagtatcctagtaaagacagaaagacagcactgcagcttgactaagtgaaggccttaacatgtaactggtgggcaaagtccaacacctccagtgacagaaacaccccctgccttcagaggctttgggaacatgcattctggggggggggtagggagacaactcatgaagaaaggtaccctgtctttcccctttgtgttggggtcaaactacctccctgctcacctgaagatcagtggtgactgttgctaaggcaacctggagcctccttgttcctggtacttcttccagaagtttgtaaagtgctcatgaaagatgggggatcgctgggaatccagcctgcgagaaagaaacttcttttcatagtcaaggccctcttggagaatcacaccccagaggcaagggcttccattcctccacggtatcggtttgacctcagcctcccaccatgtacccaggacaaattgtgcgtgtatgccttctatttcagccagctgacacttgtggcagtgcagggacaaggagagcaactgagcaaatgaagaagaggagaagagggtcctagagagaggaaagaaagaaagctaaaaccatctacgctcttaagccacttctggttgtatgtgcggagactctctgttgaggaagcctttttaaaaagttctggctctatgacccagggcagataggtccacttttacctaagtcttgctctgaggcagagaatgtagaggtgacatatcaggtgagtataattttgcaggccctacacaccatcctgccaggtgccacatacgtgactcatcagagagtgccactgtagctgtgaatgatgggaagtgaccaacatcagaatcatcccaggtacaaacagacacttaagtgggtttaaacttccttctcagtttgcaacagcatctcctcaccttcccaaagccacgagcttgccaccaagaaatggggcggattctgctagccaacctttggcccttcttgaccatctcacaggccttcccagccctgacccaggtttaccaccccccacacctgggaggagccatgactgcactttgtgtgggttcttcaggcaattctcatggtcaagggcgagttaaggatcgaatgacagcataacacgtgctgcaggcttggagaagtaagaaaagggatagaagccggggaatgggctccttttcctccatgaaaggaaagaagctacttagagaacccattccctaaggttgggaatgggaagatggaaaaaatgacactggagttggtgagtatgggaggatttatattttctactttccttccaggcatcactaggaaggaggaaggcttcctattgtatccttccatggctagtggatccccatgcagcaggtggggtcctggcctctccagcttctttggcatattagcaattctcatatctctccccacccctggaaaccaagtgctgactctccatgtaaacaacaggggtgtagttgtaatatggtgtatggcccatgtctgccacaaattgtcaggataacccagagacaaagataaaccaggcttgtgacagacacagtgtggcttctgacatgctgtgggtgggggagactcagccattctatgacctaggctacaagatactgcggttacactggtgggttgtggccacaggaagaacatggcttattttccctcagtcttcaggactttttaaaatgcccagtcctactccacagatgagactggttttcaggcatctactcagcaactccagtcttgtcctaaccatctgatgaggaaggaaggaaggaaggaaggaaggaaggaaggaaggaaggaaggaaggaagtgagcaagagataagtgagctcattaggcaaattttttacttctcctcttctctagttttctgttgtgtcgctgcagtgtgtctggggacaaagccataagaagcctatctacttaaaattctgctgtacatagaagccgagggcttgtctggattcaagaatgatcttatgcccaagcatttgctctggtgctgaatagtgcaaactactggaaccaccccaaccctaccactgaaacccctagacccaatccagtctcctgatc

SEQ ID NO: 35967 - DNA, 1669 bp, Mus musculus
tttgcaaacgtcaaagatccatatgtgtagtaactgagcaatgctggccagccctgcagtttgctcagtaaagaggtgcagaagtgtggcaggtggggctggtctaattgctctcccgctcagcctgacatcaccaattgattgaaattggcccagtgccaatagaattcatagtgacaacagaattgcttcatgtttcaaatgatcttaccctccagttcttcttgagaaagaaaaagtgcaaccttagcactcagtgggaacatctcttaggcattgacgcatgctagtcacaaggagattgtgacagttaaccgtgacgacaaggcagtggcagtcaccacttagctatgctgaatgtcaggtccaggaagagtctatgaagtcagtcagggcaagattgaaatgtgatattgtttacattgtggaatccatttcacataatggcttgctttctctttgtcatttgaatcatttttagaagctttaatctttatcttaattaaaagcatatttttttaagaataacttctacctttatgttaaatgttgagcttaatatcccacatgtaattaggagttttgaacacattgacaactgaagcctgtaacttacagggagatgaaaagacttgagactacctgccgctctaaagggaccaggctggaccttgcagtctcacttggcaagtcctttcaggaagcagaattttcccaattgtttatccagcatgaaaagggaaatagaagggccaaccatgcctgttccctttcttgctgggtgttatataacttcctggggaaacatcaccaagtcaattgctttcttttcacatcaaaaaggacctcttacgcagggtggtggtggctgcagcgcacacctttaatcccagcacttgggagacagaggcaggctgatctctgagtccaaggccagccagggctatacacagaaatccagtctcaaaacaacatcaataacaaaaaagttcctcttagagctgagatattatttagaccaatagacatttgtgagactaataagtgtatcttgactcagatggcagcaaagtttacttatagtgctttatagcactaagtgatttcagatgttccgggaactttgctggggatttagctcaatggttgagcacttccctggcatatgtggaggcctggcttccacccctagcactgaaaacaggaaacaaattgctgtgaattgtcatctccacagttccttctgtccattgttccagctgcttctctcttaacgccgtactcagaatcggagctcaagttgtgattgcatcagtcctggacaataacactattagaaaaaagggaaggctaaccctaatctctgctgagttcgtactttaacgtgctttgaagttataattgctgcttaaggtttataagcagagcatttgctcttccaagttcccacccaagtgcttgaagtggaactgtttcccatatttcgagcctgaccttagaaggcctgggaagcactcgggctgttcgagaggtgtgagtgaaaaaggtcagtgctttgccaagttctctttgtaactccttgactaattagggttgtctacatgaaataattgctgctttgataagagacaaatattaacttacacatgaaatgaatgttcgttgcaga

SEQ ID NO: 35968 - DNA, 1204 bp, Mus musculus
actatttaatcaatgcaggatttttgtttgctgttctgggtgaaaagataacttttaactccagttcctgtcacactgattagagctatcagtacctcctggcttgaaaacaggggacatgtgaaattttaatgaacttgagaggttatcagccactggcagtgattaattagttaattaaacatgggagaatacttcaaactaggtggacataatcagttatcaagagaagtataagcgtgttttattagcagtttgtagacagtctccctgatgtctggtgttgaccattttaagagctttgctgtgacatattttcttttcaaccaaacattttcaaatgtgattcactaaaagaaagctctgttggtcctgaccaggtgcccctgcaatcccagcgtgcacggagtgagagcagggacaaatgagaggccagactagggtacaaagtgagagcttgtgtgaaaaagtaaaggagaagataacagagggaagggaggaagaaaggaagaacaaagggcaaagaagggagggaaggatataaggaaagaggcgagaagtctttgttgtggcttattcttagtatttacgaatatgcattcaaatagtttgtaggtccggggcctactgtagaagaacatgagatactgttctgaaagtgtatgtgcaggtagatcatgaggcaaaggcttatttggaatgcttgtaggattgaaacttcaatcagtagctggaacatcctagttgccagccagcagcaaacttatcacctgcagaattcccattcaatgaccaaggaccacatccccggaactgtgcatgggacagggcatttccccgaggccagccttcaccttgagttgtgctggtgtgaagtagatgactgaacgcaggtgtccttagctaagcaagactgggaatgaaggtagcagacaggagtcatgggaaggaagatgaagtccagccttcaatttcaataatatgttaccatatgctagaaactatactcactgctggacatgtgacagtgaccaaagcagagtgaaatccctgcctcaggagcttcccttccagtggggacaagatagagtgattttgtgcttcacttaggaaacaagaactgtgggggtaaatgagaggcttaaatgtcttcaggatttcccaagtttctcgttttaagatatcagtctgaattgtgaaagtc

SEQ ID NO: 35969 - DNA, 4153 bp, Mus musculus
acttgagagaacaaaacttttgtaaagtttacataaataatagaatgctactttttctggagtaactatagaaaacaattctgagtcaaggcaaaggttttggacttattactgtaaatgttctgaataagttttggttaaaataaaggagactatactcatgagctctctggatccttttctttatagggacaagatcaagagtaatagaactttctagaaagctgagtgctgtctctgaagtctctgaagaaagaataccttctgcaagtcaaccagagacgcgtatttctaccaactcttaaccatgacggcactattgttatcccaatgcttagttgctttctttataatggctcactatgtccatggagcccttcccatagtctttcccattgtatcttccactaaagcttgagcaatttttcattgtgtcttgctgtggcatcattagcacccgtcacaaaagagcacagaacctcctagcgctcttgtaccctatattctgtatcttgttatggagtttagtgtctgaagtcttccagcattctgagctcatttctgatacaaacctccagctagggcttgggcagtcggatgcatcagtggagctcatcttgaaaattcagtaccagggttcttcctgtcccatatacatcacccttcactctctgatttggacctttgtgcccccttcagctgactgggttctcattgtgaggtgtggtacttggatgttagaacctgtccatctgtatcaattttattttaaagttcatttgcttacttctgttccattgattaaagcactctaaacgttgtcttggaatttctcacttaacaccttggtttgaaagatttttaagtgaaaagtcacctgctaatctattcagactacagagtgggaagtgcaggggtttgtttccatgaaagctccactatgtttgtttgccatatgaaattcctcttgtagtcatcttaggaactagaagttcctgtgtcatgtaacagattcactgtaacagagattgtcacgttttcaaaaatgttacaaaccttgataattttcattgtcattactttcaccagttttagaactgtccactcaatctgactttttctttctttattttgttttgtttttcaccatcgggtttcactgtgtagctctggctgtcctggaactcactatgtagaccagactgacctcagacacacagagatcatctacctctgcctcctgagtgctgggattaaattcgtgctccactaccacctggctctcaatttgttaatcgttagaagtaggacttagcagaggtcttggggtgagagaagagaaatgatgtgctatttatccttaacaatagaggctatctgagagtctggattcataccaatacctagcctattcagctcgctgctatgtgtttccctcttggctatatttttccctgtatatgccattcacgctgacttctagtatcatttactatatgtatgaatgtttctgtccagtcatcagtgttgaatctagatttagttttagtttgtagccaggcatctggcaaacacctgcaatctcagttctccagatcttgagacaggaggatcatgatcatagcctgagctatgtaccaagactctgcttagaaaagtttgaacgtgtgttcatcattgctcctttctcattagtgctgtagcaatgtagtcctccccaccgcctccccagtgaggggctctgcctcggaggcttgctctgacttagccagacttggctcacttgtaggtctctttgaattgcacaccatctgattttcttccatttccttgtattacctgagtccctcgtggctccttttgtctttataaagacctcattgcaaagctgacatgtagtcaaaaaatgttgataaaattcaaagagactgagactcataggtcacaagtctaagtcgtcttaagtcggtgtcttgaaggttaagctgtgtgaccattttcctatgatggagaagctgtgaaaatacttacatttaaagacattgactaccttgtaagcaccagacagtatgtccatatcttcctgagtctcagtttccagccatccttctttacacttgcaagtttgaccatgggagaacaacaggttcatattatggttaccttgcttcagcaccgtttttattgtttaaggactgtctgttgattggtctgcttccacaacagatgccacagaagggttgggtattgtgtagaaaaactttatcatattctttgtccttttgaaaagccagcttttgtttaaaggtcttaagatttaatccacagttctctaatattcttgggcttatactcatgtctgtctaagcctggtgcattccagacattcctgtctttgtgtcatcaataatttaacctcagccccaaaacagtcataagaggagtttcagggacatcctgtattctcaaagtttattctccccgtgactaatttacgtatcctctctgctggcagtgcatgagcctttgagctctatgaatttctacatatgttacagattgatgctgaccactttccagctgaattcttccccatttctctgtaatgcccttccgtttatactttcgtcctattttacgtatttggggagctgtgtatacaatttgaagcagtacctggcacacagtaggtacttaatatgtatgtgttcagtcaaaagggtgaaaactaatagaagtttacaatggctggtgaggaagcctctttctgagttcttcagatatccgcgacttgaaattggtaatgattcatgtcaagagctggagcagtactgaatttctttttatagtgctaaaagacggctttaaaaatgtggagaagtgacaggaatcagaaatggatccacatgagccgtctgattctttgcctctgaatatctggtctcagattccttatagaagggcttcttcctatcttgtgacatggttttatagctttcttaaggattccaaagaactcaacattcagcacccgatgtgatccttacgatggcaggaggtggactgtacaaagtagctttccttttccatgtgacttcagagcactttagtggcttgccaaggagccatggaaagtgagtagtagaagctgtgttctatgcttgggtcttcttgttcctgggccagtgctctgaacaatatgtcaagtgcttgggatccgcttttaagatgaatttcttgagcatattaatcctaagtcagaagttttctgtaatgcaagacagttctactcaggaaatgtttccttttgtgcttttccattctggcatgtttaaaggagacaagtggaccaggcggcttttgcctcacgaaacagaactttagaccagtgtgggtcatgactagagtttatatttgaatgagatcagtgcctgctgccagcctttttgtataaaacttctacatttggaagttgatggttttgtgttttggtagactcaattacagcttcaattaaatgctcttgcacgttctttctgttgccattacttataatagctcggctagctgtcggagccttggatctttagcgactttatggtctatagctgctggcgctctgaggtccttaagtacaaatggatttttttttccttcagttttgtagataacctgcttgcttggcacggctgcctgtttgttcttggtattttgtcacttcatttcagtatagctcagggttggcagttgtcttttggcctttcctggcacacagtaagcttccgctagtcccatattaggccttattacatttcatatagttttgtactgttcttcagaaatgggtctctccatcagcatgtgttacccatctttcccatttatcttcctttatggctttctttcatctccgtgtcttccttcgtgtgtgatctctccacgcccgagtctcatcccccatgtcacctgctggttttctctgctggtttccccaggccctgtgcttgctttcacatctttcatgaccttatcatttaatttacttctcgtggcttattactctccgatgccttatttctttgaggaccaagccttttagtctaaatgtagtggtttctgaaatcattccttttccagaatggatttgtgtatc

SEQ ID NO: 35970 - DNA, 1190 bp, Mus musculus
accaggctggcctcaaattcacagagacccatctgctccttctgcctcctgagtgctgggattaaagagggtaccaccaacacctgtcctcttttaacaattttaaggacgcagcttagtattaataagtacaatcccactgttgtgcaacatagttctagaacatttttgatttgggggattgaaactgtacctgataactctcaattccccatttcctatccccgacctgagctgcaacccttctacttttggcacagagtcaccaagattcatacatgttgtgccttgtgacagaaggtcatggcggtaaaactcatttccctgtgttaaatacataagaacttgacttgtgacccaggagaaatgtctttcaagggaacttggtatttctttagattaaaaagcttgagtgcagggtctgaaatgcaattgatgcaggtgcactgtgaaacactaatacatttttttgtttgtttgtttgttattggagacagggtttctctgggtaactctggttgtcctgaattcaccctgtagaccagagtggcctgaaaactcacagatgtccacctgcctctgtctccagagtgcagctagtaaaggtgtgtaccacccccacctggcctgattaggactgtcacactgaaattgagtatagcctagactggcactcctgtgcaagggagcccatggcagacttgtctgatgagcatcccaccctcagaaggtttgccctgcaaccagggctctggcagaccccagctctcctccagaccctgccactggcccggaaaaggccatctggggtggcttgctgtggctctccttgtgaagccatttatgtgttttagaacattctaggttactggcacggaggcaataagtaagaacttaaagcgcagtcttccagactgcttcttgcatgcctacagctgtctgaggctgttaagtgggaagtcctcctccactgcccccaccccggttcctcctcatcagttgtttgacactccctgcctgcccacctcatctcagttccttgtttcagtggactgggctgctctgccttttagagggttgaggttggagcagttctgtaacaagcattgatccacatcaaggtgcagctccttagcatttataacatgggcagtgctgtgcagccaagccctccctctgtttccaacaca

SEQ ID NO: 35971 - DNA, 1191 bp, Mus musculus
aggaggaggaggaggaggaggaggattactatcacgagaacaactattacaacaataacgactactatgacgatgaagactactaccagtacgaagacaactattataaggacgaagatgatgaaatctactacgaggctgactaccaggaggagggagaggatgaagaggacgaagaggatgaggatgctttctatgaggctaactatttcggtgaggaggatgaagaggagccagcggagccagctgagccagcggagccagccaaacccaaggaggaagcagacgccgctgaggcctcctctggaggcaaattgcagtacttcagcgcctgaaggccacaagccccagctgctgcccatttacttagccacagaactttctgcactatgaacgcctgcctttcgatcgcttgctctctctctcaatgaaagtatcctttcctctcttgttttatgcactgtaatatagaaaataacttactttgatgatcgaggtcttggcggcttgcctgaccctgaagaaaagaggggtgtgtgtgtgcacctacattatacagaaacttaccctcaacactaggccactgctgaactgtcctctctgagtgccctggattctgccactttgaaattatgtgaagtttctcaacagtcaagagccgttactcagaaaagtctctcgtaagtaagccgatttatgctgacccattgtatcccttttagtaggttttatgtctctttgggaaattaagtagaggccaaaacgtcttccttaagattgctagagtgaggccgttcctactggaagaggccagagatcagatagtggcactggaatatatgggtgggggctgctgtgctgtgttttgtttgcgtgtttgcagtgcatccacgctcttgggtgtctgcagttggaaggtagaattccgatcatttgactaccagtcccttcctaagggaaaggagaggctggactttggtttgttgatttactgtttcaaaaggcctggtttgggggctctggttcactcagtacagtcagttgtagcattccggagaaatgggaaccaaactgttgtcagaggaagcagccaaaagaggctgtgatctgaatgaagtacgcagttaaaaagaaatgatttattaaaaaaaaaaaagtaaaagaatgagcactaagattgtgtatgtaaaa

SEQ ID NO: 35972 - DNA, 1180 bp, Mus musculus
ttccatgaataagctctgcttcaaaggatgacaccaagcatcaccaagcaaaatacctttgattagtcttctctatgccctaggaggctggccctgtcttctgtgacatatagcttctattcatggaggatctactagtatgagtttaaggtccttacctacagtacattatctgctatgactcaggagaaaattctgacaacactaatgtgacgccattctccaggagcatccagccccatgaacacgaatgagatgagcagacagatagacagggatggatatgctcactcaactccagaacacttcaccagccctgatcttaaggctctgagtttaaggtgactttctgagaaaagtcacctggttattaggacactggtctagggactggtcctaggctggtcctcagttgccttttttgaatggactaacctaccatttgaccttgtcattctttaatcattcccaggcccttggagcatcaccccatcagaaaaactaccaaaagaaatggctggaaaatggcatctgatcttcaggcctggggaagaagatttaacgacttggtttcctgttcattcgctgcttttccaggagtgctgctttgccatagactgtgggtctggccagctgacccatttcggcccaccattccacatttccacatggcttttcctccgtttaatgaaaatgttggaaggtaggtcttcttgcttctccagggtctgtttggtttccccaagtggggttcactttcttcctttcctcaggtaccctgtggcttctctcctcctgccctcataaaacaagttaagtaaaaccccaggtctcagaaaaggccttttggagtctagtcacagacttcctagtttaaagctgctactctgactcctgctttcccatatcaagtcagagactccgtgcttccagaccaaggcccctgaaatcagataagaagctgttgactaagactgtgtgcaggctggcctgcgcacatcacctttgcttttttttttaattccagtctttccccttagggtgttcacatcgctcttacttaggcctgctaaaacacaaagagccctttagggctgtccaaaagatggaggtcccaagggtgtctttaggctctggttgcagattttgttgatgtggcaagtgggcatagaaattgagc

SEQ ID NO: 35973 - DNA, 2465 bp, Mus musculus
aatcttgaaagaaaacctgaatgagccatagtcgcctctcttcaccaagaatgacttgtttgaggagtaaatcctacccaaagcccagcctgacaacctcatctagcccatcatcatgaagagggcccccacactcttacatccaccctcatcactacagatgtgggccctagggtggcctgtcagaaattgttggtgttagtagtgagcattaaagatgtcacaaattcaaaagtaccttcatatgggattcacagatgaaactcctttttgttgttgttgttgttgttgttgttgttgtttttgtttttttgagacagggtttctctgtgtagccctggctgtcctggaactcactttgtaggccaggctggcctctaactcagaaatctgcctgcctctgcctcccaagtgctgggattaaaggcatgcgccaccaccgcccggcacagatgtaactcctaaacaaatgatcttttcttacttttttttttttaacaggaaaaacaactcaggccgtgagctcaacttttaatcttctgtggaaagcttcaaagcaggaaatgcataccttgatcaagaaaatggtgaacacgttttatagaactgatttcctttaggcccattgtcctttcctgggacagaaaataactaaactgatttagggaacagccaaatattttctttcaccttaaagttcttagagaaatgtatttttcttatgagacaggttttcattttcttatacatgttctgttttatgacttaatatttccccatcaaacaaaaggatcttagggaaaacgaggtgaccaaaactaaagaatactattagtggtgactaggggacaatcttaggcaatatggccatctgtcaataatatggattcgtttattttcggcagctttttttttgtcaaagttgtataaagaaaatgactcttgatattagctgatttgaccattggtcccctttaaaaatgaaagttctatttaactaatttggttacttccatagctggaagggtacttgtatatgagaaattttatttttttcaaagtttagaatatctagtggaatgcatattaatatgccactcagagggtttgacaaaatgaacagtgaaaaccaagccttcactgacaaaggactattaccccaatatataaccagctattaacactcagacttaaaaagaacaaaactcagaccagacactttactaaataagattctttaactcctagctttttgacctaagcagctatcatgataaagttgccatttcctgagttgggaatgttccctgggcaagtgtatactatgttaccttaccgaaagcttaactacatttcctaatgtttttcctctagacctgtccactgttgagagcctcaggagtatactacagttctaggttacagtggtcaaaataaaaactgatgtgatctggaaggcagaactggagcatcagctgttccaccttgaagatttctgccaggtaccaggcactgctgcagttcacacacactgttgctgacctggtacctcaccctgttaagaggctccagtgatagtatggaacaggggtaggcagtagctgtaacttcagctctcactggatctcttccccctcagcttttctgaatccagggccaagtttctatacagctcagtgagaagcattcaaggcagtgagccccagacaggataatcctcactggttccatcaaaccttgtgagctttgatttcttttgtttcgtctcccacttttcttgctttcttgcactgctaaaccaccatgaatcaggttcactctctgagacagaagcaacaaccctccatagattccagtagcttccctcaatgattcttgatggataatgactttgctcttatccttcaactgttttctcccacaccttacttccctagcttctgccatgattgtatggagcctgattcctaaaaataaatgctattctatagcacacacagtgattccaattctttcttgaaacgccaccgatgcactgccaaaggagctagttgtgaccagaagttcagattcaatgtgtgaaaatttagatttcctagtcagcatccaggtaaagattttgaataggaaagcttgatgatgtgagtagtatgtggtccaggctagagatggaaattgacaagccatacaggtaaagcaaaaaaaatcattatcagtgtataggttaaatcaatgtataggtagtcttaaagccacaagatgagatgaggtcactaaagtactaaaggctagcagggaaaaatcagtaaaaatactggataagaccccggagctcttgactctagctgcatatgtatcaaaagatggcctagtcggccatcactggaaagagaggcccattggacacgcaaactttatatgccccagtacaggggaacgccagggccaaaaagggggagtgggtg

SEQ ID NO: 35974 - DNA, 2443 bp, Mus musculus
aactatgatttgttttattgccctgttattcttgaaagctgtcttttttgtgagaacttttaaaacctacttcattttttccccagaagtaatataaaacacctgacattgaaatttatgaaatttaagaatcatctacaatcagtacagaacaaatgattggactatttaacatatatttttttaaataaactgaaagataaggaacactttacacaatttatatttctctttacataatctggaaccacacagttcttttctttttaaagcacaatattgaagcctttaaaaggtatttaagggtttggtcaagtgaatataaaatgtgtctgtataaaaagaaaatgaagtagtcactgttacgtactgacattagttacaacctagttttaattcttaaaacaattttgattagcaaagctaaaaaagggtgtttcagttaaatgttttaaagaggtacagatttttacaaggacataatataagttattgttctgtagaaatatcctattaaatattgtatgtccctccctctgtatactttgtaaaaaaagtaaaatacataaaaagaaaatcatataggggatgtgtgacattattgtaattgtgtacttgagaataacgtgcaaaaataaaaatcagaatattttcctgttaacgaatgttcagtctatttgataccagtactaagttaaagctttttcttaagaaagaaaatgtacagtttttgtaaacctaataaacatcaaaagcagtggattattttcatccccctatttcttaattccttttatgcagcagtggaatgcaaaatgcttggttgctttgaattttgtgacttggatgcaaatactggtatttcagtcctgtgaatttgcaagtaacattgagaagttaagaggtgattggtgagtcctttgatgagcatgtccttgaaattcattttttcttttatctttgtaaatgatttgttttattagcatctctgattcctgttataaattacccacccataaagtgggtttgaaagcacttaagatttgttttattatcagttcacaacacatttcatctgaggccctaccttttagttacccatttgtgcccaggttggaggcctctagtagactcagatcttggaggatggtcactgtcgtagtgaaaatggcaagttggataaaggttgggaatcctgagaaatgtgcagcacttttgatattaacaatgagattctgtaatctagaaaccagcgttggtctgagagatgaggtgacaaataactaaaccttgaggtacatgtccacaagaatgtggtggaagtcagttgtgagtctgagcatacctgatctcacccattctgctaaaatatgctgccttatcgttgccagggatctcggtattaatttcctgcaaaatcttacatttgtgtaaggaaatgcaagctcagtcagcatcttaaagaggatccatgtccaaatgatgcctgtcagcaaggtagcctgccctcttagtccagtccccagtgagccgggacgaggcatgagcctgtgtttcagcaggctccccgggttgttctgctccaggctcaggttagtgaaagcgatcctagagcacttgaggaacggaaagcttacttggtgtgatgttttgtgtagttgtcaaggggctcagcaaaagcagctagagatggtgcagtgagaatacattataatccagagactgactgcctttagcctttccgtaaaagtcctgagtcttgtcagtcactaagtccgtccttcagtgcacgtctgaacagcctgtccctcctactcttacatagcccccagtgttgcattcctcaaacgtaggaagacttgataagtaaagagaaggactgaaaattgtgtgttcttgtgtgtttaattggcccagagttaataaagtaattcatattaaaaaggacattttgctgcattttacaactttttaggaggtcaaagttaagtttgccctatggattttgtttttatcttttgtttcatgtatatattgtttgcctttttcataaaataattcttggatttgttatatattgttcctgttatttttgacatctttgctattgtaaataaattcctattttgttttaagttaccctagtggagtgttggctatagacaaggcatacatgggacacttcagcacatgtcacacacatgcacacagaaatgagacttggaccacacaaccaacccccaccttgttagaagcccagtgtgctgtgaccccttcactttcacacttctcaccttcaagggaaccactgtggctttaagtagagcacctgtaactactcgaagtttatttggctagcctgactgactagcaagctccagggatgcccctgactctgcctcccccatcctgagatgagaggcatgtgtcattgtgggagttt

SEQ ID NO: 35975 - DNA, 1147 bp, Mus musculus
taggatcttttgcaactttatatatgtaaatgtaccctgaattatatatatctatctatatatacacatatatatgtaacatgtatctgtgtgtattgcttattttacatacttatacacacaacccccagtagtagttctttaaaatctataatgaaaagtattaaatttacagtaacatgaaagatccagggatgcaagagagagcattttgtaagtcttgctcttcagagagactactcaggtgaagaattagaaggaaaataaggacactagtatttttaaagagtaaaggtattttcttttaaatatctttggtaattgaaaaatagaggttaagatgtttatagatacaatgttttcatacagtttcaactccatgcctttatatttttctgaaaagctaatgggtatccagacatgaatcccccagttctctctgataagccggagagggaactcttgtctgaccaagcgagggggacagaaagggagtgatggctccgtggaccagtgaacgggtgctaaggaggacttagactcggccagttgagcctgctctgttagttcttagttaactagaaaaacttaacactcgcttgtcttggattacacgatagaggtgtggtccaagtgtgtgaacagtctgaggcctcacttggatccttaccaagtctttcacagttttgtttttgagagctggcaatttgtaacatacaggtctgatcgctgataaaatttgtaaaaataagttggatattaagatttttgttaagatgtctttttggaaaaccgtttctagagtccctggaattggctgttggcacacgggtctggcacatcacgggagacttagatgtttcttcccactcgatagctgccttgctgcctcattatggtgctccatccctttcgtgccgttagttttgaccttccatccttctctttgtcatcaagatttgtattcaaaagttatatttttggggttagatgtcttgagtatttggtgtttggcaaacctctgaagtgctagatcgatttagtctagttctaaatcaaattcttaaggctggtatgaagtccatcctcaatgccagtcaatgccaaggcagggttccctaagcttcccacccgctagggactcctt

SEQ ID NO: 35976 - DNA, 1098 bp, Mus musculus
attcttagagctgctgttttccttgataggtggaactgtagatatcgtcgaaagtgagcctgagaatgagcatggagttgaactactcgatccaaacaatagtattcgcgttcccagggaaaagatggtttatatggctgttaacgactctcagcaagaagaagaagaactgagtaagtagatgctctttctgtgttcctaatgttttctctgtctcttttcaatggtcagtatttgaaggaagtaagcggcatcatttgagaaattactatgctgccatgttctcagggaatcagtattcactcatgtaggtttagaatgtttgctactttaaaactagattatggtgaaaaccaagagaagagttattcagcaagtgtttattttacaaaagctgtattctagctaatgtttagcttcccatttgcatattagctgaattcaaatgaaagtatctctcctatgagctatgagaacctggtcagagaagttcatctaattttctacttagatgtcgctgagattgctgatgaagtttatatggaagtgattgttggagaggaggatgctgcagctgcagccgcagccgcagtgcatgaacagcaagtggaggacaacgaaatgaaaaccttcatgccgattgcatgggcagctgcttacggtaagtcacagagccactctttggacatgaatttgtgattgaaaagcagtttttgtgattttaggtttagaaatcggaaatgttagtactatataaggattatttgatttaaacaagagcagaggaggattataaaactactttttgtcctgattttaaacaagcatttcctcctgtttacattatataaggaaataaactgtatgaagcatacaggcttttaactgtatcaggtccatagctttaaaatcttgggggatagcatgggacccctgggggaaaattctgatgcatgtttccattttggaagctaggcatttccagtggtcttactataatgagtatgctcataaaacttgggtatttttgtcattcatgagtatcatggcttttcattgtgggagttaataaagaattcctaattctttataatttat

SEQ ID NO: 35977 - DNA, 1533 bp, Mus musculus
ataattttgctggttgaaatacttagtgctgaaattcatgattttaattacttactgtcttagctactattttgttgctggaaagagacatcaataacaaggcaactcacatttgagaaagcatttaaattggggacttgttcatagttacagaggcttagtctggcatcatcatgtgacaggtgctgaagtagtagccaagagctatatcttgatccataggcaaagacctttacattttgatccacaggcaaagagttaggaggaggagatagacacatacacctgcatgcacaaatgtacactaggcctgctgcttggcatgagcttttgaaaccccaaagcccacccctagtgacaccctccaacaagtctacacctcctatccttataatctgctcaaatacatttaaatatatgagcttataggggccattcttattcaaactaccacacttatgagtttggttattttttaggagctggtgctacacacatggatggtaatcaaattgttgtggaagttcaagaaacggtttatgtgtcagatgttgtggattccgacataaccgtacataactatgttcccgatgacccagattcagttgtcatccaggatgtcattgaggatgttgttatagaagatgtccagtgtacagacatcatggacgaagcagatgtatcggaaacagtcatcatccctgaacaagtgctggattcagatgtaaccgaagaagtttctttaacacattgcacagttccagatgatgttttagcttctgatatcacttcagcctcaatatctatgccggaacatgtcttgacaagtgaatctatacatgtgtctgacgttggtcacgttgaacatgtggttcatgatagtgtagtagaagcagaaatcgtcacagatcctctggccgctgatgttgtctcagaagaagtgttggtagcagactgtgcctctgaagcagtcatagatgccaacgggatccctgtgaaccagcaggatgaagagaaaaacaactgtgaggactaccttatgatctcttgtaagtttgggggggagtatggtgtttctcacaggtacttctaaagcctgtttatctaacgtacaccaggggtgaaattaaatgtccattaaaatgaaatgtataaaaataccttgtccaggtgtgatgatacatacctttaatccatcacttgggaagcagaggcaggcagatctctatgagtttgaagccagcttggtctatatagtgagtttcaggacagctaaggctactcatagtgagaccctgtctcaaacaaaacaaaacgacatacatctctgtaaaatgagttttggtttagagtctgtaaggtgactgaaatttgcgaagagtgaaatagttgatgtgtttctatataaagatgtgatagaaagagggtgtcttcagttatagaaagacagactgcaaatcatgaaggatgtcatttggcagggagggatagacacacacacgtgcaccagctttccttagtgtcctcaaacaa

SEQ ID NO: 35978 - DNA, 1184 bp, Mus musculus
aactgattactactgataaataaaaactcagtgatagcagtgaaaataaattaaaaacggacacacctttaatcccagcacttaggaggcagaggcaggtgagtttgaggccagcctggtctacagagtgagttccaggatagccagggctacacagagaaaccctgtctcaaaatttataaaggatagctgactttgagggttaacctaagagaaatgagaatatttggagaaatgatggctggctagtattgaacaacatggcaagatttgggaacaaagtattttttaacttcagagggaaggtattaattagatttttttctttttgtttttttgagacagggtttctctgtgtaaccctggctgtcctggaactccctctgtagaccaggctggtctccaactcagaaatctgcctttctccgcctcccgagtgctgggattaaaggcgtgcgctactgcacctggacaaattagttctcttgagtgtagcagtgaaaagactagtcagccataacattttattaaatcaaggtttttggaggaccataagcaaaaaaaagtgattttgcatattagcaatgtgaatatctaagaatccttttgatttgtctaagagtagtcaaggaattgtgtaggtatatgaaaatagaacatagccatgcctggactatattgcaagactctgtctttctctctttctagaaagaaaattaaagaaataataaaacaagtaaactatccaaaattcctaatttaagacttggaagtaccattgcttttcctattgacttggtgggggtgtttatttatttttttttaaaaagatttatttattattatatgtaagtacactgtagctgtcttcagacacaccagaagagggagtcagatcatgttacagatggttgtgagccaccatgtggttgctgggatttgaactctggaccttcggaagagcagtcgggtgctcttacccactgagccatctcaccagcccggtgggggtgtttatgttgccctgttttaaagattggaagaaaagaagtttggggggcatttcctgggttttacatagtttaatatttctctctttctcttttttaaaactgtttagaaaaatttattttgaaatttaaataaaaggaaaatttagagataaacccccctttttaaaaaag

SEQ ID NO: 35979 - DNA, 1809 bp, Mus musculus
tgtagcccaatcccattcatcccctcatatccaacctttgcccatgcgacctcccccaaagtagcacaccaacaacagaacaaagcctagaaaacatgccatcgtggaagctgtagcttctgtgacaacaacaatgttggctcctcatcaggactccctccagttatcctgttgctgcgctgtgtcatagagatcctgcagctttggaacagcagggtggccctttcacgatccccaccattcgaacatgacatagattttaggtgggtcaattcagagccccggataagggccaggatggtagctgagctggtcagctggggcccattcttccaagtgctgcggcttgtgagagcctgggccaattctccctacagaaggtggcaacgggggagggtgtcccatccacaccacctcataacagacaagtggcagggccagctgtccagagtgctatatccaatgagggatggtggcagacctgcacagcctcagacacccagtgttccctagtggtaataatgagccatggacactgacccaccactgtggatccacagactcaaacaaggccctgatggcagggatgcccacttataacaggctacttctctccacccttgaattcctttttctctcccgtctgtcatggtgacaagcaggtatctatgcttatgcactggagggcaggactgtgggtggcatggaggtctacaagaccttgtgttcctcttctcatgccgtgctgccttgctttaatttgatttttatgagtcctaggcataagacaaggtttggccatcaagctaggatgaacaaaggactgccatctgctctgcccctgataaagaacaataccaccaataaggggtctctgctggttgctggggttgtaacctacttctaatatggggcttaaaattaaatgtgaaaagtggtatactatatacattggatcaagtctatatagtagctaaaattaagcattccaaagtaatgtctaatttatcaatcaatgaaagtttgaagtgaaacttggctgcaaccagtctttggcgtagcacttgtatcatgaacctgtctaagatgaaaatgatctcttctcatgattcatctgtgagtagctccatagtgaagggcaattagtaaaggctaaagacttacccctttatttgtccttctatttggggttctgttgtctgaaatttgaaggaatacgaccagtgggctcaaatgagcaccactcttagaagttgtgtgcccattcccttaacacaggtagatctgtcttacccgtttcctgggtgggaccttaggaatccagtgccctgagactatgtctttattatttatgcctagtatctcagtcttcccacactggcaaagagtatagcaactggtggttagtgataattgacaaggttctgtccaggctgcttttttgaggtctttgttttagtaagctatgaatggagctgtctcttgcatgatgaataaacactctaccattgtctccactgcccctagctgtagtactggctgataggattatggtggaaattgtgttattggtaatctttgagccttgagagaggtagaaattgttcagaaactgtgtcctctggtttctaaatctattccccacgtgcctccaattttcttgtgctgtgcattttaaattaatcatgttttttcttaattaaatactctttcacagcaatgatttccaactctggctgacgtaagaattgctggggaagtttgaaggggggaaaaagaaagctctggggtggagtccaggctttgata

SEQ ID NO: 35980 - DNA, 1177 bp, Mus musculus
aatagtgaccctgaaattttcttctctctaattatacaggttaataacttgaatgtggaagagaacaacagtggggatcaaaggcgtgcctcactggcctcagggaactggaggtctgctccggttccagtgaccactcagcagaacccacctggagcaccccctaatgtggtgtggcagacaccactggcttggcagaacccatcaggctggcaaaaccagacagccaggcagaccccaccagcagcacgtcagagtcccccagctaggcagacaccatcagcttggcagaacccagttgcatggcagaatccagtgatctggcctaacccagtgatctggcagaatccagtgatctggccaaaccccattgtctggcctggcccaattgtctggccaaacccaatggcctggcagagtacacctggatggcagagcccacccagctggcaggctccacctagttggcagagccctcaagattggcagggccctccagattggcaggtaccacctgactggtcaatgcctcctgactggtcctttccctccgactggccttttccacctgactggatccccgccgactggccaattccacctgactggcagaacttacgaccctcacctaatctgagatcctcctccaactctcgtgcctcacagaaccagggtcctccacagccccgagatgtggcccttcttcaggaaagagtaagtgctgtgcctctccacttagtttactgcagtccttccatttataaccggcggccacgttttctacaaacatcattttaattacttctccccaggcaaataagttggtcaagtacctgatgcttaaagactacacgaaggtgcccatcaagcgctcaggtaggtcgttctgtccttgatgtccttgataggggcatcttttgcttattctgtcccctccctcccatagctgctgattgtacttgagaagaacctgactgggctaccctcagcagggctggcacaggggctggcactggacggtccagctcactccaggtgcttcccttctctcctacagaaatgctgagggatatcatccgagaatacactgatgtctatccagaaatcattgagcgcgcatgctttgtcctggagaaggtaaagagtcagacctgagaaacaagaatgatggcaagga

SEQ ID NO: 35981 - DNA, 1035 bp, Mus musculus
atccagatctccgaggctccgcccaccagccaggccacagcagctgccagtgggccaaatgctagtccccagagttcacagcccccaactgccaatgagaaggctgatactgaggtttcagcagctgctgccaggcctaagacaggctttaaggcccagaatgccaccacaaaggggccaaatgattactctcaggcacgtaatgccaaggagatgcccaagaatcagtctaaggcggcctttaagtcacagaatggcacccctaaaggtccacatgctgcctctgacttttcccaggcagcacccacaggcaaatcagctaaaaagtctgaaatggcctttaagggtcagaatagcactaaggctggccccggtaccacctacaatttccctcagtctcccagtgccaatgagatgaccaacaaccagcctaagacagctaaggcttggaatgacactactaaggtccctggagctgatgcccagacccagaatgtaaatcaggccaaaatggctgacgtagggaccagcgcaggtatctctgaagctgatggtgcagcagcccagacatcagcagatggctcccagactcagaacgtggagtcccggactataattcggggcaagaggacccgcaaggtgagatcccagctagcttccctttgctttgggctctctcctttcttccaatttccttggctccaaacacaataaagggcatggatttatctgtattttggcacagttgtagggggtgctaaggtaactattattcctgagcccaggttgtccacaggctgatgatgagttgatacaaggacacaggcaatatgtgtgtaggccatcttacattttgacattaaacaccatgtcttaagctaggcaggctcacacagaatcaattagatcttgaagatgtacctcactctctagagagaacagagtcaggaagaaacgagttcagggtgaaaccaagcactgtccgtagtcacacaggaaaaggagaaatctaggtcccactttctgtttgtttgt

SEQ ID NO: 35982 - DNA, 1225 bp, Mus musculus
tgagtcctcttgaaacagtttattttaacaatttgtttatatcagttaaatttcatgttttaaactttatattgttacaaaatggtaactggtttagtattcaatgttttgcaatatattttaatctatgttccatttccgtgtttttcttaagaatttattcattgaaaataattactatgcatgtagaatctgccacattccttccaaattttgctgattgtgtccttatgttcacttgatttctttaatttcgttgttaatgtcttggtcaaacttaaatattacttttgcattcatgttctatagcattccctatcttcgtttattaacttagaacatctggctttctgtttttgtgatgctaagagccttcactgatcagtacatttgtttgtggttactttttcctctgctatatggaattgttctcctacaatcactaacacttaggggaggaggagatgtttacagcactccagcaagtttaatataaatatcattcagtgccagaatgttttcttaaatgatgttaaaactaacaagacaaaataggaaagagaactgtgtttgctgttgttattgttgacatttctgacatcctttgctggtgttagggaggctgtattgtagaattgccattcaggactttgatatgagagaaactcagggtccagtttgtgctctgtggtgttggagaggttgtgttaaacatactcatctcactaaacctcagtttcctgtttactgattaatgtgtgtgcacacgactaacattccttagacttttttttctcatacaattttcaacacataagtaaaagtatatatttcagcacattttaatgatttcatatgctatttttacatactcagttttcttgttgttagggaaaaataaggataattcagccatattggtattcagtcaataaagtgttgtgagtttatagtgaaacaggaaagggtctctttattccttaccctaaataattttctctccaattgtgagaaaaatcagaagtgggaacactgttcatgtgcttatctacataactctccatttgatcagtctgtcagcatccttgttctgtttcgaacatcggccttctttctctgtgactgtggagtctttgattctttcaaaatatgataaaggtgcagagggcgatgatatcctttgtgatctgaagaaaacattgtttatggttttccagaactgaaa

SEQ ID NO: 35983 - DNA, 1210 bp, Mus musculus
aagtgtgtttacaggaggcagatgttaatggaaacactttatcctataagatctgatgacaagtacctctttcaatttgtttgccgtgttttctactagaaaagagttattttgaaatactcaaattcaatactgttttttgtgaggacacttgaagaaaacacttttttatagtactttggcaatatataatttgccactttgaaatacattatatactactacctttataatttttatattgtttgaacccatttagtaaaaaggtaataaaagtacacattaacttttaatttaaagaagtattcagaattttagtgtgtccaagcatcaagattattattgacttagcactttgaaaagattttaaagactatgttagaaatgcattttcatgagttaaacatttctcattttattcttcaaggaatgcaaagacctgaggtaaacacagactttataagcattattaagatatataaccgtaaaggtattttaaaccgtcactttgtttcttttaaatttcttccaactaaagactatactaaaatattcttatctatagactgtagaatttccaaaggataaaatttaatttcttgatgataaaaaatcatgttgttgtctttctgatttctctccataccattgccctagcatgaatgactgtaattacagtgactacacgtgacaacacatataatgatcatacttctggtaatataaatttgacatttttgaaatgatgtcttgatttcattttatctcctttgccttttgtgtttctgtagtctttcttgatctattaagattttctaattgtattaataacaaaatgcgttatatgaagattgttttcaaagggccttgtttagccttttgatcatgtaaaatatgttaagcttgctataacttgatatttcagttacttaatattgtactgttaaataactgaaagtcttgagtattataaataaaacttgatggattttcaggtcatctgtcaggaaattttccatcatggaaaagaaaaggattatagtgtaacaggatatttagaatattagctctctggagttattcataatccattagtattaaacctatttaataatgcaaaaaataacttatggaccttacccaaaatatgtcataattgaaatgtaagactggactacattgtatgtgtctattgcttttgaacactgca

SEQ ID NO: 35984 - DNA, 1187 bp, Mus musculus
aagctctgaccccctccagcaccctctgtgaaaacagtgtctccgagctactgaccccagccaaagccgagtggaacgtgcaccccgaatctgacttctttggacacgaggaagaaacccagttcggattctcccacccaacaggaagccatgggtctcagaaagacacagatcttatcacggtgactggcaccccgtttttggtatgaaccgactctgcctgttccctgcctgccctgtggctcactttgttgttgttgttgatgttgttgtttttatcacactcaaatgtgagaatgttctggaaggagcgcttgcttgcctgcagttgtttcttgctgccttgcaaaggaacgcatctgtggattaccaatttagggatttcagttctcatcttgagtctgggactgataagttctctgactgtgagcaagtctcttaaccgagctgagccttaattcattatttataaaagtagtcttttttttgtctagcttatttctctttccttttcaactgcatttcaatttttttgtacacctttggtgtaattttttagagtatttcatagtggttacatatgagtctcatgtaatgaacaggaatgtgatccctttgaacattaaatgatcagagatagaggaactcgtgttttaacttttaccatttatcttaccttctttcacagtatccattgtatcagtagagtgcaaaaatgttgtattttatgtggttgtttgatgttttctcagtcttcttatgttgtctttctgtagaagggttttttttaaaagaaaaatatcagggatttgatatattacaagcatattctaaaatattgcctcgttaccattgaacaagtggccttatactagtcatttagtcttgccaagccttactccgctagctttacagtgctgatagaaatgcacattattctcatgcatattgtatctattgatgcttgagattgttactgaagggaaaatatatgcttgggcttttctgaatcttctttagttgtttctttctttctttatttctttctttttttctttctttctttctttctttctttctttctttctttctttcttctctgcctccttttttcccctcttcaaatcctagagtacacaagataggaaacacatgtatcatagttttcagccaataatataagtatt

SEQ ID NO: 35985 - DNA, 1164 bp, Mus musculus
catgggagccctaagcagtcgaatgtggtccaggagaaatcccgaggaaaatgaacctgttagagaaggcgctggtagaggggaggaggccgtggaagccgaagaagccgcaggaccgtccgttgtccaggaagcgcaggcaagtgaacagccaggcgtttccactggtcagggaggccacaagcggaagggcagccgtagaggaccgttggcaaaagtaccccgtaggacactgtatgaatcactgttcctgaggggtgaaaatagcgatataaagatctgtgcgtttcaggaggagtggcatttgcacaagtcctatctgtgccgctctgggtacttttctagcatgttctgtggggcctggcgagagtcaaatatggatacgatagagatgcagatgcccgatgaaaatattgatcgcgaggctttcaatgatgttctaggcttcttgtacagtcgaagaattgtaattcctccccctcgagtcattgccgtcttggccacagcgaatatgctgcaattggatgagttaattcagcagtgtgaggatatgatgagagcctcagtcagtaccgagactgtgtgcaactactactactctgctgagaattacgggctccagagcatcaaatatgtttgctgccagtggctcttggacaacctgatgacccgaaaaaatgatgaactattgttaggaatcagtgtggatctcatgaaagagctcattgcctcttcagatcttttggtggttggagtggagatggatgtgtatattacactgaaaacgtggatgtacctgcagctggaagcacgcacatgctcaggatctgaaagagtattactgcctgaagagttgagctttgcaaagttcagaagggagtcagataacagaccttttctggacagtgatcaggggagagcctttgtgtcagtgttccagcgactaaggcttccctacatcatcagtgacctgccttcagcacgcattattgaacaggatagactgatccctgcagcatggttgactccagtatacaaagagcaatggctagcacttcttcaggcagagcagtccagggaacttgggcgaatggatatcaatgtgtctgacatccatggaaacagcatgaggtgtggaggccaacttttcacagatgagcaatg

SEQ ID NO: 35986 - DNA, 1440 bp, Mus musculus
ggtaacgcaagcatgtggaccctggcagacagcatgttttctagctttcattttatttaccttttgagcccttccttctcttgtgtagacgttttgaaagtactcctgcctcttgacttttattcttttcctttctttatattttgtgcttgttttttgcaaagtatcatgcccatattgtgtggtttgttgtattaagtttctccaatggagcattaggggctcattcaacaccaggagactcgggatgacagatgacaatgctatttcaacctccaggaattggtcatctccttgggagacacccttgaatgagacttgccagcaatttagaagatggcaacattgtccagaaaaggcattaggtgattccttggtccctcttgctactttgggagaatctctccacatcctgcctcctccttcccttccctgttccagctcacaagtggatggtacttttggaaactgaactcttgttgttttgtttttttattgtaagtcttagcccttaatggctgagttgtctctttaaccaggatggcacttttaggaatggtgactgttacagtcatggctgggtggcctgatccacggtttctccatcctgtagtcattccaaagaagaaaatccacatggcatgtacatttgtgagggttgggtctattaagagggggctttaattattcctgttactattggtgcttattttccccgctgtatatgggggtggggaagggctggggtaaaccagaaatgtatatttaggtcacgttaaataaaatggctgggggaagaagaaagatatgagtctaggtgtaagagttctctcttccaggacagaaaggggattgtagcttgttgctgcacctgagcttcccttccgcattcctgagacatcatggaatcatctgcatttgttacctctccatccctagcactcactggcatctggatatcctgatacactgcctgtatgttacaacatatatttcatttgctgaatgctaataaacttctgtgctcatgagggacctccagtcactaaagtgttttcttgttgtttgttctacaacagcattcatgtgatctatgggtgatggattttctcttaaaggaaaattgaaaaaaaacaaaaaacctcatggtattaagggagtcattctataggcaaaacaagccaaagctgaaacggaaattagaggaaacttccatatttcattcaacttgtgccatgtatcttagtcagtcttgtcacaccatctacactctaagacctgttcctgaagtttctgtacattttcagggactaatttgcacttctgcagtcagtcacaggatgtgctaaccctccaccaaaaaggagcacaatggaaaagatccctgggttcccttttcaaaccagaaaagagactaagtgaccccaggatctcatgaat

SEQ ID NO: 35987 - DNA, 2098 bp, Mus musculus
atccacctgcctctgcctccaagcaagcccagcctaaatgttggaaacactagggaagagcttggtgtcaggaaaacattgcaacaggctcatcttgaccaggttcaacatttccttaatcatctatatgaaacagtttctttaaaattctccatcaggcccggtgtggaggtatgtgccttttatctcaacactcagaaggaagaggcaattggagttatatgagtgtgagaccagcctgttctacatagtgagttctaggccactagggctacatagcaagatagaccttgttttaaatttttttctgtattggaatatgaaatattttggggatcgatatgttgatcaaagttagaactttttaaatcttctgcccatgtccctcttctcacctcaaagccatcttcacatctactaagtgaagatatcaatagggctcttgctcaaaataaggcaatttaccttgagaacagatgctggtggccttctgagtcaagattgctttgtagacatactttctttgccagggcatatattcataatatttttcacagtttctaagcttgggattggccctgtgcctttcccccaaaagagcagatttgattggtaaaatctaaccccttgtaagtaacttcataactttgcatggcaccagcactagaaccacccctcaaggacctcagatcagctctcttggatgactttggctacatcacgaagaagtgcatctcttgtggatctggataatgaaagtgaaaaaggccttccttaccccaaccacatcgtcataagagacacatgcccagattttaaccacttggcctcctaccaaagctgttctgggaaggtgaggctgaacttagcctggttgggtggcaggaagtaagcactcaatgcctttacaacaggaaaagccacacctcttgcctagtcaaggtagcttgagttgctgtttacatgtcgctgccatctacagcaggcactagagctgtccacagcctccatagcccactggagaagggctaccagcctgtttggaagaggaagaaggaatctaccctcacagttcaggaggacagcacagtgcaatatctctgaagggacctgctataacttggatatattttgctatgctttgaaacttcataccttagagtaggacctgaggcaaagtagaagtttgtggattgggtaacatcattgccttccaagtcctttcactgatctggctgctagcctagggacaaaatatttacaacctaaaatgggatagccaagatgtctacagaagcagactccttttgagtatctaaagcaaatactaactgcagcctagaaggggaaagaagatttggctgcggatatatggtaatggcaacatgattaccaatgggatatgtaaccaatctctaggtatctgtccaaacatggacaagtacttcctttgctggcaccaaatatgctacaaactaccagaagtgctgctattgtgttcaccctaaggctgtggccagatgaacctcctgactccattgcaggtccttggacaatgcatttggatgtgactttaagggaagatgtgctgacagaaggaggctagctttatgttgttacccagtactactatatagtgtcagctctgatcctgagaatttcttagtaacccagtccatagaggaccagtgactgtgggtatggaaagccacctagcaggcctcttccaaagccaggatgccaatttcttggtgctttagattctccaaggaagctctgccttggggatcatctggctttagcttagataccagaccacaagcctcgtggataatggtttcagtaaatgccagtgtccctcctcttagtgctatttcaaggagggaagtagctttccacactcagaatgttgggtgcatgatttcatcctgccaccagtggctttttcacctgcaccagtgccaccactgccttcagcccttaggctcacttgctagagggaggcatgggggtttaccagggatacttcaagtttacccatgtgtatgttgcatccaagttgtttttaatatatatatataaatatatatatcaaaag

SEQ ID NO: 35988 - DNA, 1098 bp, Mus musculus
atacagggcttgggatgcatccttattgcaggctgaacccctcttctctggtcccttgctgactaatgaaccactgatgagcagccaattttttgcactgactctcacccagagatgggaggcttgctagctattagcaatataaagttatggtacatagccttcctaaccccattcctttctagcacatcaaatgactataacctatttatcccagttagttatgtttagagtgggtcaagtagcatgtgtctcgctccctgttgctgtggactttggtatcacaactagatgatgtccttttaacctggcctgccatagtctagattgaagacaaaaacactaatcctcataagggggtgattaaatctgtccatattcaagcagaatacaaagatagatagcttatggaaaatgctgtgaggtcttgagctgtggaataataatatatctatcttgtttgtttcctaagcctgtggctgttgcaggcattttagaacttcccccttttcctgtccctgaaaaatttcatctcatcacaatgaatgtagtatcttaactgagttaaaggaagagaagccacctaaattgggcttgactatatagagcattgggtgttgtgagatgcaaaagaggaaaacagacagggtgatccatttatctaaacaccaagaagggatctcagactttggaacttgaagcaactcagattaggagggaaaacttttcccatcctttctcccaaaccaaaagtaaataaataaataaacccttggccgcccctttgtaaagtggttccaagcttgtctaagacaggatgccaaaggcatctcacctgttgtaggcacactaaaaagcttttatcttccagttagccaagttcttagcattttcaaaggaccaggcttcttgagaggaaagattgtaatgtacccttgctctgccaaactacagggctgatttgcatggcagttgcagtcctttctgaaatgaacagcaccctctcttctcttgcatccatgcaggtttctttttcttttttctatattttttttctggacaaggtcccacactgtagttctctctagcctggaactt

SEQ ID NO: 35989 - DNA, 1181 bp, Mus musculus
atgtgttcttggattcggttagcgagaattttattgagtatttttgcatcgatattcataagggaaattggtctgaagttctctatctttgttggatctttctgtggtttaggtatcagagtaattgtggcttcatagaatgagttgggtagagtaccttctacttctattttgttattttctctcttttctaattgaatcctgagacagtaagcacccataaaaaccaacctagcctgtgtacttgctcactagtatctatctctgtctttgtctctcttatctccttcagaccccactgtgatgcttcctgactgatcatgttataagtgtgcccggaatccaaaggcagcatatccagtggaagaattgtcttcatcatggagagtcaacaggatgaagctgttcaaaccaaaggagcatcaacttctagcgatgcccaagaccagggagctgaaaagggagccaagaataagacaactgaggcaacagaaggaccaacatcagagcctcccttatcaggcccaggtaggctgaagaaaactgccatgaaactctttggtggcaagaagggaatctgtactctgcctagtttctttgggggtggacgaagcaaaggttctgggaaagtcagctctaagaaaagtctaaacaagagtaagactcacgatggtctaagtgaagcgtctcagggacctgaagatgttgtcattgaagaaacagacctctctacacctttgtccaagtcatctgctcaatttcctagctcccagagtgccaatggagcgttggagataggctctaaacataagacatctgggactgaagccatagaaaaagctggagttgagaaggtaccctctgtgcacaagccgaagaaaagcctaaaaagcttctttagcagtatccgccgtcaccggaagggcaagacttctggggctgaccaaagtgtgccaggggccaaggaacttgagggggcaagaaccaggtctcatgagcatgtgagttcaatctctctgcccagctctgaggagatattccgagacactagaaaggaaaatgccaaaccccaggatgcccctggaccaaaaatgtctccagcacaagtacatttttcaccaactactgagaaggcagcttgtaaaaatccagaaaaactcacaaggacctgtgcctcagag

SEQ ID NO: 35990 - DNA, 1421 bp, Mus musculus
tgtgttatatccttcattcccaagttctatgggctccaagaacactgatctctacttaaatcttactggtaattgttccataccaatggaatattattgccttttggtcccatgagtttcagccatctgaaccattgcttaaaggaatctgattactgactttatttatcctatcttcctccaccaggcctgtttgtcatgtcaccaacagattcatcgaaatgcacctatatgccctctttgcaaagccaagagtcggtcacggaaccccaaaaagccaaaacggaagcaagatgaatgaagagaaggtggagggatagacctctgttggtcgtaaagcctctctttggtcagagtgatagatgttctgatttttttttaatatcccttccttatccctactgagtcttctatttaatttgctggaagaataacccctttctccttgctcttatttctttctgctcttggaagttgtggtttaagaccagctgtgctttgggtgctaatcactgggactcatgaccccttctctcctagtcacatttctcttactgccccagtttggaactgaatgagggggtaaaaggccctagttgatactttcttttgttcctgaggactggagtctaatgagctgtagggtgtaaagactggaggagctccatgccttgctttggaaaaaggcttcagtgatttccttccctctgtttttgccttgggttctgcagggacaactactttatttttgctgtacttcctaatgggctgatgcatatatctttctcaatattcaggtcatcattaaaatctaggggtaacttagacaagtgttccttttatataaaattgtgaggccctggtgttattctatagttccactcaagtcttccagttatactgaagttcttacataccagacagggcatcttcagaatcgcaagatctgtggatctttctccatacttgtattatttgcaaatcagtagacatttcctactgtgaaattagggaccaagacccatgccacaagagtcacctagttcactgcctaaaatactgggtcttattgctgtggtataggaattgtcttagactgaggaaccctaagtgaactttaactttgaattttgttcaaacccattacctgatcagtggtctatcattctgaggatagaaagggacatagtgttatatgaatgccaatcattttatacatgtaagtaggtaggacttttgcttttctattctttcctccttttgtcttttatgaggtagcgtcagttaaggacagttggtcactccttttctgtgggttatgtaggtgacctttcttccacaaataaaagacacttaagctctccatgccccacatctcattcctttatcaaaggtaagcctcctagtcatgtcttagatct

SEQ ID NO: 35991 - DNA, 1170 bp, Mus musculus
tttcagaggcaggtgtgaagttcagtgagcaagttcaaactccagagtgttgagctatgaggtaactttgagacactgacctttttcctactctgtccctctgtttgcttagagtcttcaaagccatgggacaggtcttgccagatgaagagcaggagaagctgctgcgagtctgttccatttatactcagaatggagagaatggcttggcaaaggcgattgaaggttcctcctcctcctccactggcaaagctccgtacacactggataccttacatgaggacctacaaccacctggtaccaactgtgagtccgaagaaagtattcaacagaaggagcaaggcaaccttaaggatgtcaagcaagaggagaaaaaggagaatgaggaagaggagaaggaggaggaggagatggaggaggaggaagaagaggaggaggaagaaaaggaggaggaagaggaagagcaggagcaggaagaacaccaggaggaagaacaggaggaggaggaggaggaagagaaccaaaaggtctttcaagatcagatggaggcagatgttgaggaaagtgatgatgtagaagaagaggaagaagtagatgatgaagaagaagatgaagatgatgactatgatgatgatgaagaagaagacaggatggaagtgggggccttctctcttgcacagggatccagtgtttttgagaatactaggaccacgtctcggaagagagaagcactgcagggttcagcatggcaagtaagctctggtaaggagtctttaacacccacttttattttcttccatcattgatttccctccattcttgatgggcccctcctctcctttctgtctccctctgcctctcctcctacctctcttgagatttagtgtcagtgtaatctcagacttgagatcctggggcctaagctttctgattgcataccccagtatccggacagctataactctttttgaaatgaagattgcctgaagatctcccgtctttcagcctcctgaattggtgaggttatagtttgatactactatgctctgctggccaacccttgaggctttccttcactctagagactatataagaaagaagtaagatgtgaacagtatatggcaagcctcagaggcaactggatacatgaatggcaactggctttcctct

SEQ ID NO: 35992 - DNA, 1212 bp, Mus musculus
gtgcaaccatgcctctctaaactaactgtttatttgccttagggatgctgtgctggatgcttttctagatgatggtttcctcattcctacgtttgagcagttggcagctttgcagatagagtatgaaggtagggtcctgggtgttcactgaaaccctagggttctgtgtttcttatgtgcgaactccagaagtaggctggagtgtggggtggggtggggctgaaatgtcagcccttttggctgaacagaataggtaatcctgctgatgtgtcctgggacttttctaggtggcgttgaatctgttaaggtgggttggaatgggtaggtggggtttcttaacactgttgttgtgccttgtcaaatatgatttagccactagctagagagctagaacagcagcattggaggggccttgagaggtcatctagtccaacatcctcatgttacagatggtcaaactgaggtccagaaaggggaagttactgaaccaaattcacacagtgagttattgacgaagctgaagtcagaaagagttctttcttttatacttggttttgtatcagttgttgtttgccagatactaactggtttctctttcccgctcttctgctctcctgctctcctgctctccttccctcttgttctgcaatggcaattcttgttgtttgaacttgggcgtgtctgttctctctctttggtgtgcaatttttttcttttcttctgcctacccctcttgctggcttgttttggtgctctctcattctcttgatcttggtcccattgcccttcccatccatcatcaactggtatccgtcacaaaccagaaaacatcgacttgaatgaagtgttggtgccaaagcccttctctcagttctggcagcccctgctcaggggcctgcactcccagaccttcacgcaggccctgctagagaggatgttctccgagttgtctaccgtggggagcactgggatccggcctacctacatccttagatggaccgttgaactgatcgtggccaacaccaagactggtgaggaaaactagccctagtcccgggggccaggcatcccaaggagaagcatctgccagtgtcctcagctcagccttttaaaagtttacagttgccaaagagtgctgcgggaattagaaaaatctcccttttcctttttcttctcaatgccacagaaaggaggcactctggatgctttgag

SEQ ID NO: 35993 - DNA, 1101 bp, Mus musculus
tgtggcctctcctcagagtggttattatatgagatagtcccaggaaggtattggcttgtttactagaaggaatgttggcaactctgggttcttgtttatgtctctagttaagtctcttagatttcatacttatcccaccataaacttgtatttccatccttttatacctaaaagaaaagatgaggactctgcgatgtcattctgacatcatcaggatatggcttagctttaacgtggccatccctagtcttgggcatgttggtgtggagcctacaactggaccatcaatctgctagtgtcagggcccctgaacagactccatcttgacttggggtctggaagcaacattgatctgtgtgttatcagcaagatcaagctggactttcttcgtccattctcagtgcccaacaagaaagggactaggcttggccggtacagatgtgagaaaggcactaccgctgtcctcaccgagaaagttacccctctggagattgaggtgctagaagagactgttcagacaatggatacttcgtgaatggtgctgtgggtggttggataactctagatgacttggggtgcataccatccctaccccggggtgcataccacccctaccccaaccccattctaccccaaccagaaaacatgcctttggcaattgctcaattaaaataaataaataaataaataaataaataaataaataaataaaagacaaaaaaaagtccccaagtccttgctgagttccttttctgccttctattcattcaaagggtgctgggcaatacagggccctttagcttcttcacaagacaaatgttggccccaaacatattggtatctatatctttgggctatgagctgtctgtatagtatgctttctgctttgtctttcttggagtattacaagtgagacttggtcttagatgttgatataatcctcactttctaaagattgggacagctgtgaagtttgacttgatgtcatcaatgattgtcaatacagtcaattataatgatgtaattcttccctagaaacctaaagggctaggttgggaagcttctagagagctaaacatgtggaagtacctgaagggacat

SEQ ID NO: 35994 - DNA, 1151 bp, Mus musculus
gcctgtatattcctgttgagtttggagatgcaacacattattagcattgtagttaatggtataaagaggatctggactgttttgtttttgttttttgttttgttttgttttgttttttaattccagcacttgggttgctgaggcagtaaagctaagagagtttgagtctagcctggtctacatagtgagtccaggacaggagagctgtatataatagagagaacccatatcaaacaaacagacaaacaaacaaacagaccctgcctcaaaccaaaaaaaaaaaaaaaaaaaagccatataggtgactaaagaggataattccattgttctgtttagtcatctgttcttggagttcttcctttaggaagttcgttatgcctgcttcagtgtgttcagttctaattttcagtatgaatccagcaatacttcagtgggctaacttctcatttgcatcaactctatagagagctaagtgagccttcctcccttcctgcctatacgttattgaccactcactgtctttctagagtcttggagcagcacaaactcaacaaggaccagtgggaagagaggatccaggtgtggcatgaggagcaccggggcatgctcaggtaagcctcccctgatagccatgagcttcaccgtccttgtaaggagaatgatgatggtgtctacaaagaagacaaattattaggtgaattggtggattttaagaaagagagactagggattattttgatatttaaatataaaaggcaaccttgaatcattgtaagactgtgatttattttaggcatttttttaaaattcttaagagcaaagttttgatgcaaaggactgtaacttgaaaagatcattaactataacatcaggactttatttctattatttttatttttatgccctctctgtcagtatctctctctctctctctctctctctgtgtgtgtgtgtgtgtgtgtgtgtgtgtgtgtgtatgtgtgtgtgtccacacgtcgtgcatacctctgctttatgccagggtgcacatgtggaggtcagaccaacttttgggagtctgtttttgtctactctaccatataggtcccagtatctgaactcaggttgtcaggcttgctggtctatgaccaactgacccaactttccagccc

SEQ ID NO: 35995 - DNA, 1133 bp, Mus musculus
gtaaagtctttaaaacaaaaagattgcttccttgaatagatagtgaggccagaaaaagtaaatacttattctagatctgcaataaaatctgagaggagggaacccagagctatggttgaaggcagacaaggttagccctagccaatatttggagcacaaaaccaaaacttgcctttctgtgaagctataagacagtgtgcaaagttagtaaatcatgttacatatggaaggtggagaaggagagcaaagccatctagttggttgcttgccttaccagcattcccttttaagccttgtgcgttcaaggtaaatgtactgagcatggaagcctatgtggaactatggtgtgatgactcggttatatgagagtgtggggaggctgaggcctgagagacttattccctggaacccctcaagattgcacgcagccttgctatcctgtttcacccctccttttcttctctagtgctctcctggaaaatgagaagaagaagcgtgagctggctgagaaagagaaggagaagattgagcgggagaaggaagagctgatggagaagctgaagcagattgaggagcagactaagaaggctcagcaaggtgaggcttgtgttcactgtgcaagttgaggctcttcagatcctcacctaaggtggacattctttttccccccggagctgcagaacaacactacatagtctaggtgtggtacagaataataatataaaaaatatcaagaaaaatccttagaaccctcacctactgcaccatgaagtggaaaattcccaggaagcaggttactgtgccatcttcatctctgagcccttcatcagtttcctgtttttctaccagagctggaagagcagacccgcagggccctagaacttgagcaggaacggaagcgtgcccagagtgaggccgaaaagctagccaaggagcgtcaagaagctgaagaagccaaagaggccctgctgcaggcttctcgggaccagaagaagacccaggaacagctggtaaagttgaatcctgggctgggttgtgtgcatgcatttttcttgcttgacccctataccctgcttactggtttataaatccctttgcctgcatacctgtgtctttctagtttgtatcccaaa

SEQ ID NO: 35996 - DNA, 2528 bp, Mus musculus
tcagagctggccaatgcccgagatgagtccaagaagactgccaatgacatgatccatgctgagaacatgcgactgggacgagacaaatacaagaccctgcgccagatccggcagggcaacaccaaacaacgcattgatgagtttgagtccatgtagtgggcgtccagccttcagggacccctcctccttcttccttgtccccacactcccatagttttgcctaactaacactgtgctggagccactaactagaaaagccttggagccatgccaaacgttcagtatagccatgggaccaaacttaatctccccactcataccctcgggcaaacaaatggcccactgtggtgccaatggaatctccttttccttctttgtcacactcattcaacctagctctctagaatagagcatttctccccgccccagctcagagacacgcattccttttggtttgacaagcaccccctccccatatacacttactgttgtcctctgggactcatgtgtgaagtaggttaacagctagctcccatcccttgccagtcctgtgatttgcaaagatggaatattgtgttgtttagggacagaaggagggaattggctttatcatttagtatgtcagatgacctaggatttagcctcttaattaagtctatcccttttacagttacttaggctttgtaccgattggaggataaaagagatgtttagccattcttatttcttctacctcccatattggacctattacaaatctagtcccagtgggccttgtctctgtgtttagggatttagtttctaatcaagatgggatgaagagataaaggaaatagtgcattcaagagattcactaacaacctagaaaggcccctgccccagcacatctttggagcctttcttctcttgagtgaggtctgtggtcagggctacccctgcccatgatagtccaggttcttggttccttttctaaatctgtccctaccctctccaatcctcagatctcttccagctaggacagagaggatgagtaccctcaaacctagccagttgcatctaaacttgttgccacaaaggaagaaacttttttgtacctggctttagtatttttcctgccaggacttctaaactacttcccccagagctaatttgaccactgttcctgtttcacagatacaaaatatgatgagtaagagtagcccttgtctgtcagtcacccagcaatcctccctcatcttacccagtgcaaagtggtgagtaggccctgcttctgacaaatctctaactcaggcctcatcactcattgtgctgtcccttggagatacagaaagctgctgggtattctggccttgtcccttcacacccccacacccttttctccactttggagcagctgctcccccttttttgtcacatgtgtgctcttttaatttttaccagtattatatattctagtgatatctaacaatattggtttctaccttttttgctaatgcactattagagatattagtcttgggaaaggatcattttagcttcattattttttactactgtcaccccacatctgagaagaatatactatattaaaaatgatattttgccaaaaacattatgtaagaagatttcagtattagcgacttacctgtcactataggtcatacaatacatttaaaatgtacttagtatttggttttattgttcctgtttgctttttccccagggttcagtccccaaaaggctgtcttgtccctctatgcagtatccttagtccagagcatccctcagcccatgccccttttacttaatcttggggaatcttatatgcattgctgtgaattatattgacagttggtgagctgtcttatattggctaaattcaaacctggaattgtgggggcaatctagctgcattaagggcaataacccacccccccatagaggctggggagaagggtaggatttatattgaggttttttttttgtgtatttttgttttttaaataattgttttggaggggtttatgctcaatctgtgttctatttcagtgccaataaaatttaggaagacttcactatgactcagtctttctgtatatctcactgtaatttctaatccataggctacctatcgttggtctcagtttaccttgacttaagtcctagtggaaggaggaatatgattgtccttgtttgaataggaaggaatgactttaaacaccacaaaaacaagagtaaccagaataagtcctaagactagaggtgtggtagaactgactgaggtattccttttttcttttctttttttctgattcatgtcatggcttctggtgtgggttggaggcagagaacaggggttaaagcagtggttctcaacctatgggtcatgacctatttggcaaacttatgtctccaaaaacctttacattatggttcttcacagaaacaaaaatacagttatgaagtaacagtgaaaaaatctttatggttgggtggtcaccacaacatgaggaactgtattaaagggt

SEQ ID NO: 35997 - DNA, 2600 bp, Mus musculus
ttatattaggttttcttgcctttagctcttaaacactgtttacaatattttttcttcttatttcttggttccctagactcatagcactctgtgagtctgctggaaggtttgatggatgttcatagagctgtgtttctgagttttagcataacacataaaggaattttgatatgggtctcctgggccttatctaatctttgaggttctgtattcctctaccccaagcaaaaagccaggctacagtttgatctttcaggaccctacagtacagtacgtttctgagtcaattttccctttcctatgtctgggctccccaagcaatcacccaccagacctccaaagatacccacagcatttttcaagttagctaagtgaggctgtgaagggtccctcaaggtatgagtatttcttttgacatgtcagttagatgcctactttactgtccgtttggttctttttgaaaattcattttgcctttagcttttacctgtacatctcaagagcagagacaaacaagaatctccttggagactctattattcctttttatctctgaatctttatgaagcttatgcagctagtttctatcctactagcaattggtaggttaggtaaaatgtagacttcctcaccaggacttatccttaagagagagtgctcgctacaagattctgttaaatgtgtctttaattacagctcatccacaaacactgattaagggccttaaggtcaaactgctgataagagtgttaaaacaacaagagaaaaaatactaaaaggtcccattgtacttggcaggggattagaagcaattgaatcacaacactgtaccagacaacctggtctcctgtaagcattatcaaatgtgtctgagccaaggtttagaccttggtctttggtactttttttctgggacagcttatgcttatctcaccaactttaattagccatatctatacttctggtgaagaagaactagcactaaatctgaggtggattcagcttgagtaggttccagctgtagaaaggtcactatgtgcttggcaatgcttcaatctcaagtccattactgcttcttagtgaaaaggactatgatgataaaacagcaaaaacaatgtgattaaatgacccaggcaccctgcttcactgtgcctatacataacaaggtcgttatacatccatgccaagaatcgccttggttccagttttcttgaacagttggagttaataactaaaataaggtgaagttttattttgctttgctttctttggtttcttgggtagaatcaaagaaaaggatgatgttttgttttttctttataattgatatttgaccttggcttacttcatatttgcatatttgatcaagtagtgtccttataaagtgggaccactttgagcactatgcttttatgtgtcttctctttgaagaattcatgagacatgtatataacataactctgggcctggacagcaattgtgttttacatatttgagctagcaacagaaaatatttgtgtacaggggatagaggtaggcgtttagtggaggtgagtcaggcctcagggttcactttatttcccccacttatatcactggaatattgaaaggttgtatgtagtatgggagatcaactttcttccctaaggtcgttaatattagagtaagtaaaaatgtcaacactacacctctcttcccaatagacctggcacagcctcatacccctcattcaatttattaccgacgtctttgatgttttgtatttaatgtaggcaggttttaattattgttttcctttaaatgaactatttatagagattttgttaaattttgagccatatgcatgagtggatactgacaagttgtgtctgatttatgataatctgcaaacaattcatattaatcaataaacagaagtacgtacaaatgccttgtttattcctcggctttcagtgaacttgtgtgactcattcaattgttttgtgtgtctgcttagtcagtacagaaagaaatgtgtttttaatcattgggtttagcaccagagctaaggcaattctgactcgtaacccaggagatctgagttgtagactgtgttctcctgcttacaaattgtttatgacatttagaatcttgtctgtctacagatctaccagatatgtttgtattctaaatttagaattcttttcttattttgttgattttttctgttgtcgttatttgtttgttgttgttgttgttgtggtggtggtggtggtggtggtggtggtggtggtggtggtggtggttgttttgagacagggtttctctgtgtaatagccctaagtgtcctggacttacttttgtagaccatgctgccctcaagctcacagagatctgcttgactctgactcccaagtgctgggattaaaagtgtgtgccaccacacccagctctaaatttataattcttagggaatgttgtatagtcttcatactgtgtgcatatatttagacctataaaccaatctcttgtgtttatatgtgcacatttccatttgatcttactatttttaaaaaagaaaacatatacacacatatgtatgcataccttcacattcaaac

SEQ ID NO: 35998 - DNA, 3480 bp, Mus musculus
tgttgaaaagagaccctgactcagtggctttctgcttcatgttgcaggagattcgttgcaatatgaggctgaaaagacagtggaggaggattctcttttccccgtaccacctggccaggagaccagtcctgaatttccagctaatgagggcatcttggagatcaaaccacttaactccatcctggatgatgactgcagctccactcgcggcttccccacccaggagtcctttaccatggcctcctgtgcctcagagagccattctcaatgggtccataccccaattgaatgtacagagctggacctgcaaaagttttccagctctatcccctctactggacctgaaaccttgagagagaacacagctgaacactcaggagacaggctggagctctatgtaccttttgaagttcccagcctttaattctaccaaggtgaactagaaaggtaggactaaaggactggaaggcatggactagcctcacaaaatttccaacctgggttctgttgttccatagggtttggactaaagaatagcaggaaactaggtccgatagaggttggagaagcactaaattttgagctaagtttacactgaacttctaggacaagaattgtctagagatcaggcaggttgacatgaggctaatatatttatcttgactctactagcaactagtcatattcaattttctcctttcaagtgtataagcagcacaacactgtagagatatgtggctccatattcagagaaataccagttcatgattagctttatacacttgtgcaaatcattttattctttcagagacatagtcttcagctcataagttttcttgaggaatgaatgaaagcatatacacatgtcctttatagtgcctacatggtaggccttttttttttccttttcctgtgctcactcagtcacaaattagaaattccttttatatcatctacatatcattctgaattttgtaacttcacccctctgtggtaggcaaataagaaatatatttttaaacaagcagcaattgagcaacagagatgaaaagtgatttgcttaaaatcacagaacaacccaatctcagaattagactagaacccaggattagcagtcccattatagaactcattcaactccatcactgaatttgaaatatatatgtatgtatctcaatatatgtgtcatacacatatgtggtatatgtatgtgtgtatatatacatacacatatataatggaatagttttgaggaaaaaaaaacacacataaaacctgaaagtttttcatgttatattcttaatataaactgtcatgtgtgatcaagtgtaaaaaattttcacttatgattttatgccaaatagttaaaatgttttttagcatttttggattttgaaacttttaattttggataaaggatgcccaatctatttcttcattaaaaattatgtagttcttgagttcacaagtgtaaaaagcataattgtatctcattcttacttatgggttctggttctgttctgactcctctgccttgcgcgagaactgaagataacatttgtctggaaaacactacttttttttttggtacatggtgcttataacaactcactatttgaaaaacaatatcttactagtttgaaataggagagatttgtcatttctatagccaggtgatatatttctgctattgtgtcctaaatctttgctggtctaatcattaacctttagagaaaaggaaaaggagggtggtgatgagcttgcatccctggattctaattgttctgctctttttctaggtctctttcactcttagcaaccttgccattgcttgttgctggactttcctgctcttcttttactcaacaaaagtagcaagagcctgggatgtgggtcccacaataaccagcgttcaaaaatggggtcttcagagccccattctaagagagaactaagtctccagtgactgaccttgaacactttttgttttattattctagtctggggatccagattccatagccatgggactgctgggcctgttctttctctttaattaattatagaagtggggggagtaacaatgaatgaggtggagtttgcctgcctgtatatgtttcatgcctatatttttgagaagtagacctaaaaaatggagtatacagtataaatattggcatctgcctaccatattgaagagaatgaaatactttcccttttagctattttctttgacccccccctacgtctacacacacataaacatgtacatggagtgaagggatattgaggaaggtatcatggggaggcctgaagcctggattttataactcatatcctagacttctgtaaaaatgatagttgtcaagccagtatatttcttagactcttcattcttagagacaggctatcagtactctctggtggggattcaaatcagtgtcttctagatttttctaaattgttgtttcttgaatgtctttgcatttttcttactccaatattcttaccttttcccccttccagtcaagtcctgactgtgatgtttctgaggtgcagaagtagtaccctgtggagctacagggaccatttggtgctttcttggcttagagaatagtcagtctatttctcttaagcctgaatcttcagttttacatgcgtctaagcatgaattgaaacatttttcttcttctttttttttttccagaatatgtcagacatgaccctcaggacttagatgtggctatcatgtgttggctttaagtatcctggtatgttcaaaatgagccactaggattgatgcccatttcgttatagtggttcaagttttgacagggcgaagtggtcaactgagtaaagcaactgaaccttttttgcttaggtgtaatatataatatcctggaggctagtgtgacttaggttattaaaaacaaattcaagatgcacacaattattctgggtcaaagaggtaaagatggactaaagctgtgggtgctgtactttatattattcacattatagttgttctctctgtgactcactatataaactttgatataggcagtgcaggggttgctcagtgaaataggggggcatacaaaagttagaatgctttcttcagtcatttcccttcatttgacacttaactaaggacatggctgcatacaagtattcctccaatatcaaggtggcagaagcaggagtaatgaaatttggaagcaagcttaccttacattgtaagactctttctcaaaaacacaaggtacaggaatttagatagtgttggaatacttgcatttggcatgaacaaggtcttatttttgatcctagcaaaaggaagaaaggtggagaaagggggaaaggagggaagtaaagaaggaaataaaacatttccaacaccaagaaatacaccagaccccatagtaggctaagtgctgctgaggctgtagtggagttttccattggaaaatatcacatgtg

SEQ ID NO: 35999 - DNA, 2306 bp, Mus musculus
attcccatctttcaaaggaagcaccacattgatttctatagtaagagagctaaaattatcttcacagaacatttactccaatctcttcagatgttccgttctcttgtgtacagaaagaatgggttggaggtaatagctgtagtattattgcactgatacaagatctgaagcaaaagtcagatagatctattttccagtggatattaaaacatttttatcatgacctagactaaaaagtcaattttcatcaatacctaacgtatactaacatgtgtgttacctgggaaagttttagttagaacagtaggtcctaactattctttaataccagatacttgctagcatatactatttgatatactgtaaacttgggctttcttatatgctttatgcctaataatgatcagttatcatgtatgacttgtgccatatgatgaaaccgaagtgtattatttcttggggagaaatgttctcttttacatgattttcctatcatgtaagcacagtatgaagcctttcttgaatgagatgccccattgtgggtaataatgtaggccccaatcctcattaagtctctaataggcagagtgtgagtaagaaataaactaaaatttggtgtttttttttccatagtgtaatcttgtttattttgattgatgcacttagctttacatcattttataccactattctatttagttacatttcagttttcagtgctggttacagctgataaatttatgtaatgacaagtttaatgaaacctgtagtttgaaaaatagtgtcttgctgggcgtggtggaacacgcctttaatcccagcacttgggaggcagaggcaggcaaatttctgagttcgaggccagcctggtctacagagtgagttacaggacagccaggactacacagagaaccctgtctcaaaaaaaaaaaaaaaaaaaaaaaaaaaaaaaaaaaaaaaaaaaaaagaaaagaaaaaaaaagaaagaaagaaagaaagaaagagaaaaatagtatcttacagtatattcacttaagtcataacagatcgtctccccaagctcttatgaaccccttctatatttcaggattgtggttatggagaaggtggagatgcacactgcatagtctgccctccccgaaagtataaaagcacttggggacatcacagatgtcagacatgcatcacttgtgctgtcatcaatcgggtccagaaggccaactgcacaaatacctctaatgctatctgtggagactgtctgcccaggtaagcctactaaactgcataagtcgttctgggaatttttaacattcttagatgccctttattatcctacctcttaaaccctagtaaaagtattctaaggatcagtttcatgctctagttaagctccatgaatggagaatctgtatctttctaactggatctatctatacaaagaatccaggaattttcgaacacctatgagcacctagaagctttttaatcacactgatattctgcctaaaatttaaaataaatgtcatgttatattacacaggaatcatgaagaagttggcatcatataactgtttgcctgtctcatgaccttagctcctctttgggccataggatatggataattaagagaaaagatggactgaatcacacttggcagagatctcatgagggttggcactcctgctaagaaaggactcatagacactccttatcatctcaggaagggctgttacaagtcaactgcttgttcatcactctgccattcctttctgctctgatcacaggttctaccgaaagacacgcattgggggcctgcaggaccaagaatgcatcccatgtacaaagcagactccttcttccgaggttcagtgtgtgtatctttttttctctcccttcttccccaaacctgtattagtcaacaaaatcagtaaacttctttatccttgtaggaggaaaacattccttggcactcattcctttggcatattaaacagaggcagccacgtatgattaaatgccaacttttcagcattcagattcattggacctgtttcccttttcttaaaaaaaaatgtttctaatgagaaaacatttgtattcatactttgtgagctgcctgactaggtttgatggattaatgaatgatacaatgtattttaaaaataacatttctacacttaattgctattagagtcaatattgctattagagtcaacatacatagcatatggaaatccttaactcttggactactatagaagctgaaaaaacagctagaattaatttctacctgtgtcactagacat

SEQ ID NO: 36000 - DNA, 1182 bp, Mus musculus
gtatgtgaaaatgcaacagaaaaaccaattaagctgtgattgaatagcttaatcatattttctgtatcaatacctgtcacccttatacactgaactaatggaacccataaacctaccatttctatgcaggattgttaatacagattctacctctatcagtactttctcctatcttttgttgctgccatctctacctccttttatattattctccatctatacataactaatcagagagagagagagagagagagagagagagagagagagagagagagagagacctagtatcataaattctcaactttcaacccaccccaatttggtttacactgtcaacatttgacattactcttgccaaggtcatcaagcaccttggtggcattaaattcattgctatttccagtgatgtttctgtttatcctttctgccatatttaatctaataatcaatctttccaagttttccaagttttcttagttttgtctgttgattgcttctgttctggtttataaaaatctgtactttctggacttcatataaacttcataaagcatctctgtctctctgtacctctttctgcctctctctctctctctgcctctctctatctcccttcgctccccttaatcattttcttcctccttctaattctctctctcacttgtatctttatcttctgagttccatgtctatctgtccaattacttacttgacatttttattccattgtctcttctacccctcaaatttagtgtattcaaaactgagcttttgctcctttctttatagtccaaatctactatgtttttacctttgtaaaaaattccaccagagaactctgataaacctgataaacagcttcggtgaagtagctggttataaaattaactcaaacaagtcaatgactttctctacacaaagaataaacaggctgagaaagaaattagggaaacaacacccttctcaatagtcacaaatatatataaaatatcttggcatgactctaactaaggaagtgaaagatctgtatgataagaacttcaagtctctgaagaaagaaattgaagaagatctcagaagatggaaagatctcccatgctcatggattggcaggatcaacattgtaaaaatggttaccttgccaaaagcaatctacagattcaatgcaatccccatcaa

SEQ ID NO: 36001 - DNA, 1236 bp, Mus musculus
gtttaccctgcttatgtgtgttggaacctaggaccttgtccatgcttagcaagtactgagatacacacttctgccctataactgaacttgtattattctctgaggagccactaataaaacggaacttttagtgtacttctataatctagattatgccaatgacattggaatttagtaaatattgtagttctgataataggaccatactaaatactcctttttgttttctttagcatctacagcattccttgctgacagccagcctccaaacagaaaagccctggcagtgtatcctgtctttttattctactttgtcatcagttggatgatactcacgttcacgccatgagtcaggatacacacattcaacaccaatgaactgaaggctcacctgaaagataatggttatcaacaacaacaacttctcccactcttgtacaattgttggggtattaaaagggggccacatgccactgttgtcatttatataagaaactgatatttgcaaggctgtccttttcctcttaatgttattcttttcaaatacttgtacatcccatagatagtaacatgcctccttaaggcatgatgaagctattcgtgtgacccagtgactcgagcaagtggatccactctacagattacagagttggtgaccatcttcagcttggagaagatttgttcaggtgcagctcttaaacacattgccttatgactattagaatatgcctcttttcataaataacagtctgtatccattgattttcttttctcccccaaactcgagaaggcaacagcaagaggttaggaacgaggtttgtagatgtgggaagagaaaacgtgttaactagtttcagattttgatcagaggtaccgctgtacttggtttgtcgtttgtttttaagcaaataacatctaaggaatccgcttttaaaatatttttgtatacttacttttctgtcacgtgtaacagaggctccgcttacattctagtttttaacctttcatacagtgacagcagtcaaacatgcaactctaactgaagtgcttgatggtttaatgcttgagctttcctaagtagtagaggatcagaaatcgaggtttatggtttgtagtgcatattgtcatgtgggtaccttcctttaaggtatagcttggctattgcgtatttaaaagaatctattttgtacaacccagcctcagattagaaagaaaggctacatcagaagcgtgcat

SEQ ID NO: 36002 - DNA, 2220 bp, Mus musculus
ccctaatatttgaaatttgtcataaaatatcatttctttcctgtatcgaaaattttaaactttcccttcaaatatcttccctaagttgtttcataatatgcccaagtaattataataacaaagtaaccatacttctcaaatttagtctttactggattttactcaggtgaaacatttcctctgaaattcctaaggccacaagccgtaagggttttggagggttaaacacgttggatataaggcagcttgatcctgtgtgtgttaatctgttgcccttgggtgatttgctgaatggtttttatatggcttaaaaggggaatttaggactgaggctgtagttcagtgatagagcattagccaggcatgcacagcactctaggttcaatcctgggcattgccaaaaaaaaaaggtggataaactggaggcctaatttctttttttctggaattaaatgatcagaggatataaatattttaatatatgcaaaaaatctgttgctttctatgacaaatgaagtcctgactctggaagttgtaatctagcttttcctggttcgctacaaaggcacatggttgactgtagaaatgaggcctggaagggcagaagcgcccagggaaggacctcctgttctaagatggtgcagtttcatgctgctggtgagtttgaagcttttttgcagactgcgcatggctattgtagccgactccgacgatcacctgctgcttccacatctcagaccatgacactgttttacatggcttagcaataggaagagtagagacttgatttaattgggcttcagattacaaaatctctagtgatgacaatgtctttgaatgttttatatgtttataatcagatattgaggtgtgtgtgtgtgtgtgtgtgtgtgtgtgtgtgtgtgtgtgtgtgtttggtttggcttcaaagttatgtaagttgaatttgatcttttcattgtgggatctttcttttcgttgggcaaagttacgtggcatgagactaatgataagctgttgactctcttttataaatagtaccctcaaaaatgtgattagaagactactaagcctatacttggagatataatctgctgacttactgcattttagctgcctgcttattcctggagatgaaaatgaaattttgttggttgatatttttgggtaccatcaagtcgtgttagtatggtttgaacactgaagtgatctttaactagactgttggtttctatgatggttggatggaagtaaataaatgtatgaatgttgatggatccatgtatgtaaattagaggtcctcctctagattctgtgtgcttttgttataaatatagaactgacagggacaataatttatgattattaataactaacagttattgggcatttactgtataccaatttactattctaattttaaaagaacttttgtaatgctttattaaagtccactttaccatgaaaattcatcctttcaaggtgtacaattcagcagtccttactatctttacggaattacgcaagcagcaccactatttaatttgagaatgtctgtatcactgtgcagagaaacaagccactcctgttctctctgcacctccagtccctgtggactaccagtctgctttctatccatcttggccaggtactattctcaatgcctggttcctccactcttcaacagaaagtgctacaattctcattttacagtagaaaatttaggcacagaaatgtaattgcccaagatcatgtattgatgcatgcaagtgaattgatggtaagaacacattagatgaaatgcagtttgtattacactcttaggcacatagaatgagcacattccttcccagagtatgccccctcttactcacctttgcatcctggaactgattggacgtagatatgtcttttttttttttccagagtaatgacctctggcatctgagcacacaaagcaggcagacttaaaaagacaggtttacggcccttactcctcattgacccccccccccgtttcctctcttcacacacacacaatcaatttttccttaagcttgaagagtcaaactactacttaaaaatcttccatttcacgtttaccacttagggtactgggtctatttctaagacttaagattaaagtcattcaagtactgaatgcctttctattcggatagatgtgatgagaataaagactttgccttaataaagcttgtt

SEQ ID NO: 36003 - DNA, 1326 bp, Mus musculus
aacccgtgccagagtctggagtacgcgccctcatgctcacttcccagtacctcatggaaccctgtggcctgggccgctctcgcctcactcatatttgccgcgctgacctcaggtaccaggcctgggatgcctgcctcacccccttggccctgagcccatccattgcacttaccctatgtcagtgatacccagtgtgggaaagacttcctttctctcttggacggaaaccccatttctcatatctgcctgcctcttcctccccaggggccgttctcctgactggtacaacaaagtctttgggcacttgtgtgccatggaagtggcaaagatccgagactctttcccaacccttcaggcagctggcccggaaacaaagctctgagtcttaggctgacattgccaggtgtctgccaccaaagaaatgagtgggaatatgaactgagaagcctttagagacacagccaggcctcggtggcccagctacctatcctcttgtatcctaatgctactctgcacacacacaagagaagagggcgtaggtatcctacctccacccaccttcatccccgatactgcattctgatctcacaagcgaagagaatcttgttagtggcaagaagatcattgctgtccatctgaccaagaagacgctgctgtatctggaggcccagcaggggaagaaggtggagagccttggacagcctgggctctctgccataccaagtaggcaggccatcttatttggtgctagggttcttttgagtttgaatatgaggtctgatcctgcctttggggccaacattgatcctgaatacaggtctggaacaccagatcgggtaagcacgggggacacaatgaccaccacaatccattttatatgtgaacatgatgctgaactttctgaagattgacagtggccctatgggcccttagtaggtaacatgacaaactgggataacttgggatctgaggttagaggacctttcttcctcaagcccaagaaaccaatgaaccatcctcccctactttgacccacactttatccattactctctagagttgtgggcagcctttggccactcatggccatagatacaagtgaaatagctcattcccatgacacaggccaggccaaagctgacagtggcagcaagaaatacaaatgtatcctcatgccttttgcctacagtggtggtctataagaacagtccttttggctggagaggtggcatagtggttaagagcagtggctgctcttccagaggacctaaaagttcaattcccagcaatcgcagggtggttcacaaccatctgtaatgagatctg

SEQ ID NO: 36004 - DNA, 1240 bp, Mus musculus
ccgctctcttctcccccacacccctgcccttgccagctgtgcccacctttgtatttagttttgtagtttcttggcttttataatcccctttttcttgccccctgggcttcggaggggggtgcttgtgcccccaatccccatgctcttgtgccttccccctctggccaggcctctgggctccgtgggggtgccctttctaggagggcagggttggacactgacggactgcaggcagggaggtagccccctggccctgccccctcctcatcccttcacccatccccaggactgctcgtccactatcatcactgtttttaatgcttttgtgttgattttttttaaagctgtcaactcattttcatctgtttttttttttttgagaaaaaaaaatgggaaaatgtacaaggcagccccttcccaggctttctgagcctggcctgacccagtctaagagggcctggggcaggatgtggccagccaggaaacataggatggcatttcttttatagactccttagtagttcaggggagtgggggagggtaggccagggctatttctgcccaccgaggagagaagagcgccaccctcctttttggaccctcatgagacaatgctgttcctagcagtggggtagtgactaccacccttctaccaaaaaaaaaaaaaaatcccttccttgtgggattcttgggcatctcctgcctccttcactctcacggtaattaatgtcttaattggctgttgcctggggaacaggagagctgctgcaggcagatgacctcatggggggtggagggaggtgaggtgcccaggtggctatttgccctgcagagctgggagttccccccaccaccaccaccctgttctctccttatctttggcatctttggttcaaggtggagatcttaagcgggtgtaaggccaggcggcctgctccttccctgggttctagtacaaagcacacacaccccccactcactcaatatggctcccactgtccccccaccccaccccccgccccgagtttggagctggggcctggaaagaggaagaggctgcttggggctgggccagcctgcagtgcactttgaccccagctccttggcagcacggctgctaacagactgccactcaactgtgcctcgcaggcactcccagggctgccatggaaggagctgggccttacaccacccacctccacactgcctcctggccagctgcccaccccggtgccaggtg

SEQ ID NO: 36005 - DNA, 1115 bp, Mus musculus
cagggagtagggacttgagtccaagtgcgtcaggcctggcctgggtccctacactccctcatcttgtcctagcccaggcctccatgaaggagagctggtggtgttaccccagagctctccagagatgagcctcccctaccccatcctgtgtccatccccagcctaccaaagagtattcatcccttcccatccctgaccttgtggcctattgtcccactgagggacagctagactcctcctcaccctttagcaggtccctttctctagccaccccttgcccttgctggacaaagttcagaggctggcaagaggactctgactggagataaagtgctgctgctaacccttgcccgaggaactcatttagtcaggctaaagggatgagtgagagatgaggcttgggagcctttggccttgcttgcactgacctgctggaagaaaaggaaggacacattgcctgggtatctaaaagccaatgcaagctgacaagaacaggagcccgattctttgtgggataggccaatggctttcagagaccaaaaggatgcatacaggaggacagtcctggagcagcattacagagaaacaggaggggaggggaaggaggagctgcaccctgccagctttgtgatggatggacgccctccctagcagacaagggttccttcattcaagggccactgttggatcccaaatcagcttcttgagcctacggagcccgtttctctgccagtttactcatatctcacagcctgtcctctgcctggaccctgtgtcctccatcttttggccctcagcacttcgggcccggccacataccccatccctagagtgctcttttcagctggggagggtacgaggtgctggatccttcccagatgtgcttctgtgtaagtgaaaggcaggggcatgggctccagagagatcccagtactgccttctgacgcctgcatcctcaggaggggataaaggactgggaagcaaagggggacaatatggtcccagggaatggacccttggagactcccatcctctcttccccctcaccaagtgcccaggagacccctggctcagaccagcccaaggccttgcccagtggcaggggaaaggggcac

SEQ ID NO: 36006 - DNA, 1151 bp, Mus musculus
ctaagtctgtggtgatctgacagggtgcatgggattatttcaatcttcttgtatctgttgaggcctgttttgtgaccaattatatggtcagttgtggagaaggtaccatgaggtactgagaagaaggtatattcttttgctttaggatgaactgttttataaatatctgttagataaatttggttaataacttctgttattttcactatgtctctgtttagtttctttttccatgatctttccattgctgagagttgggtgttgaagtctcccactattattgtatggggtgtgatgtttgctttgagttttattaaattccttttatgaatgtgggtgcccttgtatttggagcatagatgttcagaattgagaattcatcctggtagatttttcttttgaccagtatgaagtgtccttccttatcatttttgataacttttggtttaaagttgattttattcaatattagaatgaccactcgtgcttgtttcttggaaacacttgcttggaaaattgttttctagccttttactctgaggtagtgtctgtctttggcactgaggtgggtttcctgtatgcagcaaaatgggttctgtttaagtatccattctattagtccatgtctttttattgggtaattgagtccattgatgttaagagatattaaagaaaagtgatggttacttcttgttatttttgttgttagagcaggaattaagtttgtgttgctattttcttttaggtttgtttaaagactactttcttgctctttctacggtgtagtttcccaccttgttttggtgttttccatccgatatcctttgtaggggtgggtttgtggaaagatattgcttaaatttggttttatcatggaatatcttggtttctccatctatggtaattgagagttttgctgggtatagtagtatggggtggcacttctgttctcttagggtctatatgacatctgcccaggatcttttagctttcttagtctctggtgagaagtctggtgtaattctgataggtctgccttcatatgttacctgacctttttcccttactgcttttaatattttttcgttgtttagtgcatttggtgttttgattattatgtgatgggaggaatttcttttctagtctattct

SEQ ID NO: 36007 - DNA, 1151 bp, Mus musculus
gtatggctggagagatgaaatttatcatgatcacgactagccaaaacaacaggatctggaattaaggcctctcctattagagctctgttgatgcaatcattgcctgcagctaaaggtccaggaagaccagagtgagctcatatatgaccaatataatatggatgttttcaggcaagaatgatgttttgcaattgtgaaaacagagatcctactggcatattaaagttaaacatgccacaagtctccaataagggaatcgattgtgcaccatataaactatcagtaaaaatattaaaagtatcatgtacagactgaaaaacattcagtactgctgtcagttctgctaactgagctgagaggctcaggagtctctatgactacttgttgattattcataagatatccagctcatcctttagaggagccatcagtaaaaatcaaaggagcatcatacaaaggctgtaaagaagtcatattaggaaatatcacctcatgtacatttaaaaattttatcaacctatcttgaggatagtgattatctataattcctataaatcctatttgagcaagcaaccaatccgtactgtgctgattcagccaactatcttgatccatactataagactgaacaatgatatctggctctttgccaaaataagttagtgcctacttccatccaagtatgatcatctgagctactgcttcataatatcctcaaatgtatccatgttagaggagccctttgccacaacaatcctgtaggcatatgaatcatattaaaaattaacagatgtaaaggcaaagagtaatctatataagtgacaaattgttcttcaatagctctttctacttgttgtaaggccagcaatccttctgaggttaaagatctaggggaggtaggatcagaactccctttaagaatatcaaataaaggtttcaattcccctgtagtaagctttaaataggggtgaagccaattaatatcacctaacaatttttgaaaatcatttaaagtttttaagttgtccctgcgaataactatcttctgggggaaaacagcttgatttgtaagtctaaaccccaaataattataaggatcctgagtttgtatcttctcaggagctatttatagtcctttatcagctaaggcc

SEQ ID NO: 36008 - DNA, 1115 bp, Mus musculus
gtacttgtgtctcaaaattttagatgagcagaaatgtgaatacaatttcaatacacatattcatgcataaaattctaaaagaattaataaaaataattattttaaaaactatatattcgtgaaaagaagtctgaccttgttagttagcagtgtgccttaaaaaatccatactagttaacctgataaaacaaattaatgacttaggtggccattacaaatttagtatataaaaaaattcaagtgtgtgtgtgtgtgtgtgtgtgtgtgtacatgatgtacctatgtacgtgtagttacatatcacagtgtgtatgtggagatcagagcacagctttgtggagctatctttttccacctttatataggttctggggattaaattctggattccagacttgtgcagcaagtagatttactcatcaagcaatcttgttgaccctgttacacagcatttaaattaatttaaaatattttaaatcgttggaaattttgtaagttgattggtgttcccatcaccccactgggggttctgtctggctactgaaagcaatctcttcaggttccatatccccactgttgggcatttcagctaaggtcacctgcattgagtcctcggagcctccccatctcaggtctctggaatttcttagagattccctatacccctcccccagcagctgcctatttccactcattttcctgagcctttcagcttctcttctgtttctccctatacctgattctgcccaaccccattcctctctcctcatgtctcccaccctgatccctccctccctctggttcccatgactattttggttgcccttcttttttttttttttaattaccaactctttttttatttttaaggcattttctattagacattttaagtgggatttatgcatcctcacttggaccttccttcttgtttaactactttgattcttttggggtatatcatgcatatcctgtactttatggctaatatccacttatcagtgagtacataccatgaatgcccttttgggtctgagttaatcactcagaatgatattgctcctgtctaaaagaaatgccgggataaaaatggaccagagactgaaggaatggcc

SEQ ID NO: 36009 - DNA, 1135 bp, Mus musculus
gccatctggattcaaagacaatgtgtctggctacatctgctgatgatatgtgtctgtaggggcttacaaagcaatatgattttataaagatgaaaatgagatttttaagctgacatttgtcagtgtgagtaagggccaatgatggaagcagttccagaaagtggaaacaattgaagaaatggaactagtactgccttagagttaaggataaagggtgccaggggattgtgaaatcgtctaagatacttaacctttcacctgggaggctatagaagcatttctttagatgtgatgagtgtctcaatgagttaaaaggtagcaaagcaatccaactttccttttggaaagctattcatgttattttgctggctatggacagtgtttgtcaaatgcattctaaaaatatttactgagtaaacagatccaatttatatcacagtaggatagaaaaactagaagaagatctgtatttgtttagttaatgtttatattcttaccatgtagacaaggacatggtacatgacagacttcagtgaatatttctggttccccatggggacttcatttctagtgcagagataaacagaaaacaaaggttgtggtggtaagggctgtaaagaaagatacagcaaagaaacagtgaaaggggtaatggagtatactgaacagtgatggggtgggggtctttgtgaaaagggggtggctgaggacagccctgagtgaaatgaagggaaagcaaacggaagaaagcaaccaaaagttttttttttttaaaaaaccctctgaaacagagaatgcatgatatgtttcaggaaaatcagtgtgactgggatcataggaagagaaagaaaggagatgagggcagacagtaaaactcattctacagccttgtaagccaaaggaaaggtcctagtgtcttattctgcatggactggggaactatattagatgagtttgagtagatgaatgacagtatttgacttacattttaacagactccttctgacttctctaatgaaaaaacagggagactcaaagggggtaatatccaggcaagagatgataatagcttagaatagggtggaagcagtatagttagtaggaagtgctatgactctagaaagattttgaagga

SEQ ID NO: 36010 - DNA, 1122 bp, Mus musculus
gggcgaagcccctgcatcctagattctcccattccatcctggcccatgcccctgccccaggtttgggagccaggactcccagaacctctaagtgctgctgtgtgtggaatgaggtatactggcgttgcagccacaaagagaaatgccccatgctatttattccccagtgactccaggatgacaaggcctatgtgacttcccagaaagaccttgagttgccaggacagttgacggagccccagggttgtcaagaagcagaaccttcttaggctccctgctgactggcttatggtgactcctcaacccttaggtccctcatcagatgtatcatttgttgcactaaaatgaggatccaagacagtaggccacaaaaagaaaaggtgcactccagattctaggggtgatggggggcttcttctctcctggctgggggtgccattaggttgcaacttaaggagagggtcaggtcagaagaaggcaagtccttgtggcaaagacctgggcaataacctaccaagtcaatatccttgacagaagaggcattcttgctgcattgcactataacctactagaggctcaaagaaaacttcccactcaggctgagaggtatactgtggcagcttgctggactccagagctgggaactttgctttggcttggaatcatgcaggaatgaccacatgcatgcctatgtaagaagctatatttggggtcatgcatgtctcattgtgtttacagctatgttccactctcagaaaactacctggagtcttcccacctgtcaccacccaccccagtctgactagaaattctatcttctttctcctcggtgcctacctctgctttagacaggtgcttcacagtgtactctttaaattacttgggcacaaagaattttccatttattaggcatacaattcttctaattctaatcaaactgtgtctgggaacagatggttaaactggataacctccaaaagccccttagagtttgaagatcggtggcactcagcagttacctgccacagtaaattttggaattcccaaaccctacactcccttgggcatcagcacagtatagcttttctacctttcccagggagggggagaaagtggggatag

SEQ ID NO: 36011 - DNA, 1265 bp, Mus musculus
tctgactcccgagctagtgtcttaccacacacttaccacacactgtgtggaatttgggttccgaaagaaaaattaaaagtgatcacatggaactgatatcatggcagagtcctagggagaaacctagcaatgctatggtactgcctagtctcttggctgccacaggctctgtggaagaagtcttggatgttttctaatcctgagttgagctctgggacccacagaacttggagccttcatgacctttcacccatctgataaaagcagcaaccatcacacaacgagctgctatgtggggcaaggtcttctgtcttccattcctgaccctagctactagttctgggagccagtctgcttcctggggttaggtgtgactcctcctctcctcctgccatattacaaaggccttaatgttgccagaacatcttcctctgttgatgttgagaggttgccctcccgagaatggagggaaaacctaagagcaccattccaaagccacatggctatggagaaatagaggaagtttcctaactgtgcccctgcaggacatgccaaccccatcatatgctctgtgcttggagatcataggggaagtgggcttctcactaccctgtcttcatcctgaatcctcacaaggagccccagatgcagaaggctgggggaggaaataagaaagaatggggggcctgctgtgctgtactcattggcaaagtaatgaagcatttactgataggaaaatagggatatagatttacagtttggaattgtcatgatgtgaagttatcccaaggttagcatagagaatgggatggggacatgtttgtgtaagcagatgacatgttagaagaaaaattgcaccgcaggagcctctaccagctgcttgagcttcaaaagccaagctggcacaaaattgtacctgctagatgttatgtggctactggttccctggaagatgtatcattttgccttagttgcccctggacccatcctgagcctaatctctgcagcttagtaagaaaaggctaaggaccctagagatgagggctttggtcctcatgtgagtgattgcattttatgcgtcttctagtggatgcaaacagatgtagagaaatctttgacctagaaaggcttttagagggaatgcagcccaacctacatcccatcctgttactcatatgcaattgatgtccagacagggaaactggcccacctaggacagtgtgcaggcaggcccccacctccagactcagcaggagaaggaggca

SEQ ID NO: 36012 - DNA, 1702 bp, Mus musculus
tggaggaatggcaccgcgcctcttctagaactttccagcagacgcgaaggaactctgccctaggcgccatctttgtcacctctccggccgcggttcctctggaagaatagaagcagctccggctgctgggagaactgaaactgctacggcgtctcttagtaagagcagttgcttttcctttgctggtttgcatttatgtttgtttttcaagatttgtttaatgtctgtgtcctgcctcttttttgtttgtgtgtttggggcgggggttgttaggttgttttggtttgggaggcgttgggtattttttgttcgtttttccccccctctcagatttttttttttttttttttttggtgtggctcctttcatgtggcagggaacggcaggcagtctatacacaggataatacgtctttgggacacctaaggggctttaagattcaactctaacttcatttggcccttaggtaccattttcttaaagttttaattaatgttaggctgaaaatggaaattgtgggttttctcaatgtttacctgggctgaaataagtttagtagaatggttcaggttgtgggattttccctgcaaagtagagttggtgtggctgaaatgacttatacgtgtttttcagttagaaaaaaaaaatgccccagccggctggcttgctcttaagcaatgttaaaatgcctgggttatgaataagccttcaaggaataatttgcttgtttggttttatttttcattcaaacttgtgcaaccagccataaatgggttttagctgcccagatattttcttttttccttttttcttttctttttttttttttttttggagggggggggttggttcacagactttgttgattcaacagtgaacagcaaagaaaaacgttatcattccaggggcttcaacgtagtcgtgaaagccacccttggaagcccagatagtttctaagcactaacacaactgttttttttttttttttctaataggtaaatgtaactgttagatgcagaaattcagtttaaatgaaccagtacctgaagtaagctttatcttaaagatgtgaaagacctgaacttagtgacatggtttgttaatttttagagagaaaaatatatattaaaagtttttgtataaaggaaagcagagaacaatacagctcggtttctattagaaattccttgttctcttaaatgtggcattcaaaaggaagagcaagaatggaatggtttacaggtttaaaattcactactgtatgttagtgaacttacttaaatacattttaaaaatgcattgtcacttccaaatgatctcaaatagtatatgttagtttaaaaactttttggaaaacgtatgcaatgtgttaaaaataaaagcagcttttgaaatacctggtttgcatttcttgtgcagctgacttgggccacatgaagtttgtatcccagatggctttcagcaaagagctcctgaagaataggagcaggtttggtggggacagatgaggctctggatgagacacctgcagtcttggaggaggccaagaggaaaatgcttcccgggctggaatttaaagagggacttatacgacggatgccctgggttgatatttcacttagtgaaacacatgaaagggcttcttttaatattctctgctgtgttttaaaagtagccctgatggtggggggggtgcccaggg

SEQ ID NO: 36013 - DNA, 1164 bp, Mus musculus
gctgagatcattgaatcctaaaactagatagaggtgagtcagaagatctacctcaggaatgttttgcatgaaagaaaaaagatgaccagcttttcagcactttcataaggaagtcctggcatcagtggtaggtaaactatgaccaatttaaggttttggcattctttgaagatgcaacttcaaagtggaggacttacaggaagcactgtcactgagcatccagcacagtaggctctgatatggccacatgactaaaacatctcatcccaaaagatgataggtcttactgagatcaagataggtctaggctcatcttgctttgtagtctgggggattggctctggcttagagaacccattcatagatcatagactctacttccaaggtaggaattggcataaatagtgcctggacatctgcaaaggcagaccttactatagccttctttggaagaactctgtattgttacgttcatgggtaatgcttttctgtggaacagatacaagcagaagaaggaggtggagcataggttgtctgcactgaaatctgctgtggaaagtggtcaagcagatgatgagcgcgttcgggaatatcacctccttcaccttcggaggtggattgctgtcagcttagaagagcttgagagcattgaccaggaaataaagatcctgaaagaaaaagactctccaagagaggtaagccttgtccttgaccacatagcaatgggaagctgccacccgaagtttgaacattctgcaggaaagaaatcggatgaaaatccctagctgcttgtagtggtgacaattccagctgctcaggaggctaaggcagaaggatcacaagtataaggtctgtctgagatacaaaaaccaaagagctctaaacaaaaattatgaaacgctggaaaagaactcactggaaaagtagctcattgatggagaacttgtcgagcagggatagagcccctaatcattagcactgcaaatactaaagctttgtcaacctccataaaagcattgctcacgttagggtaagtggagaaaggctgatggtttgccagaatcattttctgattcatttcagcaaccttccctgctactttctaatctaaggcacttagttgggactggatggtgtcaaggaaatgctttttccttaaaatct

SEQ ID NO: 36014 - DNA, 1221 bp, Mus musculus
gatcatgagatagagcaaaggtagagaaaattggggtaggccaaagctataaacccctccacgcaaaaggcaaatactcaggcttggataaggaataattcacagatccagagcatcagaagggattcttacgtggacatgctggccagttgaatctttcctgagatgaggggaagaggaacactcagttatttaatccttttttttttagtgcactataatattccataatgatacacctagtgtaatataaattaactgcctgagataccacaccaacactcaatgcttcctttttttttttcctcttcttagggcaactcttcagttacacacttacccaaccattgcactacattctctttctctctttctctctttctctctttctctctctctctctctctctctctctctctctctctctctctctctctctctctctctctcattctctctctctctcatgtgtatgtgcatgagcgaatgcctgtgcatgtatccatgcatgcacaggtgcatgtgtgtgaaagctagaggaatgtccagtgtctttcttgattgctcctcatcttattttttaaccccttctatttatcctacttgctcatactccatctcttaaatacgttccttgggctgcattgatactgaacttcaacaggcacacagtcagttaactatatgaataaataaatgaatggatgaaatttctttttgtccctgtactggacttgaccctgaattgggatgcttttgacctccagctcagaaggaagaacaggggggaggtgggggaaagaagagggaaagctgtagaacagaaagggttgcgctcatactttcttggggggtggcagtagaagcctctgtggaggccgaaagccctctttgcccttactcatcatctctcttgtcactttccccaaacatttccatcctgtccccacgcttaaggtgctagggaagcatagagagggaaatgtctttctggtgctttccttcaaaacatagtaggcttggtcagagggatgagttgggggggggtgctgagttctagaagtctcttacatcagcctgaaaaatccattgcttgcatcagaaaagatgcccctctcctcctaaagaagatgctaaaggcaaaggaggtggacttagtatgggctagaagcagagagatttagaatattacctgagggaagagatgaagctcgcatcagc

SEQ ID NO: 36015 - DNA, 1156 bp, Mus musculus
atctccatatcctagctattttgaaatcaacagcaatgaacgtggttgagcgggtatcttcagggtaggatgccaggtcctctgagcatatgccaataaacagtatagctgggtcatatggttgctttatttttagcctcttgagaattctccatgctaatttccagagtggctgcatcagtttgcaattctaccaacaaggaatgagagagttcccttttccctgccctccagcatttgctgagtgttggtcttttgccattttgactggggtaaggtgaaatgtcaaccttgttttgatttgcatttccctaattgttagggacaatgaacattttcgagctatttcttaagcatattttttcaggtcccaagctgaatgggtcatttttgtttgattgattggtttttttttggggggggttgttttacttttttttagttctttgtatattctggatattaattctctgtcagatgtatagctggcaatgatcttcttctatttgtgggtatcttctccacacagctaactcctggcctcaccttacaaggaccaaaaacattccttgaactgggcaggcagaaatactgtaacaatggttttctgtacctgaacctgtaccacctgacatcacacctgtgcgctcctccagtagcaactagtgacagttgtcatcatagccaagtctgagagtggccacacccttttggcttcctctctggggtttttcacagtgtaagcatcaggtactgctaggccaaaaggtaattacaagagtaagtgatcagatggggaccagggtagctgaggtcagacagaaaaagcaagtgactcggaggggcaaagtacaagaaacctaatcaagcttgtaagtaaggggggaggggtacaggtgcctgaagcagagagatcattctctggagttccagtactctctgaaaggaaaaaaatagctcggagatcacaccagccatgtctggacaaaatgatttattagagtgttgcagtgggggcttccacacagaattatcagagataggctatcggatcctcttaactctgtctgctgttggagctttctagctctgtgtctggctgttgtgctgcataaactcttcgatgactatgtcctccgagctttcaggagcagca

SEQ ID NO: 36016 - DNA, 1224 bp, Mus musculus
tgtaacacatctaagactgggaataagatttcggggattgctgtatcttgcagagagtgtaccacccagactacaacaatgagttgacccagtttctgccccgaattgttacactgaagaagcctcctggtgctcaggtaaacttataggggctcttattccagtaacgtttggtccatgccagaaattggccatggttggggtgtggatgtggattgggaggtaggtgaccagaaaagcagaggtggcacttctacagcatctccttttcttctgagtacatagatgtccctgttcttatgtctctgctgagtctgcatcctgtgtccttttgtctttcagttgggatttaacatccgaggaggaaaggcctcgcagctaggcatcttcatctccaaggtctgtgtgaatgtgtgtgtatgataggctgtatggctagctactttgttatcatattaaagtgcactggtggcccagcagataaaaaaatggatgacccgctggagtcataggatagacataatggaaattcagcctttccctttgagaactgtacttggggccagtatgctggggcatgtgggcatgtcagtactctgagaactcgagaggcagaagggggaagattaggagtaggtaacaatctataaagtcaaggcagacaatggtgacataggaccttagtcccagcacatgggaggcagagataggcagatctctgtgaatccaaggccagtctggtctacggagtgagttccagggcagccagggctacaaaagaaaaaccctgtctttaattaagaaaaaaaaaaaagaatctcaaaaaaacaaactgagaaccaaatttcactagcaagccacttaatctcccggcggtatcaccaaaaataacacatttgaagagcactgaatttgccctgcagtctcctgatttactccatcacaactacataatacctcttcactaacaggtgattccagactcggatgcacatcgagcaggacttcaagaaggggaccaagttctagctgtgaatgatgtggatttccaagatattgagcacagcaaagtaagcatagcacatggactatagtcatgcacgaagccatctcaggtaggacaggttggacccgaatagccttatctgtatgaaagcatctcttcaagggaaatgtaccagaagagagcagctatcagtgagctagatggggcgcattccattg

SEQ ID NO: 36017 - DNA, 1109 bp, Mus musculus
actgatcaggtccctgacatgggcttctaggctgctaagactatcagctggacagatttgctcagagaccacaagtaaaatggcttctgccttccatctgcctttctgggctcctaggaccaccttaccttctggctgggttacatagtcaggaaaggaattgtcccaaatgccttgggaactcctatgactacagcattgaagccatagttcaaatctcacacgctctgggaacactggtctttgagtctcatgttcaggagcatccctgtagcaagtatcctgtggctccatgcagctcttgctgccttccctaggactgctgtcagctcatttgggaaccataggaacccaacaccaagtgtcttggggactttttttaggaaggcctcatcattgccaggtcacatgggggtttacccatgagcagagatgaggctcagtattgctcttaaaggatgctgggactttagctcaggcatgcaccagtttcctggatgcttcttagagatgtgatgtaggtaaataaatggacctttaaaggggcatcattaggctatagttttggaagttgggcctaagggtctggactcaggtaaagtgactctgcaggtgtgtttcaaccagctggagcttctcttgattcttctcagaacaagggggctattgaatataactattacctataacaagtaactccctagagcttggggtggtttggtggagactcgacttatgggcctagccccataattgggcaatatttcactgaatgaaaacagcccagcccaaggctgctgaatggctccttagccttcttgccaacagaaagtgagcctgttttgtggtgggcgtggggtgtggtgaatgctgtacacagtcatcagatcataaagtgctgacgtgtttccctttttgcagaaggacaagaggatgctattttgtcatatgagccagtgacacgacaagaaagtaagcccccttctgagagtcttgcctttgtgctagtctcccggtcatggggcttagtaaagaggatagcttggggagcagggaaggaggaggaggcacatccagcccctggctcatccctagcatcactggatgga

SEQ ID NO: 36018 - DNA, 2073 bp, Mus musculus
aggtgcaaatccatcagagttgttgttctcataaacacccagcagaagcgaagagaagagaggaggactgatggaaagacagactctggacaactgcacagcttgtgaagtgagcgaaacagcccacgtgaggaggcgctcccgggcattcctaccctgtactgcggcttgcagctctgaacggtgcaacgtaacggctacagaaaggatcttatttatatatagatatatatatgtaatttatataaaatatatagaaattattatatatatatattatacactcttctataatatatatatatatattcacatacattgggactagaaaatctatggagacgtccatcaacggtactatgttattagagaaatgctttaattttcatattccaatcagatgacatcttttgttccacctggttgggaaggggttgacaacagtagtaagtgctataccaaagcactcgaatttggtcattctcttcagagctaaggcttgctccaggtggggccaacctacagcataagagaaggggctttggctgggagctggagattggagacgtgactaaagcagttgctgcccctgcagggcagtcgttcctgtgcagaaagagagaatgaatggctaatgatgctccggatgaaattgcctattgttttatgccgcctgatgtgtctgcatgagaggtttcctttttgttcatttttaagctgctgttaaaccaaaaccatgttgtgctactgtgtcagccttttcattattccagattttacttttactatttaagtgaatgcgtagaatcctatttgccagtgttctaaaggcttgtgaggttctgaaggagccaggcctgggatacagcggtaacttaggcctggccatccagtcaacagagggaaagcaggggctggtgagggcagagagtacaagctggggctcggagttaccatgctggacttagctaggggttccttcacggggccactgacaggcatagggaggtgcttgccttctggctcggtgctgggacagtggaagagcaccaggcttggccagccgtgtagtgagttggatttggattcttttcttttgcaactgctccatttgccctaccccagccccctcaccaacagctggtagcttactgtttcttcaagaagaaagtagactttaacgctgtaaatttgagctgtagagctaagactcgcttactggtgagctgtgaaatcttgttgcttttttcccagagtctgatggcagtgactggtccaggtagtttccctcccgcagccagtgcaggcagcaggtgtggtccaggccctaccccaccccactatgctcctttgaagccaacgtgcctccctcacctccacactggagggatgacgcaggggagaacatagaattgcttggccctcaactgggttaggaccatcgcaggtgatgcagggttgacactttaaagcactaccagccacattcaggaactctgttcacaggtatcctaccagcataatgaggctaactgtgactcgtggggcccagagttagaagaaagaaaaggcagcagctttctcttgggcagtacactggattgaaggcaaagagggataaagtgacagatgattgtgactctcgcgagggggggtgagcgggaagtgttgattctctgatggtaactgacagcagtggacagtgctcaatcctccctcccagggaagaaaagcaaagattcgaagtaagcatgataatagttggtttaccagtgttccttccaaggagacatatattttttaataaatgatagttgcaatgaacaatggctcagaggtcttcttgaagtagtcgagtagggtggttggggcccaacagcaggaagaattcagaccaatggttcctaatgcgggggggggggggctgggggaggggtggctgaccgggcagtccatgagaagggtgtgggcgtgggtggtgctagatcctttgctaaaagtgtctacagaggcttctaccctggcctagaagctgcccttagcactctctgctgggcaggggccgtgaccttg

SEQ ID NO: 36019 - DNA, 1275 bp, Mus musculus
tattctctcacattctggatttgaagagtctaataatataagtgataaatgagtggctgctgaaatccagagtgtgagtagggcttgaacttgacctgttctgcccccagtagggtaaggatctctttgtaggtcattgagttgtataaagatttatctttgttttgcaggtgcctgctgttcctctactcccactggtgagcatctttgtgaatgtttacctgatgatgcaaatgacagctggcacttgggcccgatttgggatctggatgctgattggtaggtgtctgctttgaagagtaagcctcttaggtgacctatcctgactcctctccctctggatctccagttgtaaacctcaccttacagttgtctatctctactaggatttgctatctactttggctatgggatccaacacagtatgaaagaagttaagaatcatcaaactctacccaaaacaagggcccaaactatagaccttgatctcacaacttcctgtgttcacagcatttgacctaaccatacctaattgttgtcttgttctcctatacaataatggagagtactcttgaccccacgaagagctgggcctctcatgtggtgttagtgacggatatgaaataatgctctgtatttcttgtgaaatgatggctatgtctttgctgtttctcatttgtttttaacttgtatactttgaaatagtctctgtagttgtttcctggctttgaaaaaaatgttattaaaggaaaattgtaaaaaaaaaaccaaaaaacctgtcctgttctttgcttactagagattatataaagcttagctttaagactgggaaagattcagagaagtgtcttgtgtctttttctctagccgtcacaaaattttctgctgttcctgggtatatgccttctggacagggtttggagaggatagtaaagactgcctaggtacaaacacctttaaaaactattcatttacctatttatttaacaaatatgtaaaattttagaccttgtgctgagagccagtgacacaaacagtaaacctttgctctagtctcacagtctagtgaggggaacaagcaggtaaacacgaatataaaatgatgagttgattcagggcaggatgagagatgaggaagcacaaaggaccacatttgacctgagtgcttaagcagtagactgaaaggagggtatgattgccagtgaacagtacaggaaacaaccgaattaggataaaacagattctctgtgacctgactgcagttgtggtgtagct

SEQ ID NO: 36020 - DNA, 1134 bp, Mus musculus
caggagagtgctgcatactggcttgttccttgtggctaacttctccactcagcttccttttttatatacaccatgattacccgcccagggatggcaccacccacagtgggctggaccctccacatcacccattaattaagaaaagtgccctctagacttgccaacagtccagcctcacggaagttatctctaacttgtgttaagttgacttaaaattagccagtgcagttgaccatttgttaatttgacacacaaacacatcactattcaagtagaaccatacctttcttgtttgtctccaagatctcatattacttgggaggcagaggcaggcagatttctgagtttgaggccagcctggtttacagagtgagttccaggacagccagggctacacagagaaaccctgtcttgaacccccccccaaaaaaatctcatattagtatcaatatcacaaaagaagaagacactccaacttttaaaagtcccctagtttttaaaaattaaaacatgctaaaatttcagtctctttaaaacatctgaagtatctttcaaagtttctctgaaatatcccaaaatctctagaaaatgacagtgtctctctaaaattccaaagtttcttaactgtgggatcctatatttatatataagaaaagaagttgcatactttcatattaagagcccagaagagggctggtgagatggctcagtgggtaagagcacccgactgctcttccgaaggtccggagttcaaatcccagcaaccacatggtggctcacagccatctgtaacaagatctgatgccctcttctggagtgtctgaagacagctacagtgtacttacatataataaataaatctttaaaaaaaaaaaaaaaaaaaaaagagcccagaagaatcagaaagaacataatcacagccgagtcaaagcaaaacaaaaatttaatatatagagttctgtgcttgagatcagggtcccactcaaaatttctgctcctcaaaagggtctgtgctacttctccagctcctcagcttgtcccctagggttagtcctgctctactttacagctgctgctgaccttggtggtcatcccatggtactggcatctctaaaatgctggggtctctgatgt

SEQ ID NO: 36021 - DNA, 1064 bp, Mus musculus
gtggctgaatacatttttttgtggaaagatttaatactttaaccacaggctgccgagcaaagctttatagcaatagatacttttgggcctgagactgagggagtgaataggagtatcttggattttaaagggcagaaggggagtgttttagggagactagtcaaccatctgaaagcctatttattctacacgatttttggatcattccttttatttttgttaactttcttatatccctttgggccttctcctaccttccccacctttcccactgccagtcagcatccactgttgtatcccttgccaggtatttgcatcgtttatcctggaaagctgattgcattgtagataggtttccatactccaagtctccttctaaattctttctactttagctgaaacttggtttctatcactgtgataaaataccaagaacaaaagcaacttgaggaggaaagggtttgtttagtcttgttcttcctgaagggaagttagggaaggaactcaccgtaggaactgaaagagaccttggaggaactgctgctcactggcttgctccctatggttagcctgctttttttttttttaactcagaatcacctgtcctggtatggttctacctggcctaggccttcccacaccaatcactaattgagaaaatgtctcatagacttgcctataggccggtttagtgggggcactttctcaattgagcttatctcttctcagatttctaggtatgtgtcaagttgataaaagccaaccagcactgctggcttctcccaaagagttatactttccctattgctatggcgcttttcagatagggggtctcactaggttgccttaactgatctctgatctcaaacttgtgagctcactcctcctgcctcagtcttccaagtagccaggaatacaggtgtgtggcacaagaataatgtacataactggtttcttttctaatacacattaggtggttttcagcattttagtttataaacaatgccacattgagtatctcaataaatgttatgtttttgttatgtaaatatgcttataggata

SEQ ID NO: 36022 - DNA, 1884 bp, Mus musculus
gtatcacgtgtgtatgttttcagaattgacctttggtattgggtaactcattggtatgcttttccttggggaagattgtttcttctgctcccagaattcctcagttgcctgtagttctttgtgtagggttgagacctcgtggtctcccctctacctccacattatgggtggagtttctgccattactaggagatacaatctcatagtaacccccaccccatactctttctggcttttaaaatctttcctcctccattgtttgcagtgttccctgagccttaagtgccaggagtattttggagatggatccattaggcctgggctccacaactgtattttgattggatgtgtttttctgtaatggtttttattataaagagaagtttccttggtaaggggtaaagactacacttatctgccctctccttttgagatatggtttctcattggtctagaactcaaccaattaatctagattggctggctagtaggttccagaatcctcctgtttccacttccgcagcactgggattacaagtgtgcatcactatgtctggcttttttggcaggtcctcattgcttgcaaggccaatacgtacattactgactgaagtatcttcccagattccccctcccccctcccgccccccgctccccaaccccgctttgggggctattgcaactctactacaaggcgatagagaaaagaattgatgaagcccagtctgaccttggattcactatgtagttaccttccaagtactagggttcatggtatatgccagcacacctgatttatgtattcctgggtattcctgggtgttagacctgtcctcacgctcactttgtgcttataaaaacattctaccaactgaactatatccctagtcctgaggaaaagcatttaaaaactcattttgaagcagaatcttactgtgtagccctagtgtctcagaaatcaccatgtagagcaggagggtcttgaattcagcgaagtgtgtcggcctgtgcgtctgtagtgctggaattagaggtgtgtgctaccacatatgactgaacactttttaaatatttgtattccttgagaatttcatacatgtatagaatgtattttgatcatagccaccattcactcccctttctagctcatcctggatctccctccacagtcaccttccaaatccttatccgcttttaaaaaaataacccacggagtccaatgaatgctgctcatatgtgtatgggtgtagggctatccactacagcatgggaacctattgaaggccatctatctgaaaaaaaaaagactctccctatctcaccccctaccccaaagtctactaactcctcaggtagggatgaggcgttgtgagcccctccccaacccatgctggaatggtgactgtcttgatcatgtgcaagtcctacaggcagtcacatctgctgtgagcttatgtgtgcaatggccctgtcatgtccagaagacactgattcatagtagtctttcttaatttctgtctcctacagtctttcagcttcctctttccagtgttccctgaggggtgtgtgtgtgtgtctatgtgtgtggctgagcactccatagtcactttttctctagactttgaccagtgtcggcattaacttgctgtccacagcaaaaagaaaaaattgatgatgatttagaactgcagtaatctataggtataaagaaggcagtgtgatatgtgtatttagcaaaatagtagctttccctgctagggcctatgacctcttcttgactaggttttatagtataaacctgaatttattcccatggagaaggccttagatccaattagcttgagaactgttttgtagtactgtggatcaaatatttatgcaata

SEQ ID NO: 36023 - DNA, 1198 bp, Mus musculus
ccctgcctctatgagggtgctcccccctcacctactcctatcctcccgctctggcattcccctacaatggggcattgaacaccctcaggcctgaaggccactcctccaactgatgtccaacaaggccatcctctaccacatacgtgggcagcaccatgggtccttccatgtgtattctttggttggtggtccagtccccaggagctccaggaggtctagccaattgacattgttgctccctccatggagctacaaacaagtcccttctccaactcctccatcagggacccggagctcagtccagtggttggctgtgagcttcctcctctgtatttgtcaggctctggcagagcctcaaggagacagctcaatacatttttcatctttctacttcaaactcaataacacttccattacccctagcagttaccatcctttctgcctctttgaatttaacaatcacaagtatatcatataagtggaatgtttcttccatttttgttattacacgtttatttctatgtatgtgcacttataagtgctacagcacatgtgttggggattgagggagccttggaaaaatcagttctctccttctaccatataggtcttggaattaaactcggtgtcagggttggtggcaagtaccaccctgggccatctcactcactcttatttgtctttttatgactggcttctttcaccttagcataaaatcgagggtcatccgtgtacagtgcatgtcaggatgcctttccttctaaaggctagataattttccattcatttccccattccattttgttcattcctctactggaacttgaggttttcccatctaattaaaaattttaattatgtttgtttatttgtgggtgtgtgtatacatgcatgtgcatgctattgtgtgtgtatgtaggttagagaacagcttgaagaagttggttctcaggttctagtatgtggcttctggggattgaactcacattggcaggcttggcagcaagcacctttaacctgctaagccatcttaccagcccccattttaaaaaaatgtatgcatgtgtcattatgtgtttgtagggggtgggcagagaacaaccttaggtgtcatccttgggaactccattcctccaccttttaaacatgctcaataaataaatatattcccttgagacttctgcctaacacatgttta

SEQ ID NO: 36024 - DNA, 1222 bp, Mus musculus
tcactgccaggtgactttctgaatggtgggagggggtcatgttttaggttcctcttgatggtaaggaagagcaacatcattttcctccttccattcctcctttcccatgtcatttagtactgccccaagggcagaagcacgcacgcacgcgcgcgcacacacacacacacacacacacacacacacacacacacacacacacacacacacacacacacaccactttctcatttctcctaagcacttttgagctgttgaatggggctcaggagcaagagttgtctgctgccttccccagcttggtcacagggttattgaactgcctgtacttgtttcctgttgaactccagtgttgtccccagaaattgaaataggctagcagctaggtgtagatttcccaaatcttagaggctaaagtagcttcttgaggctggcaaatgtcctacgctgttgtttgggaggtggtggtttgtttgctggggcctgctgtctgtccaagtggtgggatgagaacaagttaactctggtaccagttgtaagttgggactcttggcttagactccctgtcatggaaggatttgtgttttttctataggtccttggggaaaaggattgctgagtctggtgtgaccctggtcagagagatcaggattagattttgacaggggacttggaacccacctcagtgttgaagatccttgagatagattagctctctagctgctgagcccatgctggtagctgagtagcccctttcccacctcgccagtgtcggtgtccttgctgccttttgatttttatcctctgttacagattttttttttaaagatttctcctttcattgtgcacaagtgctgagactctgaggctccatttcttctgtgtatatatcctgacttggggcttttattcagcaaattgttcattcttctgtcagacaatgtcatattcaactctgttcatattaaaccactgtgaagcaagcctccgtttttctccttaagtgtaaatgtattatttcctagtgctgagtacatgctggatattgtgtagaactcatctaacatggccattgtcctggggtgatgagtaagctttgagtttatattacattacagaacagcagaatctagactgcttatagtagtttacctatggtttcttgtaacttacaactgactttgtcacatagataatgcatctccttccagaaagtagccat

SEQ ID NO: 36025 - DNA, 1230 bp, Mus musculus
gatttaccactataatgtacattataacacgactgagagttgtctctgtaagataaattttaagtagcaaaagattttatttgtgcatttgtggggaggaaccaagagccttgagcatgttggtaagtgctctactactgagcagccccagcaagggacttctgatccccaattgtgatatgattgggtatggtgagggttaatattcacctggtagtgtgttttggaagaattttagctatgtagtctataggagcactttttcttttttttgctgggagtcaaaaccaggtgtttatacagactagggaagtctcctcccactgagacatatcctcagtcccataggaactactgcttctgacaggtgatccccacaggttgaacagaacttcttgcctattttcagtttggttatttttttacttttgagatggggtctcaccatgtaggcccagctgatctggaattccctagatggtgtaggttggtcctacactgactgctgatcctcctgactcagcctcctaagtgttaaaattacatgccacagcacttggcttcttttcattcttccttccctgtagacaaacctacccatcttcaagctgaaagaatcctgtgtacggcgacgctatagtgactttgagtggctgaaaaatgagctggagcgagatagtaaggtacagctcatctcctaattagtaccattggaggaggagatctctataggtttgggtgtaagatcacagcctgtaaagatcttgaattggataataagggggaacgcattcttatggactcattcccaatatattggttctggggggggggataccctttgaaacttgaaagagataagtttaggacttattatttataaaattgtgtgtgtgtttgcttgcctgtgtgtgtattatatggtgtgaggtcacacacaggccagaagagcaggttatgtatcctgcctgctctagctctctgcttcataccttttagacagggtttctcactgaatctggagctaggccagcaatctctagtgattctcctgtctctgccttcaactcccagctggacttttgtttgtgtcctggagtccacattcaagttctcatgcgtgtgcagccaatgcttttaccagatgagccctttcctcagccccatgaacaatattttcaactattattttgttttttgtaaagttagtaagcatttataagtgcaaaa

SEQ ID NO: 36026 - DNA, 1130 bp, Mus musculus
aagtgaggcatggctggacagggtgtggacgatggacaaagattagtgaggaatccaagtagactagaacatgattgacaggacgggaggggaggatggaagaaggctgggggatggaaagccaaggcgatgtatcgctgggttctataactaaactaggttatgggaagccattctaaaggggggagggcaggagggctcagcttcttcctaataagatctctctgggatgatggagttaagcaaaacctttagttcaaggcaagagtgagtgaaggaaagggagacagtgggcttatgggagcagtagaaaagcaatttgcagacagaatgctttgctgacttgtgtaagattgacatctgcaagagagaactgttttatgcttaagtttcttaggtaccacaatgtcatgtctcacgtgaaacccggccctgcaccgggattggggattgtcagctgctgctcccatcctctgctaagcctttagatgtgaagtatccacaatggtgacttcaggttttattggcgttcacttagggtttatgggaaaggcagcatttgccttgtcttcccctaatctgtagttactttaatacatgacatttcagaagggctccaggaatggcttcttctagtctgcaccccaggggactttattctcttactccacagtgcttagtccacagtgcaagatatagtacatggttcacaggtattttttttttttttgcccagttgaaatggtacagattaaaaaaatttaagaaccattttttcttttttacttgtgttttcttctcaggttagagatgcaggatattcttttcgaacagtatctcttttgaatagctttgaagatctatgagtcatatgaagttctcatttttttaaaaagatgaattgaattaagaatgtttgttctacctgtgcctgacaatcttatggagcaatggcaccctctcaattgagagggggcagaaagccatcacagcatgaagcacaactgtttttatggaggctagactatttgaaatgttctctttggagaaggatgggatttatcttcttcaaactgatagaagagaggtgatcatggaggaaggcttgactactcaagggaccctaagtc

SEQ ID NO: 36027 - DNA, 1200 bp, Mus musculus
aaacattttaatacgcagtggttatatgggctcacttggctattttcttttttttctttttctttttcttttctttttttctttttttcttttttttcttttttttttttttttttggtgttttgagacagggtttctctgtatagccctggctgtcctggaactcactttgtagaccaggctggcctcgaactcagaaatccgcctgcctctgcctcccgagtgctgggattaaaggtgtgtgccaccacgcccagtgttggctattttcttgaacaatatagctacagagcatttccaccatcacagaaagttccactagaaagcaccgtgaatctaaacagtcaaaatagtcaactcaggaccaagtctctgcatctacatgaagcatgattttgtttttctcacttctgttgtctctttgcaccggtgtgtacaaatgggtaggaaggcaagtaaaacaacttagcagatgaaccctcttatgataaaaagtaagaattcattcgaaaaaaagggcttctgtcatgagtggcatatgcagggcaacttgattgctctaagtgcagaattgacatcaagagatttcggaagcataattttttggtatttgggcagctggtgatcgttggtcccaaagcctgtgtacttgttaaaataaaggcttaaaaaaagaattcattcaggaatggttaaataaaataaggcatattcactaaatggaatataacataaaagtttaagggaacaaactagatatatctatgaaaatagacctcacaagtatctgtatgagggcggaaaaacaaactgataaatgcaatcaatgatgcaaaaagaaagcaatggctatagtttgaacgtgttggaaacatgataacatgatatcggattttatagttttttttttgtttggttggttgggttgttgttgttgttgcttggttttttgagacagggtttctctgtgtagtcctggctgtcctggaactcactctgtagaccaggctagcctcgaactcagaaatccacctgcctctgcctcccaagtgctgggattaaaggcaccaccatgcccggccggattttatagttttaaaagatgagacttctaggaggtgaccaggttgggaggcttttgccttcaaaaatgaactagagccatcatcatgacagtctctttgacattatgggagtggc

SEQ ID NO: 36028 - DNA, 1496 bp, Mus musculus
aggatatattaatgtgcatgtcaacagtaaaagaagaatgaataacaggacccagtacccaaggcactggagttggcagaacctcaagggaagccttactatacatctagggcctacctaccagttggacatataggggacagttgcacataatctcacccagtctatatggcatttatggtttcatgtatgctcttgctgtcctggaactcactatatagtccaggctggcctcaaactcaacagaaattccccctgcctcccaggtattagatttcaaggcccagtgtgggatctattgggggagagaatgctcttgagcctggcaactctgtgtacagtcccttgtctcccacctcactctacctctccttcctggctttgacaggtgatgctcctgttgtgttccagcctctccttagattagactgctgcccaccaccctccgctatacatatctcacgccccttttctactatctctctcccatccagaactccatccgtcacaacctgtccttgcacagcaagttcatcaaggttcacaacgaggccactggcaagagctcttggtggatgctgaaccccgatggcggcaagggtggcaaggcaccccgccgcagggctgcctccatggatagcagcagcaagctgctccggggccgcagcaaaggccccaagaagaagccgtctgtcctgccagctccaccggaaggtgccacgccaaggagccctctgggccactttgccaagtggtcaagcagcccttgtcctcgaaatcgagaagaagctgatgtgtggaccactttccgtccacgaagcagttcaaatgctagcaccgtcagcacccggctgtcgccaatgaggccggagtctgaagtgctagcagaagaggaaatgccagcctcggccagcagctatgcagggggggtccctcccacgctcagtgaagatctagagctactggatgggctcaatctcgcatctccccattccttgctctctaggagcggtctctccggcttctctttgcagcatcctgggcttgctggccccttacatagctatggtgcctccctctttggcccaatagatgggtctttgtcagcaggagaagggtgcttctcaagttcccagtctctagaggctctgctcacctctgatacaccaccacctcctgctgatgtcctcatgacccaggtagatcctatcctgtctcaggctcctacacttctgttactgggaggaatgccttcctctagcaagctgggcacaggagtcagcctgtgtcctacgccgctagagggtcctggtcccagcaacctggtccccaacctttctgtgatggcaccacccccagtcatggcaggcgctcccatccctaaggtcctgggaacccctgtgctcgcatctcctactgaagattccagccatgacagaatgcctcaggatctggatcttgatatgtatatggagaacctggagtgcgacatggat

SEQ ID NO: 36029 - DNA, 1921 bp, Mus musculus
caccccagcatctttgctcttgaatattcaactaattctatgctctgagccagagggagccttacagcagataataggagtccctggggaggtggaaaggtggatgtcatactagaatagcaaaacttctaaatggggacctgtgggctcctcatcacagaagggggagctttgggggagggaagggtgaaggggtgcctctggtatgactctgctgtcccaaatgaatttcttagcttgtcctccatttcttttgttccacagatccctgagtcacagcaagaagctttgtcccctgcttcggaggtggaggtggagccaggcctgtccttatccacttttcctccttgagccctccccaggagtttgggaccctactttagagctaaggattggtggcaacacactcaagtgttgaggaaattataaagataaatctatgacatgtagggattgtagaggagggtgataggaggagggagggaaaagggctttgtctcactgtgccaattagggggtagttatggtcctttctcaggggccaccattgatttcctcattcccacctcctaggcctgtagcaggggccagcaatgctgttgaaatgtgaagtcaccagtggccttattaccctgcctttgggagcaggattattattttttttggtagagagtcttactagagctgggccaggctgggttgagcctggatttttatgcagtggggtgggtgggtggggggggccgggggacctaaaagggccaagttttgagcactggagtggctcaccaggccaaatcacttttggaaggatgcagataacagacaggctttttataaacttttaaagaaatataaacacaaatatagagatttttaacagtggtgaggtgctagtgatggggagaaggcttttttttttctttccgaaggctttgtcatagtgacatgatacaaacactacagactctatggaggagacacaggaagctagggagaggtgggtagcaagagttttaagcaaagaaacctaagtcaggtccccacattctgttcacttgtgcctagaagagagtgctgttgtggggcaagcacactcttatttgaccagtgcaggttagtgctcccagagagagcatccaagtcctgaaattggcttggggcctgggaggggcgtgaaagaaggaaggatttagggtagtaaagttaggtacagagacctcgctgttcaaggcctgggacagctgtccctgcccttcttccctgttgtggtctgccagggttatgtggaaggctgtgtagcagcaagcagggctgtggagaggaacagggaagggagagcctgacgagtttggctgagggtctgggaaatgagcagggttggggggaatgtggatcaggtttactagcacctgccagagaggccatctggggctcctccaccccagcccccaagcagcccctcccccagcgcctttgcattgtcccctcccccactcctgctgtgggttcccatcatttcctgtgtcagcgcctggcctacccagattgtatcatgtgctagattggagtggggaagtgtgtcaaatcaataaatgagttcaataaatgtctataatcagatctggtttctggtttctgctgcctttgctgccccccccctccccgtccaatatggggggagggagggaggcggaaaggcgaagggcagttaggcgaagggctggtgggagggactgcccgcaggctgggaggtgggggaatttcagcctgggaggtaatggagtgtgttgggggagggacacctaaccccagcaggagtaggcggctgcaagataggcctcccccgaggggaggtagtctggtttgagaagaccccacccccttctctggccctcaaaggcttattgtactaaaagtc

SEQ ID NO: 36030 - DNA, 1099 bp, Mus musculus
caatgagaagctcgccttgttcatgtttcaggtaggagcaagggcatgttgtacatggcattgagttgcaccttatcctgtcctgttggaatagaatggaatttgccttttaccttgcccctggtatagctctcttcattcttccatttactttatctgccttacctctaatagttccctgctatccataggatggaatgctggacagacatgagttcctgacttgggtgcttgagtgttttgagaaaatacgccctggagaagatgaattgcttaaattgctgcttcccctactgctgcgagtaagacctaggcccagggagggactatttagagggatttgagtaagaattagacatcagagcagtatcttctggagaaacctagcgggctctgttggtcatatctttacagtactcaggggagtttgttcagtctgcctatctgtcccgccgccttgcctacttctgtacccggagattggctctccagctggatggtgtgagcagccactcatctcatgtcatagctgctcagtcaacaagttctctgcccactaccccagcacctcagcccccaactagcagtacaccctcgactccctttagtgacctgcttatgtgccctcagcatcgtcccctggtttttggcctcagctgtatccttcaggtaagtacttaagggcccaagaaagtataaagaattgactgctcttcctggagaatgggggtgagttcaacttggaggtgggagcaggcaccgagtacctgttcaagaattagtgtttctctgtaataggatgttcccttttagagatttcggacattgtcttccaggactaagtaatatggcccaaagctttttagaaaagtgcatgagaatctgggtatgatagtgtatgcccgtagtcccagaacttggaaagaagaggcaggagggttgtgagttcaaagtcagcttatgctacctagccaaatgaaaccttgtctcgagatacttttttttttttttttaagaaaaggaggaaggtaaggaagatggggatcaggaatgatacctgctccaaggacttagtcataataaacctaattgagatgtc

SEQ ID NO: 36031 - DNA, 1931 bp, Mus musculus
cagcccttcgctgttctccctttatttcgttataaagctgtatttggcaatcctgcagccttatctcagtgtccttgattgtgctctgggagatggctcattgggcctgttttctaatgagtctgggtcatttctccccgctatagacacaggtcctgggaaacgaaagagagaagatgaaactatcttagagcagcgtgagaatcgcatgaatcccctccgctgccccgtcaagttctatgagttctatctctcaaaatggtgagttggtgagtgtgtaagaatgacttaccgtgtggacctaagaggcctgctttgccttggtactactgatgtctgtctccccatccccactcttacagtcctgaaagcctccgaactcgaaatgatgtgttctatctgcaacctgagcgctcctgcattgccgaatcacctctctggtattctgtgattcccatggaccgaagcatgttggagagcatgctcaatcgcattttagctgtgcgtgagatttatgaggaacttggtcgtcctggggaagaagacctagactgagcccatgttgtaccttgtacccatctatcacatcagtgtctgtcctggaaccaatgctatccattctgaagggccctaactggctccttctattctctccttccctgcctttcccaggaacccctgcctttaaccttctttcataccacttgataatcatgggcccccagtgtactcaggggctagtcccccagtgatgggtgtgaacctggtagcccattttgtttatggaaaccctttctgctggggcctgactctgatggagtgatgatagctctggtgatcctgttggctttgcgttttctgacctacatctatgtaggtgaagccctgtggccctaggtgtgacctagggaagaacccagctgccttctctgccctgtatcctctctctctctcctcttcccctgtaccatgtgaaagggtcttgtctgagaggtctgaaagtgaggggaccatttacctaaagcacagagctcagacactcttatccctcctgagagaagtgattgtcgacaccctgcactaccacatccattacctgaccgacccttccagcaccacacagtgctacagtttctcaagggttccagatactttctttttctcaaaggcagagaatgactcagtatggagagcagactcctattgtgcagatgactcctgtccccttggtttatgtgtttgtctctctctgccatcttaaggtggcgtgaaccatggtgtcaacatgcttaacccctctgtaagctgcctccctttagttccatgaacagagctcccaaggtaaaaatgaccttcgcacttagactggggctgggttccccaatgttctaccccttccatcaaagccaggcccacagtatggggtcctaggccatctaggatggggtttgtggtcaaaagataggtgaggagctgtgggccagggtcctacacctactgcctactgtcttctcttccccatcttacctttgtgggcccagaaaggttagtgtctgtcagagggagcacccagttctttccctgttggctttgctgttccccagccttctttttgtgtttttataactgtcctcagtttagccactgttaaaatgtatatattgtactgaggtgcctggcctgttccttcagtgagccatgcccacccttgtgttgtagtgagaaactgttgtcacaactaacttgtctctggaattgtttcaaataaagagttaaaattgttctttgctttctctgggggaggtagagctggcgttgaagagtggaagagaagagaaagagcacccactgtgggtccctgaagattagtcttccctcagtcaatgaatatcacaacgttggtcctcttctcatacattttcagatacatc

SEQ ID NO: 36032 - DNA, 1126 bp, Mus musculus
gcggggaagggctgagagaggacgggctccgcggggaggggcgctggggctggagaggatggggagagactggagacctggggggcttttgggggggagtgagaagggaccaggggctgaggtcgccggagcgggaaaggtttctggctgcggcaggcacgggaaaatgtgagggggcgttgagtctgaggtggggggtgtgtgagaggtagggaggaaggagctacgagtctccgtggggggtgtcgggcgggttagagaccaactgcctggcgagtgtgggcacggggccagggcagggaacgccactccccacagagggcgctgtattggggggggagtggacattgagcctgaagcctgtggaaatgcctatcggctgtggggggcggctgctaatgagaaatccaagtggatgacggacggggtgtgtcccacagccgacataagaaattcaggctaagaccacctctactgccccctcttccgatctgcagcccatacccagccatggaccccagtgatttccccagtccatttgacccattgaccctgccagagaagcccctggctggagaccttccagtagacatggaatttggagaggatctgctggaatctcagactgccccaagtcgaggatgggctcccccaggtccgtctccatcctctggagccctggacctgcttgataccccttctggcctggagaaggaccctggaggagttctggatggagccactgagctactggggctgggggggctactctataaagccccttctcccccagaggtggaccatggtcctgagggaacccttgcatgggattcgggggagcagaccctagagcctggaccagggtgtcaaacccctgaggtgatgccacctgatccaggggctggggctagtcccccttcacctgaggggctactagaacctttggctccagattctccaataatcctggagtctcctcatattgaagaggagataccccccttagctacaaggagaaggggctcccctgggcaggaggaggagcatacccaagggcagccacagagccccaatgcaccccctagcccttcagtgggagagactctgggggatggcatcaacagtt

SEQ ID NO: 36033 - DNA, 1235 bp, Mus musculus
cacccactccccctttttggccctggcattcccctgtactggggcatatatagtttgcaagaccaatgggcctctctttgcagtgatggccaactaggccatcttttgatacatatgcagctagagacacgagctccggggtactggttagttcatattgttgttccacctatagggttgcagttccctttagttccttgggtactttctccagctcctccattgggggccgtgtgacccatccaatagctgactgtgagcatccacttctgtgtttgctaggccccggcatagtctcacaagagacagctatatcagggtcctttcagcaaaatcttgctagtgtatgcaatggtgtcagcgacccacgttttttgagaggcattttgttgatggttgcttggttggtcttttgtcaaattctaattttctttttgttttccccaggaaacacgaaccctagcggaaattgccaaagtggagctggacaacatgcccctccgtgggaagcagctgcgagtgcgctttgcctgtcacagtgcatcccttacagtccgcaaccttcctcagtacgtgtcgaacgaactgctggaagaagccttttctgtgttcggccaggtggagagggctgtagtcattgtggatgaccgaggaaggccctcagggaaaggcattgttgagttctcagggaagccagctgctcggaaagctctggacagatgcagtgaaggctccttcttgctgactacgtaagtaattttcagacaatggtttggggtcccttattctttctttggcatggaacattaacatctaataaccatgttcttattttcatttaaaaatttagtgctaactcagcttttctaatgtagttttcactatagtcctaaatacttaggtattcaagtgcatgtatatgccatggtgtacattggggagtcgggacacctttgggaagttggctttgtccttccacctttacatgtcttccaggaccaagctcagggtatctagcttgcatgtgtctgtatccatcatggtatagtacgaggatagctttttaggctggaaaagtacttcagtggttaagagcactggctgctcttggcagagaacctgagttggattcccatcactcacatgttggctcatctgtaatttcagttctaggggatctgatgccagcctaaataggcaccgggtgtggaagtggtacattgatatacatctgg

SEQ ID NO: 36034 - DNA, 1117 bp, Mus musculus
gccaatgtcaggtgtcgggagcatacttgttagggtatggcctcattaacactaactttcttctatcacccagatttcctcggcctgtgactgtggagcctatggaccagttagatgatgaagagggacttccagagaaactggttataaaaaaccagcaattccacaagtgtgtggtccagtagttgacttttatacatttctggggaggggtgggatgtgtgtttatatatgtggtgttggtagttgaacccagacccttaacatatttgtcttacacttcatcccgtagttatttttctgttcttgaaacttgaaggggtggttaaaagaggcatgtctttgctgtatacctgtgtttgcttggcctttaaaagagagtgattctatggaatcttggacaaaagtattatcatacataatgtgtattgtctatagggagagagaacagccacccagatttgcacaacctggctcctttgagtatgagtatgccatgcgctggaaggcactcattgagatggagaagcaacagcaggatcaagtggatcggaacatcaaggaggctcgtgagaagctggagatggagatggaggctgcacgtcatgagcaccaggttatgctaatgaggcagggtgagtagaggcctgtaagtagggaaagtggaatacatatcaaataccagttttgttcagtaatttctttatttcttagtagaaaaagacaaagtctctgtttttattccctgaaatactttgtttatcctagtagggagatgaatttggagatgggtatagaatactagaagagtcaatgaagaaagaaatggttaagtttgagtttacttgcatgatccttctgggattatatattgtcttagttaagggttctgttgctgtgataatacacgaagcatggccaaaagcagtttaaggagaaaaaggtttattttatcttaaaatttaggtcactgagagacgctaaggcaggaactaatgttgattagattgttacccagggcttgtccatccccccctttgtttatttttggatgttgatgtttttgggggtttgtttgtggcttggtttccttggtttctctgtgtggccctagcta

SEQ ID NO: 36035 - DNA, 1448 bp, Mus musculus
atataacagatgtgaatccaagggccttgtgcttcataaagtcctgaagttgttctggttgtaatgtcaaaatggaatgggccaaaactggatagatgtaaggttcctaaagaacaatagtctgtttttcctggctcatgaaaaagaaattggctagaacctatgcaacctcgaaatgtcagttgtatgtaaaatgtggatagaaagctaaataaagatggatggatgactgactggagccgtaactagtaaagcctgcctttcctctcagggttctccattagagctctaaacagacttggttgcctgtctcctaacagtcaggaggagacttgagtagttaagtagaaatggcctgtagtgggaagaaaccttagatgagctagaacctgcagagatagattctactgtaacattgttctctttctcttttttaagaccccaccaacaactgaacgttttggccaagctgcaacaatggaaggaattggagcaattggtggaactcctcctgcattcaaccgtccagctccgggagctgaatttgctccaaataaacgccgccgatattagataaagttgcattgtctagtttcctgcagcccttaaaagaagggccctttttggactagccagaattctaccctggaaaagtgttaggggttcttcccaatagataggccttccctgcttgtactactctagggagcatgcttgaaggcagaggggcaagggaggggtggtattcaacaagtcaaagtctgtggtatattgctttatcaagactgtctggtgcattcctgaactatattgattgttgagggcctggagaaccatgggaaaatgaactcagagctccattaatcttgatcattccttctctctctttctctctctcttgttttaattactttctcatctttattcccctcaacccctgagacactgccatatataccacaaaccataaacatcctccaatgacctagccccatccctccattcactcccaggtaagaattcagacaaatgtccacagaggttacagcatacgtacggttgtgttatatctcatatatgaccccttcatgtcctaaggaagacattttctcttagaggttttcattttagtatatcttaaaagaatcttgtgttaccttgcctccatctttttcttgggtaaggactacactttgtgtctctgatgttgctgttcacagcttttcttgataggcctagtacaatcttgggaacagggttgctgtgtggtgaaggtctgacagtagctcttagtcttgcctatcttaggtagctacgctgtgcatttttattggtatactatgaattgttccagataccttcagtttggaaagttttctgagaaatggagacgtcatgcagcatcaccttattaaaatacatttgaagccttttcattttctgtgctg

SEQ ID NO: 36036 - DNA, 1297 bp, Mus musculus
ggctacatgtgccagcactcattttacatggtgctgggactccaacccaggatcttgtgcatgcaaggcaggcattctttcaaacaagctatatctctaacaaatacatggtcttttgaaagtcctttcattcatgacatgcgttttgttttggtttgtttgtttttcaagacagggattctctgtgtagccctggctctcctggaactcacttgtagaccacactggcctcgagcacagagatccacctggggcaagattttccttacccaattacattaaaatattagtacagcagagggcctgtgattggacagagaaatgggaggcggagcaaagagttgcaagaacggagagcgactaagaggaggaaaagctaagatggaggcagacggacaggaagaagatcccgatcccgcgtggttttaaatagccacaggtagttatgaatatcatatagggatagaataattgggaaaacttgtatgatctaggtgggcagcttgtatcattatcaattggctctgaaattattgtgtggacctcttgtgaattgagattttttttttgatacataaatctaacctgttaattataagcctctagagttttgtttctattgggttgctggggcttgtggccgctggccgtggggtggacggtcgtttcgtggggctggtttggcggcaaagggaactccggagccatgcatgcagagtagttggatggaacgaaggaatttggcagttcttttttcgtttttggtttttttcgagacagtttctctgtgtaactctggctgtcctggaactcactctgtagaccaggctggccttgaactcagaaatccgcctgcctatgcccccaagtgctgggattaaaggcatgtgccaccactgcttggaggcagttcatttttaatatttcctgcaacatctacctatccctgcttcctgagtgctaggattaaaggctcgtgccaccatcattcagcggctctcttgaatggtgaatattgcactatgcagatgtctcgttatttgctttctgacttctcaaatgatggacattttggttttcactatttttgggagacaggatctcattctgcagctcaaattctaggttatgtgtgagccaccatgtccagtttgggttttcaattttgttataaactgtaatatgagatccaagacatctagggctacacagagaaactggtcttgaacaaccaacccaaacaccaatatggcaatttctgcacgaggttttctgtgaacacgggtttctgttattt

SEQ ID NO: 36037 - DNA, 1185 bp, Mus musculus
attgctttacttgctaatatagtttaatagcaatattgatcatcataatttttaaatgatttacttatttttattttgtgtgcattggagttttgcctgcatgtttgtctctgtgagggtgtcaaatcccgggaactggagttatagttgtaagctaccatgtgggtgctaggaattgaacctgggtcctctggaaaagccaccagtgttgttaactgctgagccatccctccagccccccaccataattatttagctagtcccttagtaagtaggctgtttaaatttgaactattataaacagtattacaatgaacattttgttagcagtggtttctgtcaaagagagatatacgtgatatctagtaggtttcgtttaaatagttacatgagtacctgcactaatattttttttctgtttgctaggatcataactgaaaggacaattaatgttttgtttgttactgttttctcttcttgtttggtcaggttttacagctacattggatgatgataaaccttggtactccattttccccattgataatgaagatctggtatatggacgttgggaggacaatatcatttgggatgctcagaacatgcctagaattttggagcctcctgttttgacacttgatcccaatgatgagaacttgattttgggtatgttgatggcaggagccaatgctccttatctttgacatcttattattaatggcaaaggtcaagaggatataaaaatgttagagaaggcaaaagctagaaacttttaggtgatgcttttttaaaagcagagttgtagctgccagtttttagtgtttgaatattgtttaggaaaaactcatgtagggatatttaaaattgtatcttcaagacatcattagacatggcttgggcagtagtggtaaacaccttgggagacagaggcaggcagatccctgagttcaaggtcaacctggtctatagagttctaggacagccaggactacatagaaactcttgaaacaaagaaacaaaagacatcagatatagtctagctggagagaattgccaactaaaagtagtctggaagtgaagtgagacatctacttagaaactccaaaattatcagtggaaaggtgaattttagctggacctagtagcatggatcccagctacttaggaggccaaagcaagaagact

SEQ ID NO: 36038 - DNA, 1191 bp, Mus musculus
tcacccagccccgtttttttcttttttgcggggagggagggtcctcatgcaatcaggctggcctcagatttactgtgtagtcaaggctggtcttgaatcctaaccttcctgttcctcctaacaaggactgggattacagaatatgccactatgtccagctttgactcaatttttttgagagatagtttctttccatagctcaggctagcctggaactactgtagcctaggacggccttgatcctcctgcctcagcctcttgaatgctgggattagaagtatatactgctattcctggctctatttttaaagtttttcttccttttgtctattaggttctaaaagacagtgggtaaaaaaaactaaaaaaaaaaatcttgtgtgatattccatattttactcatcttattatatagactttagagctaataaatataggtaaaattaagtttttttcccttttttaatagttggctgaattttctaaagattctctgtaaataacttttgtggtttactttcattaggcatttgagaacaacctttttcgtgctccaatttatcttcataagatgccagaatctgacttcctgatcattcgaacaaggcagggttactttattcgagaattagtggatatttttgttgttggccagcagtgtcccttatttgaagttcctggtcctaactccaaaagggccaatacacacatccgagattttcttcaggtaagatgggagtgtgggagttgggctaagatgcacatgctaatagaacgatgaaaacacatctgagcttagttggagaaggcaccttggtaagagcttttatcctttatgtaataaaatgtatttggcttattggacaggtttttatttaccggctcttttggaagagtaaagataggccacggaggatacggatggaagatataaagaaagcctttccttcacattcagaaagcagcatccggaagaggctaaagctctgtgccgacttcaaacgtacaggtcctcagtgtgacttcttgtcttctctgatgctcttgtactcctaaagaattatgacagtcagttaaaagaaattataactaatagaatagaaattgatggttgtaagagaaggtaccaaaccttgtaactagagactttgataatttgatgataattggttgctagtatagtccaagtga

SEQ ID NO: 36039 - DNA, 1238 bp, Mus musculus
agatcctacaggctgtggtgaagggttctcctatgtgaagattccaaacaaaccgacacaacagaaggtgagagtctagaaatcaaaatggaaggactgagggttgagcagtcgatgaatagagtggagggcctggacgtgcttcatttaccacaatgtcatagatgcttactgttaggaggtcagcttcagatttttatttgtttctgtttgagacaggatgataaagagcctcagccagtgaaaaagacagtcacaggaacagatgcagaccttcgtcgcctgtctctgaaaaatgccaagcagcttcttcgtaaatttggtgtgcctgaggaggaggtaggtttagaagaggaaaactcctggtaagaggttttgtatgcagagagaaaaggtaggaagctagaaagaatcgtctggagcttcatatgctgtagaggctttaccaaaacttgtgaaacttcttttaggctttgattttttttttttttcggtttctaatcatggccctgttttgtcctttaacatccctgaatgagttacatatgtgtagttctgtgtttctttcagattaaaaagttgtcccgctgggaagttattgatgtggtacgtacaatgtcaacagaacaggctcgctctggagaggggcccatgagtaaatttgctcgtggatcaaggttttcagtggctgagcatcaagaacgttacaaagaggaatgtcagcgcatctttgacctacagaacaagtatgttatattcattcagtactgtttaaagtttaagctagaatatggacgtttcctagacatgctatattttgaactaataatgcttttgtacatgcaaatcactaactctatctcccgctctcagatactatttttctattttggaatgagatagccctgctgatctcgaacttgctatgtggggtatgttggcctcaaacttttgataattctatatctatctcctatgttctgggccataggtatccatgctctaccagatatttcgaaagaagaggatgttactttaaaaaagtgtaactaggttgttgggtatctgaaatatcaggcactgtctgtaataatactgccagagtacctattcctggtttttgtgtgtgtgtgtttttgtttgtttgtttgttggttggttggttggttttttttcgagacagggtttctctgtgtagccctgaattcactctagaccaggctggccttgaactcaga

SEQ ID NO: 36040 - DNA, 1528 bp, Mus musculus
tttagtagtaagtaaaatagtaattatttctctagattgtagagtagcaagttcttttccctaaccactaccaaaaggagagagcagactcactcttcctcattacactcctttaatggcatttattgctcttgttgtataaacatgccaccattttactttctaattggcagactggaacaaaggaaaacccctctgctggattagagaattaggtcctgatgagctggctctgtgccacacttaaaatataatcctgttagacaaactggttgttcatatattacttacttggatagacaatgccttgttgctaaatagattacagggatgtagctataaatctctgaatgataggtggtcatgtaaatgtcctcttcccccaccctggaaaaaattataggaaaatggttagtaccttagggcaaagactgccttttggttttttttatacttaggatatggttttatgcaaagtaactactcagtagatgttcttaaaaatcacagaatcccaacagataatgttactgtgtgcctgattcatgtagagcactctatcagacctttgcagtgcaaaggttaaataagagcttgccatcaagttggggcagtgagactggaattcaaacaatgttaattaatcagagaactctaagtacaattaagaagctagctgtaaggtacaaaggaaaaaaattagaatcatgtgtggaaaagcagagttttctagaggctacctgaatgctgattgttgagaagttatagagtaccatctcagcagggtgttaacatgaagggaaagttcacagtctagatgtgacagaatgtgttccttgtttgtacctgccttgtttcagaaaaaggatgctggagtgactagacatgacactgaaagacggacaggaagcatatcttcaagagctttgcatttgagctaggcatggtggcacatgcctttaatcccagcacttgagagacagaggcaggcagatttctgagttcgaggccagcctggtctacagagtgagttccaggacagccggggctacacagagaaaccctgtctcaaaaaacaaaacagaaaaacaaagaaattttcagaatgttgaatgaagatagaaattgagtcaagtaataaacatgtatgattcagtttgtctagaagtcaaaaattgggtatatatgatatgcttgtatatacttgtatgtgcaaaggaaaagatatgaaagaatgtacattaaagtgttagcagtgatagcctctgagggatgggaatggagaggaggtggtttgtttggtttatgtacagtaggtaagtgttatgcttttatttctgtatcttagttttataatgtgtattattttttgtaataaaatgttaatttaacagcaatagaatcgagagtgattttaagtagtccaagctaaggaggtggaatctaaagttcaatggtgccattggaatgaagggaaggggaatggcattaaggcatcttcagaaaggggtgtgatcaataggacttc

SEQ ID NO: 36041 - DNA, 1138 bp, Mus musculus
ttaattaaacttttctagacgctctgacattctaacatcgacatcactgaccaggtagtagactcgtactttagcgcttgccaaaaaaaaaaaaaaaaaaaaaaaaaaaaaaagtaatcgacgggcgttttttgcccttccgccttgctcttaaaaacttgctggctcttgccccatagggagcccttaacccggagttgcctagacagggttgtcgcatgcgctctctacagtcatgtttgtcgcaatggaccttgggcggaaggttacgtaagagcaaatgactttgattacagtcacttggtcggtagtcttgttacgcgctacctccgcggggtacttgattataacagaaagtagttccggcttgtgttgtttcggtcgaggagccctcgccgccatttcaagacagtgagaggtagatgtctaccaagagttcctaagattcgagttcagtattctgtgccgccccctgagcccttcaaaacactgatacggctgctgccttttttctgctacttctagaaccattcttgtcagtagtggcggcagtagaagtcaattaccccttgttctatctcaagaagctccagatggcgtcttccgtgggcaacgtggccgacagtacaggtactagtgtcccattctactctggcagacgtccctttggggtctggcgccgtcttgtatctttcattacttccctctgaccatccccattacatcagtggcattactgagctctcgagttctactgctatctgatcgggtttggtgctgccgtccgttcgtaaacattctctagttgcttgcttgcattttgcttgctttgggggctttttcgttgttgctttatcccatcagtgttgtagccttctctctcgggacgaatctatagcacacgtgcgcgcttagtgtgtcttggaatgggctgcattggaatctctgcaatttctgtctcccgtcgcaactgttttctccctcaatttcagcccgtcgctccctcccgtgcgcttccacctcctccccaaagcccctttcccttagccacatttggtcctcctttgccaggctagggcggggatgctatttcggtgtaatcctagcctcactttgcatcaggcatgactagcgaagg

SEQ ID NO: 36042 - DNA, 1108 bp, Mus musculus
aagctaaatttgtcacatctttatctaatagagacttgtttgttatctatgtaaaagaagtgtttctaggaatctttaaaatatttgaaaagctttcagtgttttagttaaatttgcatttactattctagaggattatctttctagggccttagcccagcattctaccattgagctactactccccagcgccagaacatcagttgcttattttgtaaaagtgtctcagagagccccaggctgcctacaaacttactgtgtagctgatggtgacctgaactactgcatgctcctacttagacctcccagctgcttgaattacaggtttttgccatacttggcttaatgttccaactctaattacatatcttactgaggacttgctgagctgtgtgtatggagtagaggaacatacatacttaagagctcactgcttgtttctaccactatcttttagaagagttaaattaactgaagacaatagggccaagcattagaaatacttatatggtagcgcaagcctttaatagtagcacttgggaggtagaggcaggtctgaactcaggatctctgcaagagcagtcagtgttttggttttgtttgtttttattttgttttgttttttgttgttttttttttttttttttttttttttccgagacagggtttctctgtgtagctctggctgtcttggaagtcactctgtagaccaggttggcctcgaactcagaaattcacttgcctctgcctcccaagtgctgggattaaaggcgtgtgccaccaccaaccagccaatcagtgctcttaactgctgagccatctctccagccccacaaactgagttttattctagaaacaaaatgtaattggatatttaaaattacttcagaataaaagctgaatgagaagttaatgtgataaaatcctatctttttctaactgactgtcttctaattttaggctgtcacccttgacccaaattttctggatgcttatatcaatttaggaaatgtcttgaaagaggcacgcatttttgacaggtaagaatgttatgtttgatcaatttccttgtctttctagtttggactaaaatgtggcaatagcttcc

SEQ ID NO: 36043 - DNA, 1088 bp, Mus musculus
tgtcgcagcttatcttcgtgccttaagtttgagcccaaatcatgcggtggtgcacggcaacctggcttgtgtgtactacgagcaaggcctaatagacctggccattgatacctacaggagagctatcgaactgcaaccccatttccccgatgcttactgcaacctagcaaatgctctcaaagagaagggcagtgtaaggattttgccttatttttacttccttgttatgtggtagaaaagaagagtcttcattcatattacatacatattaagtattgagatgtacatattaagtactgagatggttatattgatttcctttggagtgttgtttgctgggcaggaggatactggaaagtgtctgttttctggtgtgttcccaaccattagactcaatgatgcacctacttgaattactagaataacagtggtctctttgattcttctgtgtagtttctgaatggtttgtttcattttccaggttgctgaagcagaagattgttataacacagctcttcgtctgtgtcctactcatgcagactctttgaataaccttgccaacatcaaacgggaacagggcaacattgaagaggcagttcgcctgtatcgcaaagcattagaagtatgttcagtgccgtggctggagggtttagcctagcctgtgtgacaatagagggaaagcagttgtttgcctgccattcacctctgggttgatttttattttatttttacttttggttttagttttggattttgaggcaggggttttctgtgtagccctggctgtcctcgaactcaactgtgtaggtcaggctggcctcaaacccagagagtcctaagtgttggggttaataaaggtgtgcccaaccactgctcagctgccattcacctctttaagaggatcattcattattgatgtaaggtcctgtggacatgtaagacacccctatattgagctcattatgcataggtgagatctgcacaaagattgaccagtaagctaagtaaagctagtgcagtgaagaactcaggcctgtgtctagtggttagtaggtgtggaggttgataaaagtggcattactcagcat

SEQ ID NO: 36044 - DNA, 2490 bp, Mus musculus
tgttgcagacggatgatatataatgataatagaatagcacattcagacttacttcctgcatgatagggagagacaagaaagaagaaatgctattccacaaggaatctcttagagttttgcagcaaacaggtggtgcacaggtctggaaggtctggtctcccttggtcttccatgggatgcttaatgtggaggggagatagagattaaccagccgttttgtgatgccgtggattgatcaagtcttctgatccttttttttttctttatattttgggttttggagcttttaaaaatgtttgctttcaggtatttttactcatgtgaagtgatcttgattcttctgaggttttaaactaaaatgttgcttcctgttttagtgtctgaactctgacagggtgacagggaccttgctggtgtagtctttttataggttttataaaccacatgagcctatatcagtcattttagtgtctgacctaatgcttggcactgtcagtgctttgtttagatgatgacttaagacttttcagcctgttttacacaccccagctcccgttaaattctcctgtgactgctaacaaacccatgtctgctttcagacatcccagggtgtttctctcgaacatgccatctggtgccaaatgaaaattcttaggagtgaatattaatcatgaaggtcacagttgtggtactgttattgataataatatagggtttttttctgcctaagttttacctgtttcaccagtgtttcagcccttgactgcccctcctatgctgcttccaaaagtaatagtgtgataagatttttaccttcctttctaaagtttgttttttttttaaagtgagtcctgttcttcccatttctttcagcagaaatgaaatcccaggtaagtatataagtattcaaatgtttggttagtaaattacagttctctccagtaccttaaatggtgttcaccgctctgaagaagcatctctatacaggcagttattttatttttagactgtgttagaatgtctggacttagcttcaaactctatggattcggccttggtagggaattgtaccaccacttggtttggactacaaattaaacattggccctcgcggagcttgagttcttcatggtagaaaacagttgcatttccgtaaagggtggagggcttgaggcttaaatatatgagtatgtttatactgctctactgcacttagactctccactcacagataagtcttgtctgttagtagtgctgtagattaagtctttccaaagcacctaggcagtgcacctattctgtagttgcagctattgcctgaatgtaccttagctgacaaattattgataattaagaacttgaatttgtgattcttactgctaattaaaacctaagcaagaagtctcatgtaattctgatagcagaattgcattgtgtgaactgtgtaactttagtaatgtaaatcaaggaacatcagttaagagatttcctaatttattttttaactgaataaatatcagttaaaagattgccagcatggttacaggtaaactgattttcagaattcactgaactactaaatgtgggattggataatagacttggagtgccgctgaggctgagatctgtggccatttacatagcacatcattcctcctatagggatgaactttttttccgacacaaaaagtagccactgcggttaaagctttgcttattgtaacaggcttttatttccaggtaacctatctgtggaagacctaattctgaatagagtaatagatattactggaaactgatttgttttttttttcctattatactctgctttattgaaaaagtaaagcatttaaaattgtgctccagaaattcagatgttgtcttgcgatctttaaacaataaaatggatgatttccccttaacatggcttggtgtagtttgtctcattatattgaaacctattcttgaattgctcaaaacagtccaaccagaagtgtttccttaagttgatactaggaattaacattattttctttgtgatgggagggttggaggtggtaaataatccactaaggagaaacagagtcccattctgaggattatgcatatccagcaagtatattaatatggagctggaactccagcctatgtagtacattctttatatggacttggtttttttttaggtatttgcagacagaactgttttctattgtgtacaaactcagccacaactttggcttccagctttttcagaaacataaaagggaaatatttggaactggagagattgcatagcagttggtagcactgggtgcacttccggaggccccaggttcggttcccaacatctacttggcaaactattccagatccaggggatctgacacctcttttggcctccttgggtatgcacatggtgaacaggtgtacatataggtaaagtacttataaaattaaaattaacatggtgcatatacacacattcag

SEQ ID NO: 36045 - DNA, 1186 bp, Mus musculus
ccattgtggacaagaccaggctgctcccctcagcaatctgcagccctgggtggcattatagacaagcaagcaggcaataacagataggatgctgccttcccagaagaggaagaaagtgaggctgtgggagggagggaggaggggtgcccatcacataaagaacaggaagtggggtatcagcaagagatgtggtatctgggattggatctggaggaggaagaggggatgagtgaagggatgtagagataagagagccaggcagagagtagaccacttaccaagagccagcatgtaaagagaccacagaagtgggccatgctgacacgcatacctgtgatcccagctcttgggaggctaaggcaggagaatcagaaatttgaggctattttgacatacggagttcaaggccagccttgtgaggctgtgtgagggatagaaaggtgggaggaaggaggctgtgccttggaaaaccgcacagagccaagccattcagtaggtatggctatgctgtgaggcaagactgagaagtggacaagggctcctgggaagtgcctgtctgagtttaatttccagcgtgctgaagagccaggaagcagctctaagcaagagagtgataagacgtgctgggcagtctttttggcttagcctggcaatggcaaggagaccagtttgtaagggacccgcacaagtggccatcctggtcatgccagggatatcatagtggcttagttcagggtggtagaaccaaggaagtggcttatgttttgggagaagctaaagcacttcctgatggaattcaggtggggaaagaatggagggaggagctaaatcatgtccactggacctcagcttgctgttgaggacccaggggtttcagatctgagatctggggaagggatgtgcatgtactttgtcatgcacccagcaccactgaagtgctttgtgggtatgtcacactcattataactgcttctgttaatgcagtctttctgatgggaaaaaggaggcacaggaagattaaataactaccgggaccctggctttgtgctgtattccttcttaagctctgtcattgacagtcataacaaactttatgaggttgtgatgccattcacacaatgcctctttcctgtgagctctgtgagaatacgggacacagtctttgactttgcgtcgcagaaagcct

SEQ ID NO: 36046 - DNA, 1163 bp, Mus musculus
cctggtctataaagcaagttccaagacagctaaggcaacacagagaaaccctgtatcaaaagaacaaaaaccaaaacaaacaaacacccaccttacagggatgtggtcttgtaaagtatcaaatactgaacagtgtaaagcagtgtttctcattctataggtcttgattcctttgggtttcaaatgacccttacacatgagtcaaatatcagagatctcctgaatagcagatatttacataatgattcagaacagtagcaaaattacaactacgaagtagcaacaaaaatagtgaaactgtattaaagggtcacagcattaggaagatgaagaacctctgatacagccttaccatgtatgtatgtgatatatatatatatatatatatatatacatatattcttttctatatctatatagaaagagagaaaaagaaagaaagggaggaaggaaggaaggaaggaaggaaggaaggaaggaaggaaggaagaaagaaagaaagaaagaaagaaagaaagaaagaaagaaagaaagaaagaaagaaagaaaatggtacttttatgttggatatgttttaaatgtgtggcctgaagatgtgtgtgctggaaacctgggcctcagtgtggccatgctgaggtaatagaagcgagacctggaggaagatatttataggtccctgggaatgtgccattacaggagactaccatagttctcttgcgatccccccaattagatcccacgagagcaaactgttataagatcaagtctgaccttcacatctttcagacttcctgtctcaccacatggtctaaccttctctctcatgaggccttcggccatgctgtgatgttgctaaagaagccctcccccaaggcctaacagatgagactgtaagttaaataaactgtcttttttttaaaaatcagtatctgcactttggtaccaaaaccagactaatacggctactgtttcccactgtgcctctttattgaccctgaagctattctgggcccaatgctgctagtggtttcagatggtgggctctttgtctcctgtggtcactgtgagcattactgaagtttgactgagtaagtgaagctttagtcttgaggggaaaggaatctggaatatgttacggtggggtttttttcttcctttccgga

SEQ ID NO: 36047 - DNA, 1176 bp, Mus musculus
caatggaccaacagagtcaacattctccacttcctggaagggagatgctttcacatacatgaccccaagtgccagcagccagggcaatcaagtcagtgaaaatggaaaaaacccttcctcgggcaattcttgggtccctctgaacacactcccacctctggttcctaaggaggcggccacgctctttgtcacccgtgataacccagcaggatgcactgggctacccagctactctgagcaccccactctacgaagacagataccagaaagacctcccaagattggccttcttgcccgtggtacctcaaggctggaaacaggcccaggtgggaccaacaggttccgggagcggtcactgtctgtacccacagactcgggtgttacctcagtggactatgacgaagaacagaagaccagtgagacccgcatcctgccttatgccagtacaagctccgagggcagtaacagtactgacaacattgcagccctcagcactgagcaggaggcacggcacagaaggcaaagatccaaaagtatttcactcaagaaggccaaaaagaagccctctccacccatgcgaagtgtctcactcgtcaaagatgagccagccctcccaccagaaggcgaattggtactgcccaaggaccagaggcctaggagcctttgcctctccttggaacaccaagggcaccacccacctcacccagatgctcaaggtcacccagctgtgccaatgctcaaagatccaggaagtacgcagttctctcaccactggtatcttactgactggaagtctggtgacacctaccagtccttgtccagctccagcactgccaccggcaccacggtcattgagtgcactcaagttcagggaagctcagagtctctggcctccccttccacctccagagcgacaacaccctcccagctctccattgaggtggaagccagggaagtagcctctcctgggaggcccactggactgatgtccccttccagtggttactccagccagtcagagacacccacacccactgtctccatgtccttgaccctgggccacttacctcctccaagtgctagtgtcagagtacgtccagtggtaccagaaaggaagtcatcactgcccccaacatcaccaatggagaaaatctgcaagtcacggttatcatttga

SEQ ID NO: 36048 - DNA, 1102 bp, Mus musculus
atccgactcaaacaggtcccatcccccgccccccactgggtgaggataattgctttaccgtgctctcagtatcttgagttttttaattatgtatttataacaaggggggctggggaatatatagctcagtgccagagagcttacctagtgtctgcaaggtcctgagttccgtccccagcgctattgttttaaataagtaaataaacaagaaaacacgctcagaccacctgttgtaatgaaaagcatacacgagaacagggatctggactggtcttcaccatgtgggcattgaatggcctgagggtaaattattaaccttcagatctccatgttcctcctcgacaaatggagccatcaaagcctctgtcctgctgtccatccagagttgctttgaacatcaagggaaataatgaaattgtatgtgctttgtcctggctatcatggtcaaagtcattccttttggttcttatgcctagggaggtcagtggaaccgagtgctgaagagaaaagtttaatcagtgataaaacagccgaatggattgcagaggaggaggatgacgtgtttgtggcttcccgcacaactgaagatttatttactgtgatacacaggtcaggatcattttccttcattgtaattgtaattgctttccccttctctacttaaagaaaaactgctgcctctgagcagccattagaattgcaagtgaacattaagtccaggtacctacatttgtgagcagtctggggcctcacatctcaaattcactgatgtctttgagtgaaggggaggaggggaggaccaggtgctgagagaggcccctcgtctcctagcaactgcttggcctattgtgtctccatctgctccctcacagctctgtctgcagtcagagatgtttaacccttcacagaattccttgtaccacagaattctatctcagggtgacatggagccctgggctgaatatgagagcagggacgtaggcagagagggatcaggggtgggcacaggggcatgacacaggggttcgtgagcccagttactggtgtggcacaccagttttcaaaccagtttcaaaaccctctggctgccttaattcattca

SEQ ID NO: 36049 - DNA, 1480 bp, Mus musculus
tggggcagagacttcacagtcagagaaaagacttaggcctgggaatgtccattcagtgtttgcaggagtggacctagtcctaaagaaaccagactattggggaaaagatttaccactcattgatcagcacaccaccaagcatctttctaatacttaaccttctcttattcaactctcttccctgggtacaatgtatgctgccggtgaggatgggggaaagttgaggagaaactcttttcagggaggttctctgggaagttgcttccagagtgatctctataggtagaatagacagtaagttggagggaactcaaattggccccaggtagtcagcctctgcttcaagctatttgtattcccctgtttccctccagcttcaatctttagtggtaggtggctctgttagagtgaatatagacaaaggttggcaagacgcccccccccatccccaccccaagatgcaattaatgctttgtacttggtgggtattgatttgtggttcaaatgtgagtggtggagagcaggctagtcttagtacaaaggctgactttgcttgtggctcctcccctttgcctgtactcctggcctgcatgggcctccaacttgtcctccagtcctaacacccgtgaactgcactggtaccaacagctcagccacaaaggagtcaaggccatgggcagccaatccattcctgttagcttcatgaccccaaggttaaggttctgccaacaagcattctgcctgacatctactttatctagacaacccagatccagttgtctccgtaccttgtcactctgagcagatctacccatgcacctgtccacccccctcctcctcacctttgaaccagtcaggaaaaaaaaaaaaaaagactagttatctatcaatcactcagtgctctgttgctcactgctccgccctctatgttagccaagtctgtggcacaatggtgagcttttcctttgctatgatttgccagggccaggactagggtgaggcgattggggagacgcccactctcaaggcccccgccagtgccttacccttgccttggccctgcgatttgcactctgtaaagttgtatcggttactcttcctgagtgtagttgtgatttggggggcaggttctgcaccaaatgtttctttgctgtttctccatttgttgccagaagcctttgtatgcctaagcattagagaatcttaagtattatcacaagcatgtctaaatggcctgctccagctggcaaatgagcaccccggtcaggaggaacactatggcctgagcccttcaacagtcagttgggggtctgcccctgtgaccttctgtctgttctttctgcttcattctcccttgtagtccttgtggcccagcaccgattctcctcagtgcctcctactttgttctcctcctaagaagaaaacatgctctcaggaaagggatggattcgtttgctttgagaccgggaggcttaatgct

SEQ ID NO: 36050 - DNA, 1225 bp, Mus musculus
gggaccaacctccctcttttcatagaggaaattaaggcccagaagagtcaagtggctcactgaaggtcacacaatgagtctgaggcagggcccagcatcaattctaggtccctggtctctgggatgaatgtcttgtcatttaaagcactatatttatgaaggacccatgactggcttctacttgtctgacattaatttcccgggtatttcagtgaaaaaaaattctatatgctttaagggaacatgcgcaagcgttctttagtttatgaatccaaagaaaatctggtttttagtttagaaatgcatctccctccatgtttgctatctgtgccctacttcgtacaggggatgtttttcctaagagctatgtagaaaaatggatttatatagaataaatttcatttttagtaggaaagcttccctatgtaagggaatcttctaggggattcttttggaaaaacaaaacttttcttgtcatttgttctttaaggtctttaattctttattagtgtgaatttttgtacttgctgtttagttaaagtagggcaaagcagtgttagctttcccagaatttactagaaccttaccttcctcatctttttgtgaaatcttcagactgtggcatgcttatgaactactcaattatgttctagaaacttcacctcgcttgatattttaccaatccctgggctcaaaattcctccttgatctgatcagatactaacagagctccctaatcagtactcatctctacatgtggtctcttttccagaacattctttgccagtattccttagtgtgctcttcctttagccatctcaggcctccttccataaatcacacatacctcactgtcctatggaccagcaggcactataccttgagggttatgctatgatgctgaggaatatttcctgttacttccatgttctcattccccttggatcttctctggcttccaggctcaatgaacttatctcaccagagactgatggtttggtttttttttgggggggggttggttttgttgttgttgttactgttgttgtttgttttttccattgtttcaggaaatcaataaacttttttctacaaagggcctgggagtaactattttaggtttttgtgggtcacgtatgatttctggaacagattctttttttgtgtctatagttgtttgttcattcacttgtttttacaaccttaggaacataagaaaaccatt

SEQ ID NO: 36051 - DNA, 1791 bp, Mus musculus
gatgaagaatcagaagtgattagtgtgaaaaccaaaagcaaaactagaaggatcctctcagatgatgaagatgaagatgaagaagatgcttttaaaggtagtcatacaaattcaattaacatctctccctttccattctcatctgtgaaacaatttgatgcttcaactccccaaagtggcagcaatccatctcgaaggttcttttcacctaaaacaccaggtgaagtgaatacgtccttacattctaggaggtccctggcttctaggaggtctctgatcaatgtggttttagatgatgtggaagatatggaggaaaggcttgataacagcagcgaggaggagagtgagccagggctttcagaagagaacaatgaagaagaagccttagcctgcacagaagagcagccttctggggcaacactggcttcaggaaacaagtccagcaacttgaccatgtctgagcctacttctccagccccacaaagctctccctgtgctcctgaaccttcgtcaagtgaccctatgcctgatcctccccaggatctggcagtggaggctggtaatgactatgagagtcttgtagctcgtgggaaagaactgaaagagtgcgggaagatacaggaggctctcaactgcttagttaaagcacttgatataaaaagtgcagatcctgaggtcatgctcatgactttaagtttgtataagcagctgaacatttgagaactttatagcctatttcttatgtctaaaatgcaattgaatataaatgttttgttcagcagttcttcccttgaatatttcattttttcccctttaggcatactttgcaaactttcagaagtgttacctaaagttttgtgaagctgttctggctatttttactgtgaaaagggccattttgtctgttagctcagttctgaaaattaaagtgccttttctccagagtgtttccattcattttctttcacaaggtggtagacagaaactctttagttccaataagctcgtcatttagcattccaaatctaagatagccttaataatgtgccgtttgtgcttccagcttagctgcatacagtacctgtactagcattcttgggcacttgtagcctgccctggagttgctctaccaactggttagctattcttcacttactctggactatgcttttcttcaacccagttatgtggtgtgtgtgtgtgtgtggggggggtgttcttcagttttttgagacaaagttttacatagctctggctggcctggaactcagggagatagctccacctgcctctgcctccctggagctgggattaaggatgtataacactatgtcccacttatactggtgtttggatgctatcacatcctctcttttgattgttgactacataagaatccgattcaccttcagaaacaccaagtgcagcatatgctgtcaccaaagatttagtgtttacaatgtgcctactggatattgagtatatcacacaggcctcttgtttaatccttaccataacctttgaggtggagggtggtgtttttgtgtttgaactgaaacatctaagactcactgtgacctgcccatgatgaatgacatagtaaggcataaaactgacttaactttgtactgaatgaaaagcaactttgtaacactgagttcattttactttcatcaccatgacacccagtgtggtggtggaagtccataccagaacacttctctggacaccaaccagtgacctgcaattcagtttggacacaacccagagttagtgggagactacaagttt

SEQ ID NO: 36052 - DNA, 1105 bp, Mus musculus
aaagacgacagtgctgagcatctttggagttaatagaaccaatgagccatagcagtttgattcatgagcagtgctagtaatggaataaatcttactagcttgtgggtatttttcttagaaataaatgatcatgtggtgttaagtatgaagggtactgttgtccatatatagaatagccacagcaaccacagctggtgatatatatacactgtggtatgagtctcaggaccacctgcccagcagccaccatgactttggatctaagaaataaagtgacaattgtgtcctgtgccatcctgctaatggggttttcttcattctttttctagggtaacaaaccatggatctctcttcccagaggaaaaggaatccgcctcaccattgctgaagagagagacaagaggcttgcggccaaacagagcagtgggtgaaatggtctctaggagacatgctggaaaagtgtttgtacaagcctttctaggcaacatacatgctagattaaacagcatggtgaaactacttttggtttgctgttgcttttttttttttttctcaaacataatttgttgatgttttttggacataaatactcgggttcatttagatcatgtagtgcctagcaagtcctaggtgtttctaatgaatttgacttctatcactgggcttatgctctttgtaagtggactgagtgcttagtcctggctggtgtagaacctgggagtgagtcttctgcatttagaatgctattataggttgagctaccatacctagcctcttttgccttttagcaaaagacagccttattattcccaactggttgtcacatacccaccaccccctcccaaacaaacccatgtagagtgaatatacaaagtcttgaacgtataccaaaaaaaaagtgtctcccccaacccacccctaatgcactggtatgaagctgggtggcctgtctcaagaagtggtaggttttgttcatcacttggcctgctctgaaattttatcagtctctcccaagagttattgccttgatttgtttgtctctgggggcctccttctggcttgatttgtaaaatcttaagcatgtgtcagcagtgaggctgacaaa

SEQ ID NO: 36053 - DNA, 1241 bp, Mus musculus
tcaatattgcccacattttgttaattgggaaagttcgaaagtcagttcattgaaggatttacgccgtaggctttgctggaaagacctgaaacaatgtaacaacgttactttgaaaacttcttccaggctcgtggtcccaagaaacacctgaagcgtgtagctgctccaaaacattggatgctggataagttgactggcgtgtttgtaagtattgtggtgtgaaaggtagacatacctttaacaagcatatttgtggagttgaatgtagagaatctttggctgtcttaaagacctgtgtcctacctcaattttgatacatctgtttcatctactccatgtattccatagtacactgatggtggatacatagactcaggtctcaaagtagcaggcctcattctttggaggagaaaatgttgaggaatcttctagcgaccccccccccatgtaaaataacccaagttttggtgtagtaattttcctaaaactttccaggctcctcgtccatccactggtcctcacaagctgagggaatgcctgcctctcatcattttcctaaggaacagacttaagtatgccctgactggagatgaagtaaaaaagatttgcatgcagcgattcattaagattgatgggaaagtcaggaccgatataacctaccctgctgggtttatgggtgagtaatcaggatcggtagtggccacaggcccttaactcccaatagtggcaggtgactgggaaagtgccaggctttcctggtcttcgtcttcacccctaccctggcacggtaatatggagaggtttggctactgggcttttattcctttttaaattttgaatttcttgctactctcccatacagacctactggatcagaatctctgttgggctgttacttaaatattgtggggatagcttctgaaacccaaattcccatttaaagtttatgtggagtcttgataaaatgggctcacacacacacatcccccagctcagttaggagtgtagtgagggttgctgtggtaaccttattctttgatatcagatgtcatcagcattgacaagaccggagagaacttccgtctgatctatgacaccaagggtcgctttgctgttcatcgtattacaccggaggaggccaaggttggtgtggcaagcgggctgggtagtttcctctaaaattagtttctaagttagatcatggaagtgagagatgagtcaacagatttcattagaattgt

SEQ ID NO: 36054 - DNA, 1160 bp, Mus musculus
tccacagtccctgtctcagttttaggaaggtgacatcgggtttgtcagagtggattattggagaggctgttaatctctttcagacagtgatgaaaagtagcgaactaaagttgcagcacgaaatttactctgtaaacatttcaaacaatcctcagccttagcaccattagctaatgtagctgggtggtggtcttgcctgctattgaatgtatagtttacctctatttaaatatttaaatgatatttgcagtttgaaaacttaaaagagttcagactcttagcgccaaaacttgaaaccacgtttttttagtgtttagctgtgtttctttctgttaccatactcctttaaaactacatctcccagcatgctttggagctggtctgacctcatttcaaatggccccgtagggcaacaaggctggttacttttgaccgtgctacttgtgccatgaaaaaattgatcccaattggcagttatttggtttttatatctgtcaggcaccttttttgaactgtggtcatcagtagaaggcatctggtctggaagggcccatccatccctgtagttggacgagggaccagggaaactgtctccggcgatctaaataggagggaatgttgacaagggagcaccgctggggctgaacagaggagcaggaactggagctcaggctgagtctgaaaactgttggctccagactttggctcgcggacggttggaagtgggagatggagatgccagaggaacccgccaacagtgggcattcactacccccggtttatatttacagtcccgagtatgtcagcatctgcgactcccttgtgaaggtccccaaacgggtaagagaggtctggatcaaagaccacggtttgcggggatgggggtgggagggtgtgaaagggagtacattaggaaacgagaaaactggactgaaggataccttcagcaaaaatgtaactagcagtgccaggcacgccaagccgagcagaaggaagtggttcattaccttcagagagcgcagtggggcatccaacgctcgagtgggggcggggggcgggggaggggaaggattggcgcagaggtgagcggagttaccaatagggggtcctggaccacaaactgttaggagagagtattccatcacttgcgttagtaaagc

SEQ ID NO: 36055 - DNA, 2767 bp, Mus musculus
gtgctggggaggaagctcagaggcacactaattagagtttgactcagtaggatcagtaattttccctttcactctgttttcccacccttttaaaccaaatagaaaaccctcggcgcagatgataccatgttggcaaaggatcctgcatctggcatctgtactctcctgtatgacagtgcacccagtggcagatttggcaccatgacctacctctccaaggcagctgccacctacgtgcaggagtttctgccacacagcctctgtgccatgcagtgagggctgtgggttctgcctgttagaacacttcagtagctagcccgtctggttgattgtgcatggaactgacatgttaacacctgatcactcccccaggcccttttcctgccccatccctcctaggaagagagaactttgctgacgatctcactacttttgaagaaaagaagccctatctggagacttgactccagagcgaagccctatctggagacttgactccagagcgaaggttcaactgcgcctgcagtcactatccctacttttgtggttcatagaagtctgcatgtgcgttgattctgtagagctgttagtggcttagtttttaaactcctattggggagtaggtattaataacttattcctgtaagttggttttcttatttgttggtttttacgtgtgtatatgagtggtgggtattgattaggccatcatttcaagagagtagatgctaagttggatttcgtgctgctgtaaattggaactgtcgactctaagtgcctttacttaggaaaagccagtaccacatcatggcttccttcttcactcaaaggctgctttgctctgagtggggaaagagtgggtgttttgtagaagcattgcctttcattgttctttctatatctgtccacaatgcctactgtctctgtggtgaaatattaaaatatgtaagctcacatggaagtttaagaatttctgtgttaatacttggaataacccagagaaaagaagccagaagcctaattccagagaggaagggaaagaagttctgtaggtagtgctttacacatagggggccgagagaacatcagaggcaggtaggttgcttgtggacagccttagacaccaaatccttgcctctggagtgtagccacacacaacacagagagtaactgaagcctatcttaagcaaagagaaaccacccgtccactctggggctgccctactgaatgcccctttccaggaccttggtattccttctcattcagtccccagcacatccggctacccctagctctctccacattcattcctcaagtctctcatttacatggtttgactttttaattctagtacttacaacctttaatcttggtaactgtggccaaatatctattgttatacatatctctgaatgtgcttgtaagtggttaaataatttgtaagcatttttgatctgtctgtctgtctctacatggatggactgaataagaatgtaaataatatttattgcaaagcaagcctggtcatacttgctgcttgagaagctgaggcaggaggatcatgaattcaaagccagcctgggatacatagcaagtttcagggcagtgtgggtatgaggttgtgtctcaaaaacatttgaaagcatgttgtgcatgtgtgagagagtggcgtggctggtctcaggctgacactcgaagggtagtagaaatatcccttctggcctattgtctgcttcgctgtgtaggtagcctgacttgacagaggtttctcctggttttccttgtttctacccagagaatttcctactcccctttccctccaaatgttaagggttttctcccagaacagtaatggggctaaaggggcagtgagctccaaacagtcacagagtgaggagtcttctgagctccctggctaagtgcagcgtgctagcagacaggcaggggatgcaaacggctgccgggccacctctcccctctcacaaaccatataaacacagggaggggctttctcaccacttctgaggagactgtacagcccgttttgtgcctgtgtgtgtgttcatggcctgtaagtgtaccccaagcactgtgggcgggagctaccacttctttgagaacctctgctttacggttgacactgatgcttatctttctctggagttacggatttgcctgtggatttaatgctcacaccatgctatttaatttttaaagtaacttttcagaaaatattactggcgttttgttcattttaagactgttaacatgaagaaaagtgtgctagaactttttaaaaacacataatgtcttgaagttagaataaacactaagaaatgactatgtctggtgttactgcacaaaagcttatctggtttgtgactgaagctaattcatgattatttcacataacgttttgctatacagtatactcaactgggtcaaataagactaacatttatatactgtacattatcatacatcatatatcatatataaaaaagccacaggtttagtgctatctttagacagactgctcactaaaaacataagatgggtgcttactctatttcaactctatataagtggtatttctaaactattagaaaactaaatagtttgctctcctaagtattctcaatatttcacatattgtttaaaatattcattggcttgaacttggtggtagaagcacatgcctttaatcctaggacttgggaggcagaggcaggtggctctctgtgagtttgaggccagcctggtcta

SEQ ID NO: 36056 - DNA, 1146 bp, Mus musculus
tgtgtatggaatttttccctgaatgtatacctgcaccatattcattcatggtgctcatgaggccataaagagatgttggcattatggatggttgttagctacccaatcctctagaagaatagacagtgctcttaaccactgattatgtttctagcatctctctccctctctctctctcttttttttaacctagatgctagcaaccaacagaactgtgtgcatcccacagatgttagagtctttatctatgaacagcagctctgcaatcaggatggggaaacactgaaacaggattaagaaaagagatgctataccaagcaaactacttgtttaagagtctggctatttaatagagtttggcttattctttccgatatcttttgtttccacatcaatcatttggaaccaaagtttcactttaaaaccaaggtatttagtaacaaaccctattttgctacttttctcttagtctatcctgaattcactactgcccagggcttcaacatccaaagaagttgatgccagtctgctctcagtggtctctttcccagcctttgctgtagaggacagccatttggtggagctcaccaaacaggagatcatcaccaagcttcaggtatggccatgtgtgactttcttctctttagggctgtgacttgaaagggagattctaggggccatgagtgtaaacttatgccaggaacctcccctcttcctaggttacactctcataagtattttttttgtttgtttgtttgtttttacaaattgtcaaaagcttctgcagtcgttacaattgtaagtggtatatccacttaggaaaacagttggtatattcttaggaatttaaacatatatgtaacatgtgatccaacaaacatcctatctatgtactgaggttatccagatcttgatttttaaataatagtcttgataaatggttgatttgaggatcaaactagggatgatacaaaggatcctgaagcatctgaaaattttagaaggtaaaaacttcaaaaggatttgggtgtggctaggcttggtgggacaagcctttaatcccagcatctgagaggcagcatctgttaattcaacagcagcctgcagagtgagttcctggacagccaggacaacacagagagtcag

SEQ ID NO: 36057 - DNA, 1199 bp, Mus musculus
tttcaatgggttccagaggccaaacttctactatgtaatgtcacggccaatgtggcaactcatgaaacagatccagagccatggcttcccgccggaggtggaggagcaggatgatggcactctgcccatgtcttgtgccaggagagcgggatgggccgtcaccctgcagcctgtgcttctgctaggatcaatgtgtagatgccattcttgtagctcttgcctgcaagtttagcttgaattaaggcatttggggggaccatttaacttactgctagtttgggatgtctttgtgagagtagggttggcaccaatgcagtatggaaggctaggagatggggggtcacacttactgtgttcctatggaaacttttaatatttgtattacatggatttttattcacttttcagacatgatactaacgtgtgcccctcagctgctgagcaagcatttgtagcttgtacattggcagaatgggccagaagcttatgttgtgacccattgtgaaaataaagtatcttgaaataactgggcatcggggaatgtttgcaagtatccttaaagaaggcaccaacatctgcacaggctgctgtgtcatggagagacccactgcctgtggatctgaaggttgagctagccccgcatagcacagaggagaggtggatggcacaaggctgtgccctctctgtacaacatcagtctgcttagctcatcccaagtgtgcagttggctgagaattttggtgcccagagtctgttggtgaggaatgtcatctgcctagtgaccagttggcatggccacttcctagggaggtcatctgaagttctttgaaccttcctgcagaaaccctgactgttccctcaacccttgactccatttgcatcaccacctagtaacagttggaagtatcatacagcatcggcagtcaacttcctgtaataaattcaacaacagcaaaaaaaaaaaaaaaaaaaaaaagaatcccccttccactttcatgtcacagatatgctattaccttctttatcctctccttgaatattctttttccccctctaacgggctcttttctaattttcttatctctgcctacactcatgtgtgcatgtgtgtgtgcaagtgcgtgtgcaagtgtgagtgtgtgtgtgggtgtgtgtgtgtgtgtgtgtgtgttaaaaggatccaattatgagattaacct

SEQ ID NO: 36058 - DNA, 1187 bp, Mus musculus
ctatttctttttctttcctctcctctctccctctttctctctccctctttctctccagggtccccagtcaggggctgccccttttccaccctccctcccccccgctgtgtaggtcaggcatgttcacctggggcccagtggaaaagtgtccagcagctctgcctgagtcctcctgcccagagcacaggagctctggctggacgtttggccccttttccttccccttcttccccagggcctccctagggcgccccccttattttgttccaaacaatcctactctagcaactaaacaacacacctgaaagccctagaacaaaaagaagcacacccagtaggagtagatggcaggaaattgtcaaattcagggttgaaatcaacaaaatagaaacaaagagaacaatacaaagaatctgcaaaaccaaaagttggttctttgagaaaatcaacaagacagataaacccctagcaaaactaactaaagggcacagagacagtatccaaattaataaaatcagaaatgaaaagggaaacataacagaaacagaaaattcaggactctaagtgagggaccttagatgaaatgcccaatagtggggggagtgaacttgtagagttcacccccagtgaaaaggcctcagggagtggggaggcctggtggggtggtagaggggtagggacatacccttggagacagggggaggaggaattggatgaggaactgtgggagggcagagtgggaggagggttaccactgtactgtaaaaaataaaagtaataaaaagaaaggcccaaacaaaacaaatgaacaaattttaaataaaataaaaataattcttgtcttcaacatcataaaaaagatatcaaatattattttcgtgtatttatttgctatttttatgtacacacttgaaaagttgtttcctcccacgtccaatttatgtggctatttataaattggaatatttgttctttgggtttgtaataattttagttctttgtatagtctggatactaattcctcttagatgagtttctggcaagaattttctttccttctgtaggctgtctcttcgcactggtaattggttcctttcctgagcagcagaagcctaacttgataagaatcgcaattgtggactactgctagtattttcacagatgtaggtatcatattcagaaattca

SEQ ID NO: 36059 - DNA, 1638 bp, Mus musculus
acatgcagctcagctacagatccttatggaattcctcaaggttgcaaggagaaataagagagaggacatccggtacagtgatgaatagaagtggtgatagctgggcatcctagtcttgatgctgatctcaaagtgaaatcattcgacgtgtcaccattagcaattggagcagatccagaaggaactaagtgttttggaagaggatattaaaagagtggaagaaatgagtggcctctactctcctgtcagtgaagatagcacagtgcctcaatttgaagctccttctccatcacacagtagcattattgattctacagaatatagccaacctccaggtttcagtgggacctctcagacaaagaaacagccttggtataacagcacattagcatcaagacgaaagcgactcactgctcattttgaagacttagagcagtgttatttttctacaaggatgtctcgtatctcagatgacagtagaactgcaagccagttagatgaatttcaagaatgcttgtccaagtttactcgatacaactcagtaagaccgttggccacattgtcttatgctagtgatctctataatggttccagcatagtttctagtattgagtttgaccgggattgtgactattttgcaattgctggagttacaaagaagattaaagtctatgagtatggcacagtcatccaggatgcagtggatattcattaccctgagaatgaaatgacctgcaattccaaaatcagctgtatcagttggagtagttaccataagaacctgctagccagcagtgattatgaaggcactgttatactatgggatggattcacaggacagaggtcaaaggtctatcaggagcatgaaaaaaggtgttggagtgttgactttaatctgatggatcctaaacttctggcttcaggttctgatgatgcaaaagtgaagctgtggtctaccaatttagacaattctgtggcgagcattgaggcaaaggctaacgtgtgctgtgtgaagttcagcccctcctccaggtaccatctggctttcggctgtgcagatcactgtgtccactactacgaccttcgtaacactaaacagccaataatggtattcaagggacaccgaaaagcagtgtcttatgccaagtttgtgagtggtgaagaaattgtctcagcctcaacagacagccaactaaagctgtggaatgtgggaaaaccatactgtctacgttccttcaagggtcatattaatgaaaaaaactttgtaggccttgcttccaatggagattatatagcgtgtggaagtgagaacaactccctctacctgtattataaaggactttctaaaactttgctaacttttaagtttgataccgttaagagtgtattagacaaagatcggaaagaagatgacacaaatgaatttgtcagtgctgtgtgttggcgggcactatcagacggggagtccaatgtgctgattgctgctaacagccagggtacaattaaggtgctagaattggtataaagagtttcctgaagtcaaactgagtttgatcctcccaaaagccatctgcagctgatgatgagaagaaaaagaaatggcatgtaatgtctctcccaacatcatttggatttgtt

SEQ ID NO: 36060 - DNA, 1138 bp, Mus musculus
accctcctctctttcccagagcctcaggttataaccaaagggatagactaaagacaatccagtaccttgcccatttttttcattccttgtcactgtttccatatagctcttttgaaattatgaacatatagtatcagttgaaaacggaatgaatgatactgcatttctgcaaaattccacaggctatagggtggaagatgagccataggtggaggaatcagccatattagagaatctgggaaggcaagaggtgttgaaattttgattcatctactaatttactggctcaggatttgtcaatcactgcagcctggcaaatgagattagagaagagtcctgggagggaaggggtgacgcagcaacctgcatacacttaaaaaaaaagagctgagagacaactgcgtaatcatactgcggcaccagttcctccatccctccgcccccgagtggctggagcagctgcttgcggaggtctgcccactgcggctctctgcagtctctagcctgttccttcagggcctagagtctccgcccagacagccggtttcaattctgctatcccagcttcagcaccgtcttttatccccactgcttgctgcctgccatcagtgcagccgccgccgcctcttggttcatctctgccagatcatcgcgcatctgctgtattggtgagtcttcctgcggaggtcaggtctcctgatctgcgggcttagccaccataagtgcaggcgatcgtttgaaaacaatggctgaatcagtcgaccataaagaactgtctgaatccaaccaagaagagcttggcagccaggtaatggcggaggggcccggggaaagtcaggaccgcagtgaaggtgtctccattgagcctggagatggcgggcaacatggtgaagaaaccgtggctgctggagtaggggaagagggaaaaggtgaagaagctgctgcagggtctggggaagatgctgggaagtgcggaggcactgatgaggactcagactcagaccgtccaaaaggacttatcggttatcttttagataccgatttcgttgaaagtctcccagtgaaagttaagtgccgagtgctagctcttaaaaagcttcaaacaagagctgcccatttggaatccaaattcctgagg

SEQ ID NO: 36061 - DNA, 2230 bp, Mus musculus
tggctgataattattggacagaaaatgttgctgatttagaaaaataccagaatcttttgaggaccatgtcagaaaaacctcagaatcaatatacaactaaggccagcttaccaccaaatttatatttacctgaaggagaggtaccctggggactctctacttcaggtgcaactgttaaaaaaacagacctgcccatgaaatgtctacaaccaaatgaaacatctaatatgtctccttttgaaagtagagggattcccaaaccaagtggtgtaattaagctctggaattccccttttggctacaatgttgtaagttctcaagatcaagcagttactgattcagtaagagctcagaattatcctgtaactgatgccagtcaactccagattctaccagtggacagcattggtatgccctcgactcctaaatttacctatgaatctttacctactgattttgaggctaaaacccatcaaaatccaaattagcacgatatagtaccaccacaaggccagtcttcatcatttaaggccatttcacaacctgtagttgaaattaaaccccaactgaaagctgaatctgagagaactagacacccagacttgaaatgtcatttgtccttatggaaaattatataaacacttatgtcttttcaaaaaaattaaaataaaaacaaattgaaaagcaaattattaattagatcttgttccctattttgtaagttttaagaggattttttttttgaggcttaagaaccattttattagagtttaaaagaaacatagcagggcaggcaacctgaaaatccaggccgattccagaagaaatatggagaaagccacgccttcttgggttagatatgaagtttagtaatggaggctcctaagcagcctcatggcagaagcagaagagggggatacaaataaagcaagagagcccagtacatcaatggggggtggggagggagcccagacattggcaagtattcaaaagatggggaaaagaaacagatgcgttttggaacttaggactccaggaagtgagcagaccacaaggtggaggccccacaggtgactagagccaagacagagtttcggccaaggaaaatacattctctcattaaggagataattgttcctcccatctctttagtatattttaggtcaatcagtgctcctgaggtatggtcctttggccaaataattgacagatctagctggagtaacactcttttcttctttcaatcccttgggtagattctctggggagtgagcaggaaaacgggcagggtagtgctgcttaagccccactcagtcgtcctccagcaggttgatcttggtggggtcaaaatagttggactccatgatggggaggccactggcctcttggtgtttcaccagcatcgcagcttcccggcgggcccactcgatcatcttatagtttggcacataagccacaaaggtagtgccaaggaccagggcgatggaaaaaccaaagaagaagactgcgtgcatattcaaggcatccaccttcgggtagtcgtcgtaaccatgtggaagtctgggttcttcaagtacacgttttcgtccttgggtcctccatccactgcacggtcggttcttcctgctccttttgggccgcagcggactgggcgaccacagccctggaggagctggatttccagcaaagtggggcagcctggagccgtcgaattgcggaaaggctgcgagcgcacaaacttaaccgccaggccgccatgacagctgcagtggtggggcaagaggattctttttacaggtggatcaatttaatggtttgaaagcttttcatgttgaaaattattccaagttaattgaagaatcacacagtttaaaactaccaccaggagcttgagagatggctcagcagttaagagctcttggcagctcttccagaggttccaagttcaattctcagccaccacatggtgactcataacagtctgtaatgagatctgatgccctcttctggcatgcagctgtacatgcagatagagcacttcacatacataaaaaaaatcttaaaaaattcataaaaaagttagctgtgctacatttttcctaagttgtaaaatttttgaaaaactgttgttcaacataatcagaatattaacatagatacaactcatccgttttatttataatttttatgtttgtactcatttgtatatatattttgcaattttcaatgc

SEQ ID NO: 36062 - DNA, 1197 bp, Mus musculus
ttattatccaggactgttttagctgttctgggtttttttgtgtttccaaatgaagctgagaattattcttgcaagatctgtgaagaattgtgttggagctttgatggaaagtacattgaatttatacattgcttttggtaagatgaccattttcactatattaatcctacctatgcatgagcgtgggaaatctttccatcttctgatatcttctctcatttatttcttcaatgtcttaaagtttttattatacaagtctttcacttgcttggttagaattatctcaaattatttttcttttgaagctattgtgaaaggcattgtttccctggtttccttctcaatctctctgccatttgtatataggaaggctactgatttttttttttttttcagagaccgggtttctctgtgtagccctggctgccctgaaactcactctgtagagcaggctggccttgaactcagaaatccacctgcctctgcctcccaagtgctgggattaaaggtgtgcaccaccacagcccagcaggctactggtttttatttttagatttgtatcctgatactttgctgaaagtgtttatcagctgtagaagtttttcttcatggagtttggggtctttagtatgtaaaatagtatcatcagcaaataaagatactttgacttcatcctttccaatttgtatcctcttgatctccttcagaatctttctctagctaagattccaagtagtatattagatatatagagagtggacagctttgtcatgtttctgattttagtgggaatgctttgagtttctttccatttaatttgacgttgactataggcttgctgtaaattgtctttgttatgtttatgtgtgtatcctttgtaaccctagtctttccaggatttttaccatgaaggcatgttgaattttgtcaaaggccttttctgcttttaatgaaatgaccatgtgtttttttgtgtttcagcctgtttatgtggtggattacatttatcaatttatgtatgttaagccatctctagatatctctgatgaggctgacttagtcataagggaaattaagttctctttcatattgaatctttatgtggtttgggtatcagggtagctgtgctctcataaaagaaataggcaatgttccttatgtttctatattgctgaataatttgagtagatttgatgt

SEQ ID NO: 36063 - DNA, 1157 bp, Mus musculus
gctatgtcaattgcacaatgcattaatcctagaaaatactataccgccatctagtggtcacctggttcagaataaaggaaccaacacagcttcagactatatctccttaaactcctaggtcacaagcttttcccagggctatgcctaatctgaaaagtgaagcaccattggaagaaagaatgtccctctctcacctgtgagggaaggccagcctccattcaaggacttggtcaaacatgaaaaagataaaatgcccttaactttgttcctggactatgaggagcttagtgagtcaagaaacctttatctctttgaggactggtgaggccacaggaaaagctcttgtattcactacttctgtggataagccttcattgtatctgggatactgtcagtgtatctgggaccacaattacattccttattgacatgggagagactattttttcctggatgatcttctcgtatttgactacccagtctctaggcatccttactgttactaatggcaagccctagcaagcttacttaacattgatcttaagctgtatgataaacaccatctttccacttattcctttctgagcctacctttgtcctccatcttactgttctattgttctgcagtgacaccatgacaaggtaacctctaagagaaaacatttaattggggctgccttacagttttagagggctagttcacgatcatcctgggaagcggacagatatggcagtggaacagtagctgagagctttataccctgattatcaggaagtgggtaaaagagactgagactggtgtactgtgggattctgagacctcaaagcccaccttcaattatgtacctctttcaataaggtcacacctactccaggaacagacctcctaatcctttaaaaacagttctattaataactaaggaccaaacattcaaacatacagacctatgggacattctcaggtaatatttatccttctcaggtctctgatggggttgaatatagttatagtctcacatataaattatgttgtttaggatttaagaaaatggtttaaggtctaaaaagatgtttgtagtttgatatgttaaagttatgatagaaaatgatttaggtatagaactttgaactcaccaagatagaataggtagtagagt

SEQ ID NO: 36064 - DNA, 1225 bp, Mus musculus
ggtgatggtgtctcttcacagcaataaaaccctaagacaagtgttaattccagtttagaagtcagccactgtgtctcttccatcacggccacttcgtgggaaacactaagagacaaatctaatgaagagaactctttaatgcaataattgaagttttattcagcaagtgctggaactcttgtgtagcaagctaaactgtacaccagagccttgtaatacagaggagatgcctagaaagttcacatgaaagatctgtgagaataactgtgctgttatttcctcccaacagtatatgccacttctcatgcatcaaacgtactctttgttgggagtagagatcagaggtcacgtttggatgaagtcaaggtcccattctcactggtggctaaaccagatttcactctctaactcagtctaggagggaactataatcccattgcgttctgttttgtaagacttcctagcaatatcccgtgggttaaagctgggtgttctgtctgacaatcatatctaatcccatgagtctgatccctgggacctggtatttagaagatgttatgttacaattttgagaagctattttccagaaagaagaggtattataagtggaaaataaacagactttgcctctgcactcaggagagttggagcatctgcccatggatatctcagattccatccaaaataagatatttaagcccagaccttgttggcttaaatgcagtttctcttccaagtagtggtggaggaatattcctggaaaatccattctgcatttcttacccatttctctaaccctgaaatttacttccttaggcctttctcctcttcctgaaataataggctgactttttgttttattccagctagggaggcctttccttcctttcctttccttcctcccttccttccttccttccttccttccttccttccttccttccttccttccttccttccttccttccttccttcctccctccctccctctctccctccctccctccctccctccctccctccctcccccttccttccttccttccttccttccttccttccttccttccttccttcctttctttcttttctataagatattttcttcaattacatttcaaatgctatcccgaaactcccctatactctccccctaccctgatcctcaacccacccactcccacttcctggccctagcagtcccctgtactggggaatatgatct

SEQ ID NO: 36065 - DNA, 1227 bp, Mus musculus
gtgtaacagaagatatgataagcagttagctgaaggtgggagtgctctgtgcaagtaatcaagcaaatagtttaacaaaatctaagatatccagttatctggaggatggtggtttagcagaagccaaggtcagtagttacctggagctttgcaaaagcaagcagtttagcagaagctaagataagctaacttgggaatcttgtccttgggttcttagaatagagttagctattttacacagggcttctcatcaaagagattaaattctggtcaaacctaaaatgttctcaggaagaatataggatctaggaacctttgcaatgtcttacctttaaagaaagcagactggctttctctggtggtttctctggtactaattatgaagaattaaaaggtgtggccttgatagagtgggtgtgggcctgttggaagaagtttgtcatgggtgtgtgtttgttgaggggggagctttgaggtttcaaatgcttaagccaggtccagtgtcactctttcttcctgtatgtgagtatactgcagctgtcttcagacattaggacctggggaggtggctcagtgattaaaagcactgtctgctcttccagaggtcctcggttcaattctaagcaaccacatggtggctcataactatctataatagaatgtgatgccctcttttaatatgtctgaatacagctacagtatactcatatacattaaaaaaataaatcttttaaaaaaatcattgaaaaaaggagaactcttatttatactcccttgcttaggatcttttctccctaaccaccattttgtagcatttgcaatctcacagtggtggggcaatccctagaacaggagcagccttttttttttttttaaaggagccagatcttgtttcccagagaagtctgagttctactggttcctcttcagtaactcctttcagaggctgacacctaactgctgtagggatgggagtgataactactctctggatatgtactgttacgaggaggtgctgttttacggtatatcttagggtttcactcttctgaagagacaccataaccaaggcaactcttacaaggacaccatttaattggggctggtttacaggttcagagattcggtctattatcatcaaggtgggaacatggcagcatccaggcaggcatggtacaggaggagctgggagttctacatcttcatctgaaggctgctagacaaata

SEQ ID NO: 36066 - DNA, 1139 bp, Mus musculus
cgcttggccacttggagaagggagctgcttcaaaaaaggtgtctagatggagcctatactctactcagaacagaggcagactcaggcctaactagatccctgcacaggagcagatcagagttcaagaaacccaaaccttggtctgcggggggggggggggggggtggggggggtgttagcctaacaaattgtacaaaactgccacctggtggcctgaagtggtcttaccagtactggaattaaagagagacattaaaaaatcttgggatgtgtgtgcgtgcgctcgtgcacacgtgtgggtgaatgatgcatgcacatgcaaacaaatatggatgtcaagtgccttactctatcactatctatattattttacaaagcagactctccttgaatgtggggctcaccaattggcttagactggctagccaagcaagctcttgcgatttcctgtctttacctccagtgctgggattacatatgtgcgttgctatttttagcttaaaaatattttatgtgtattggtgttttgccttcatgcgtgagtgtcggattccttggaactggagactggagttgcagacagttggtgagcggccatgtgcgtgtggaaaaccaccatgttttgatcccaggtcccccggaagaacaccgctgagtcatggcttcagcccctagtcttgagtcaggtcctcatgcttctgcagcaagcactttacccactgagtcatcttacaagctctttggatgattttaaaaattaactaatttattaactaattaactaagtaattaactttacatcctgattgcagcttcctctccctcctcacctctcctcccctactcctcagaaaaggggaggtctctctttgtatgatttttatatgcagattcatgtctcatatcttggagccatgtttatgggtgagcagaatagcagataccaataaagtttataagacactgagtgatagatgcactgtggactgaaacacattgagcccttatatgaacgggtccatcagtgctcttgcctcatggagtacccgcgaggtctcttttcttttcctagatcacatttccaactgcccttttcttctcttttgaatctggaaattccacgtggtatctggctgtta

SEQ ID NO: 36067 - DNA, 1167 bp, Mus musculus
gggctaaggctcctaagataaaggcttctagaagcaacaaccctgctattttagttttattttattctatttcttcctcctgccttcatgttgttttggatatttgagacagggattctctgtgtagccctggctatcctggatcttgctctgtagaccaggctggcctcgaacttagagatccatctgtctctcatcctaagtgctgggattaaaggtataagcaccactgcccggctagttcctattgatgacctttattataagaaacatcccaccaacagcaataagatagatgattttttttctttttcttttctttggatatttcattatttacatttcaaatgttttcctctatccaggtctcccttttggaacacccccccccccgcctctatgagggtgctcccccacccacccacccactcccatcttccccctacacaagggcatcaaaccccctcaggcccaagggcctctcctcccactgacttccaacaaggccatccactgccacatatgcggccaacgccatttgtccctccatgggtattctttggttggtggtccagtccctgggagctccgtgggagggggagatcctactctgttgacactgttgatccctccatggggattaaaaaacccctcagctccttcagtcccttctccaactcctccattgccacccccccccccccccccgtgcactcagtccacctctgtatttgtcaggctctggcagagcctctcaggagacagccatcattttagggaactcttaagatatggcatcgttctgttagaaataaacattttttaaaaaaataagtactctctggtgccacgttacttaattgtgtttaaccatccacagttgtgtattttatttaattatttttgatatatatatttctccctttcctccctccaaaccctcccatatacatctcccatatccactttcccactactttaacttcatggcccttccccccattgtttttgcatgcatatatgcattgcattgccctttttatatttttgcaatgagttttagtacatcatgagtaaatagactaaatgtatcatgacttttaagttttaaagatttatttattttttaattggctattttatttatttacatttcaaatgttatcc

SEQ ID NO: 36068 - DNA, 1099 bp, Mus musculus
agtgcatttttgaagcttccctgaacacctttcttgctttaaaatgcaaatgagagataacattagaggtacaagagaaagttcaagatttttaaactaaaaaacaaagcaaaaccaaccaaacaaacaaaaacaatctttttttttccttagatcaaaaagtttaggggcagggaaccaaagaagaaatacaataaccctagtaccatatgctaactaaccagtttctatattcaggaccagaaaaccctgacagctcagctaggtaacttaaagctgcatgctgcacatttcttgcaatgtttccttagtaatcagggactcacctatcaatggcttgaggtgggaggaaaggggaaggagaaggaagtgatcatctattgtagaatttgctttatttgctttcctacttttattattttgagcacctttaatacaagtaagtgtgtgtgtatgtgtgtatatttaaactttattataaaaatattgcaaataaaatgtcacacactgaaattagccagactcaaagacccaatgaacatctgtacactgagagcagccatttcaaaccaaagtcgcagagtttcacattggattatatattttcactgttgaatctatgttatgcacctattcaccaccaaaacagcagaaacaaccgtgacagaattggaactagaaaaacaattagctttatgtccccttcataactcgtggccattgcctgtgttcaatctttcctcaacccataacatttagcctttcttgttcactttttcttcatgttaaatcgtccccacatgtacatttgttatgtagatattatttcctagattctgaatacaagggagaatatgtgggctttttttctgagattgtgtgacatagtataaattctaattccatcaatttttttttgcaaattttgtgagcacatctttgtttttctttttttataaccttctatcattatttctacatttgtggcactgctcagttcttcatgctgcccattagcccttcaataaaggttcaccctaactattgaccaggagctcaagtcagttttcttactataaaacagagctgttgagtctca

SEQ ID NO: 36069 - DNA, 1401 bp, Mus musculus
cccttccctcccccaacccctgccaataccctacagaagaatggatatagaaaatgtggttcatttacacaatggaatattactcagctattttttaattggatattttatttatttacatttcaaatgttattccctttccaggtttcccctctgcaaaccccctagctcatctccccttaccccttctatgagggtgctcctccacccacccacccactcccacctcactgccctagcattcctcaacactggggaacatcaaacctttacaggaccaagggcctcccctcccattgatgccagataaggctccttcagctccttcagtccttcccctaacttctacattggggtccccatgcttagtccaatgaatgattggctgcaagcatccgcatctgtatttgccaggtactggcagagcctctcaggagacagctatatcagactcctgtcaccaagcacttcttggcatccataatagtgtctgggcttggtgtttgtgtgtgagatgaatccccaggtagggcagtctctggatgacccttccttcagtctctgttcaaatctttgtccctgcatttcctttagacaggagcaattctgggttaacattttggagatgggtgggtggccccatccctcaaccagggggcatgcttaacctctggatatggtcttgtcagggacaggttctccctcccccttgttgggtatttcagctaatgtcatccccgtgctaatgtcaattagcagtcagccccattgctacacacctctgttcaatttcctaacatctcttccatctcctgacatctcctccatctcctcccatacctgattctgccccactatttagctattaaagaggacatcatgagttttgtagacaaatggatggaactagaaaatatcatcctgagtgaggtaactcagaccaaaaatgacacacatggtatccactcaccaacaagtgaatattagcttttgcaaatagcagattttgtttgtttttaaattttatcttatttatttatacttatgtgtatgtacatgctgtggtatgtatattgaggtcagaggacagctttgtggaatatttttctcttcttccagttttccatgggttctaaatatctaacatagatattagtgttgtggatagccctggggctaattatatttgatttcaattccattttcctgtgaggggttgtgaacaaggaatgagtcagcactcagatgatttcttgtaaacctttttcccaccttaaattttaaaatagagaagaaatgatgattgggaagataaaggggaaggtggagtggaaagaaataaaagaaggaggtttgagagagagagaactcagagaaggaggaagaagaaaagtggagcag

SEQ ID NO: 36070 - DNA, 1096 bp, Mus musculus
taaattcatgcacacaggttgcctctcccctaaggaggggttgaagaggtcagcattggatgtgtatggttagaggtgggtgtatatagctcaatccgtgagaaacaaaggtttaattataaacaggagcagatgttggctttactataagatggcttttaagccaaaatggaagcaggttggctcttcagtagtattttataaatatttcggaggactcaatggctgcctgtagcatacttcttcactttccctcagagagaattgatggatgtctgctgaaatcttgtacatttgtaggtttgttggcacaattgctgtaaactattgcaccatctgctgtgatctatagctctattctgtgagaaagatctattctgtgagaaaagttgtacgaatcatggttgacaagtgccacccaatgtgcatgtccttgaggaagtgggcttgccttgcccacagttctgggagaattcctgctgctttaccggtgtacagatgaccatggattctgcacgcatctggagagagtgatgagtcaacttccctcggtgggagtgcataatgactcttgaaaacaatgttcttctgctatgtactgtgagtcagctaccacttcctctgtcacactctcccctgtgctgaaaagtcaaactgtttaagagcacttgatgctctgtttttaaaaagatttgttaaacttttttttttaaacagtccagactttatccctctcctggtctgccctctgactgttccacatttcactcctcctccatcaccccggtctccaagaggatgctcccatcctcacccccaccccaccagacctccccactccctggggcctccagtctcttgagggttaggtggctcttctctgactcaggccagaccctgcaattctctgctgtatatgagttgggggcctcatatcagctggtgtatgctgtctggttagtggctcagtgtctgagagatcctggggaccaggttagttgagactgctggtcttcctatagggtcaccttcctcctcagcttcttctagcctttccctaattcaaccacaggggtccctgacttctgtccattgt

SEQ ID NO: 36071 - DNA, 2084 bp, Mus musculus
gaatgtattattattatcaatgtattgccaacaattccacatagattttactatgaatgatgtttgtaagcatcctgttgaatgtagagacctttaacatgctgttttgtggcaaagccaaactgagtatgttaaatttcaggtgtggggcggagtgcccttcctaataagtggattaaaattgaaatcattacttcagatcttaggcatcacacctgagaccaagaaccttcttttccatttacttcactgttttccatttctcctccactccacccccatcttacagcctcactagctctcatttcctttcccttctttgaaggtacacaagatttcagtctttaaatgtcttaagagctgggcacataccgttaatcaatcccagcactcagaagacagagagaggccacagatctctttgagttcaagaccaacctggtctacagtatgagttccaggacagcctggtctacagtatgaattctgagacagccagggctacacagggaaaccctgtcttaaaaaaaaaacaaagtgtcttgagatttttgcctcttatgtgaggtatcaaggcctccgtgaaagccatggcttatcctcttctgaagttcctgtatcctacattgagaaagagcacagagaagctctacctacatagtaggctagtcagagttgagaaaacagtttcagccgtctgattggggatcttttttaaacacttataaattattgaggaaagacaagtaaaatttagataaaattgttttcgtttgtaaattggccacattttttgattgatacatgcatatttctctggttttttccataattaaattgagtgatgttactactttgattctactataatttgaaattataatataatataataaatgtttttctatcacattaattcaactgcaagtgaatgcctgtatatgggcattgtttgtaatttgcagtgactgacatacattctattctctttgtccttctattcttaactgcttttaagtaagctcatctcagtgaacggaacaagcttaacaaggtcaagcctttttaaggcacttttaagagttatgcctaatctgaaatccttagtccttggtggaaagaggaaggacatcctgtttgatatgtggctctaatggtttgcacaaaatctttttgagccacccagccaccccagatctctaagttctaatatattatgtatgcctgcaaatatgtctgcctgctgcaaaattgaaggtgtatttttatagataagaaggaagcctttgaaaatgcatacccaatgtcttgttttatagctaaggtcagggaaaaacatatctatgtcttatgtttcagctaatgtcatcagatttatgcttcatactgtggtgttttaataccaaaattgatttccatcataatatagaatttttaattctcactggtaaaaaaattacttgtgaatgtcaatcctcagcaatcttacatttcgtctgtagccttagaatttgaccaaatagtcatcataggaatttttttctgccatgtacaaatcacacttcattttgttcaaaaaaaaaaaatcaagaagtgtaatgaattgtttccatgaaacaaatattaagacaggaatagattgtatatgaaagtgaccaagtatcattcaagttacaatagtatttgtcatttaaaatatttatcattacatgtcatatcaatttgaactcctcactaataactgtattattttattgttcagtatattgattgacaggtgatagttttctcgttacttttcttttttatgtgactggtagtttgagtggggaagaagttccttttcattgaaattagtcacagcaaatgctaacccttcccctccaaacttcttttcttttaacctcaggatagaatgtaacttgtatttttctattgggttagccaagtattttgtgaaagttatttttgactaaaaaagagaataattttgttgatatataatactcctttattaccatggtagtttccaaaggaaaaaaagttttgaaataacattttgccaaagcttctaaatctctata

SEQ ID NO: 36072 - DNA, 2939 bp, Mus musculus
tttacaactatcaaatcattcaggttcccttgagtggtgaactgttgggaaatttttcgtggtaaagaataagtttattaatacttgttcatatactttgtgagctaaaaataatagaagggtatctataagtatatccttccatgtgtgagtgtgtatgtatatatatgtgtgtgtgtgtatatatgtatgtatgtatgtgtataattcttatcttgctccagcttttccactcacctgattctgagccagcctttttattttgatgatggcaacctgagaatatgttccattttctgtgaattttgtcaaagtcagacttaatgaagaaactatctaatattgtggccccaggcaagtggtctaaattatgtgtcagtgttttcctctgtaaaagtagagggttgaaccttgagctagacaggaaatgagaggttagttaccattctgtggttctgagaagccacagaagatctttgctgtgcagtgtgtgaaaatggttattctcggatctgcacttggtggaaactcacagtgccttgcacacagtttgagttcagtttgctggctggctgctagttgatgtgtgttagtgaaaacacactcaaagaacccaatgcctggtagaccttattccctctgtgctgataaaagtgaatgtagtttccctaggaaggaggggctgggatctctgtttgccatgtggaatctgactacgcagttggtatcaggtgtgacattggtatccgcttagactgtgtgaagagttgcaggctcaatttcacatctccttcagtgtctcaccaagttccctgctcaccaaaaggatctatccgaacggacttagaaaattcggtggaaaggaaaatggcatgaaagttcaaacccaagtcacttctggtttcattcctagctctgctgcttaattcctctgtacctcatgtcctcattgctgaagtggggacaatattctggacctacctcacaggggaattgagggtctttttcatgtgtctgtgtgcttagaagctgactaaaagaaatattggatagcatgattatataatttctacgtagatgtgactttcagtctgcattatgttttctttctcagtaacatcctacagagtgttctgactcaatttttttcccaagtcatttttgttgctaatgccctatttgttaaacatgagtgattgtactatattaatacttgatttagggaggaaagcaggtgggtgtaaactagtggccctcaggttagagtagatgaaaaatagcagtggaaagtagccttgagcctttctcaagaatcattaattcacataacactaaaggccacacactgacctatcacattccttctacaccagccaaacaacacatggaatcaccatgcattttgctcatgttctttcctgttctgtctattgacatgcttactgacactgattaaaagctgtgaatggaagtgtgcttgtaattaatagaaatgagaaagctgtccttaagtgtactttaatatatacttgaaaatggggaaggaatttagagatccatataatgaaaatgttaggagccacttttaagaagaactaaaattatttggcctctcaacacattgtgtcctagtcctgaatgattgggggcaagggggagagagagagagagagagagagagagagagaaaataaatgagaattgactagattaagctataaattcagattataatttgccttcagttttggtttgtctctggactctagaactgaactgattcagtggggtgtgtccatgcacacacacacacaggattgcaaatgtacaggattgcagtgttctggtgtcatgttctagcattagtctaagtaacagtttctcagcatctgaaagtagttctatgtgtaaagcctgtatggtaatcaaggcaataagttctcaaatggtccttttactcctgcttctttgatttgcttttatcttggcatagttttcctgcttttctgtttttattgtaagcaaatagttgaaaattgttctaatgccaggactttggaacaagttacaaatgtttgaaattatataatctacaagctagtttgctgtccttggactaattatatataagtgtgaatttctactgcaaggacatccagatagagctggcgttgttctaaagattggattgaaaaatgaaacaacttctccattttggccaaggattcctgttggaacagctttcccagaagagaatcatagtggctatgtctgtcgaaccaagaacattcatgcatcttgtagtgttatgtagcctgtggaatgaattcctcttccccctggagtccaggactgactctcctggaagaactcaacctatatacagctgtgccaaaagaaggctacctgcctctgaaactcccactgctgcttctgtcgttgttcacttgtcagatacaattttattctcaggatgcaaattccaataaagtacaaacccatggtactgagttgaaccgtgtggctttggggcacaccgtctcagtttccttaggttttcatcattataatatcattacttaggggcagatacagtaactcagatggtaaaagtcttgttgcctaggtgacctgagtttgatccccaggacccacatgttagaaggagaaatctaacttctacaagttgtcctctgacctcatataacacacacacacacacacacacacacacacacacacacacaaataaatacctaaatgtaattttttctgagacaaggtttctctgtgtagccctgactgtccttgaactcactctgtagaccaggctggtctctaactaagagatctgcctgcctctgcctcctgagagctgggattaaaaaggaaaggagagtttatttggtttacacttccagatcacaatttgtcatgtt

SEQ ID NO: 36073 - DNA, 1117 bp, Mus musculus
tgggctatcgctaaaatgcctgccaccggggacctgggctatcactaaaatgcctgccgccgccagggacctggggagatcgctaaaatccctgccttataaccaacccctagaggtcgactaaaatgtctgctgggcagagcagaggtgatgaaaatgtctgggatagcgtagagatggttggctaaaatgttacaggtagatatgcaaagcgttcaataagcctggcgtgggtaataaactgcagtctagagcggaaaagaaagttaagggcgtgacttgtagcagggtctagaatccacacactcacatcagggaaagcctcgtgtccgaaaaactctttggaatagtcttaatattttaatattgctcaagccaaattcagcaatactacctcaccgcacgtgtctttttcaggtaagatttttgctctttttttttttttttggtaacaattttcccgccatgtgattatgctaaaaaccaatgggattctacctccgctttagtggggttttctgattgtacgcgtttggattaaagttgatgaaagaatgtggggggggggcacagattcagaaaagtggaaaaattactggtagcgtgtgaagtaaccaagaacgagtaactaagtctgcgataactttctttgagaagccttggaagttgagacctaaaattttggtactgcgttccgtttatttccgaggtacataatgacccgatctctggtatcgttgaaattcgaaaataatctgagtgctttgaaaacccattaagtttctactatctgggacaaggagtattttcggggtgggggtggcgggcaaggcaaaacaattctcagtggttcgtatctgaaaaatcatattcttatttactataggcacggaaaatccctcccggtagtgtttattcagtgtgttcagacgagcaaacaatggcactaaggaatgaatccagtttagaaaggagggaaattaacaatcagctttggttttgatgcggatttggggtgaattttgttttttgttttttttttaatgccttatttctgagacaaggtctcagtaaataacctcaaactcgcaaagctctgcctgccactgccttcagt

SEQ ID NO: 36074 - DNA, 1099 bp, Mus musculus
tttctcctgaacaacttaggctctaagttatgagacctcaaattacccaaggaactggctaggcctgcctggtggtgtaggcctttaatccgagcactcctgagtcagtagcagacagtgctctatggatttagggccagcctaatctacatggacttcaggctagccagatggccagggcaacataaccaatttcattacatagggaattaaaactgaggtatctggtatgataaaagggccactgagttagaaactatcatctgaaaagcaggcttagtggtacaagcctgtaattctaacacaggaggatcaggagctcagagtcattccggctacttagggacttggaggctagcctagttctggctccatgcaaaggaaaaggggaatgtggcagtggttaagataccataatagattcttgtacctgcctcactcacactcgcttgcagtacctgtctatctttctcttcttgccaatcacattgtagatgaggcttttgtggttttgttggctccttgtattagcataaggtgaactgatttaagagcactaactgctcttccaggggatctgaattacattccggctacacacaagatggcgtctgtaacttggtttccttgggatccgacaccctctgctggcctacacgggtataacacccaaacctaatgcatagacaaaactcatgcacattaaataaaatttaaggaaaatatcatatacagcacatgatgttttcaaaacaaagcattttatttaacagcaaactaccccacccactcaaccacccacccacccacccacccacccatccacccacccacacacggactcattgtgacatgttggtaagcaacagttttttttttcaagtcttcaaaacacccaagagtcaacagaagttctgtattccgcatccgttcacaaagtccaggtgttttccatgtgttttttcacagttggtgggaagatgactccagtctttcaacaacagattggtacacagttcatttatgtgatcaaagcagatgatggtaggatgtgcttaattggtagcaatattgatggcagtaactgtgaaaggaaggc

SEQ ID NO: 36075 - DNA, 1112 bp, Mus musculus
attactgaatccagccaatttccactaattaaaagctaatattagtaacacttttgatgcccaattgagttttaatgaaaatgaaaaaaatttgtttgaactcccagacctcttcaacctggctccatcttctctgttccttttcttttgcctgaatgtcctgattgggttactaagtaaagtctagatactttgaaagtatgcgtatgctacaatgaataagcttccttacagcaaattgtgacttcagctctaaggcaacttggataaagagatcacattgacttaatctgtttcattcccatttgactcaaggcttagctgatagccatttagatgaaaatacattttcagaaacatttagcgaattaataccaattttgtggaactgcattaaagtcccaacttagattccagatagacaggctggaccctttccttcactcggcctcctgtcccaccctctgtgagtgaaagaaaaatggaaagggtcaaagcacaggcatttttaatctttttcaagttctttcaatttggtctttcgttcctccagttttctgattgttgtcaattttattattcttaaattttatgcaagaatgttaaacattaatgttattttcatccactggcattattttaccatagcaagccaccttgagtatattatagtaaggagaacatttctaaattactgtgagcattagcatgtaaaaaggtaaaaggtttaacgaacacaggcaaaattggtcaatgtatttcaaagcctgctgcagctcaaaaatggcttgtttgccccaggataatgcaaagtagcctaagattgtggaacttagatggctgtcatccctcctgaccagtagtggtcacagtcatagctaaaatggcctagaaaattgagtttcttagcgtggagggcttctgtaactttagggtcaggcttgctacaaagcccagcttcccactcattgcagtggccggagaagacatgaggatgaggactcacattgcatattacttggggactaaggactaagtcgtgccactacccagaaaagagaccccccccccccatccagcacttccctatgtctatgtttcctttttccatg

SEQ ID NO: 36076 - DNA, 1148 bp, Mus musculus
atacacatatatatggcagtttacaaattataaattaatctcatgcataatttctttagatacacaggacaatgagaatgctctttgcatcccagtgcctagcaagggcactgttttgtaataaatgactgccattcagtatgtactcatcaagtattgaatgcttcatatattcagtggttcacagttacttatttactttattttcacagtataataaatgtggcagaattttaaaagcctggaaattgataccaagtaagaaaatgaattgttacatttatatggtacctccgagttcataaaatgccaacgtacatattattctcaagtgtggacacactgaaatgtacgtctgtgtatctctccagtacccatgaaagagaatatacacatgggagacaatatttagcctccaggtttgagattgaccttatggtcttcccaggctagcctccaatttctgggctcaagtggtcctgttgcttcagctcagagcacatgctaccacacccagcttgttaactgtactcttcccattatgggctaaaaagtacaatgaaaattttgtagagactatgcctattttataggcagctttatttctatagaaaatttgtcttgtcttatactactgaactgctttatagttaagaaagtacccacaaccataatgtgacctgggcaaatgttcttgtattaacatgcccttatcactcaagttttgactgattaaattaagcattggctcattccttatgaatagtatggaatgcaaacattcttatttcatggcagttactcatgaatatttcatgtacccaaaacaatatcggatacatcagaggtagttagtagtcattcatttgcacacatggaacaattgatagctgtataatgctttatttaatgcattcttttgtaaattctagttctgtggtaatgtccccctttgttattcccagtgctgaacatgggtattcagaaattagaaggtgatcagaatagggtaatcaatcacctgcattagtgacctagtttgtagtttaaaatcagtttccatgtgttttctcttctgctacctggtataatataacttactgagcctcaccaaagcagaagaaacacactggccttaagtatatgga

SEQ ID NO: 36077 - DNA, 1136 bp, Mus musculus
cttcccaccacttaatgaaggtgtacattctcaaattcacttgttctacagggttctttgtttacaaactcctaagtctgggtcaagccattggacagcttggaagaaagctcattcttctttttttttcaagacagggtttctctgtgtagccctggctgtcctggaactcactctgtagaccaggctggcctcgaactcagagatccgcctgcctctgcctcccaagtgctgggattaaaggctcgagctaccactgcccggctgaaagctcattcttaatgtatacagttcaggcagcctgaagatggtgatggcgagttggtggctttccattacatgattactgacagtgagggctgggtcaggacactaatttggggaactctttgtattccatcaattatggggaccaaagatggcctccagatggttttgtgtgatggcacctcctaatggacatttcaatcacagacaagctcatgttccagatgtcctactacaaataagtgtgtattttacagtgccgtggaggtcatgtaggactaggttgccatgacagaattggccctgattaatgatctgcctgctcacacaacttgatcatttcaatagggaactgtcagtgatagtgggtttactgtgaatagcagcagtaccagcttcctccaggccactaactggagtctgagtcctaatctctatttaggtccataggaggcaggctgaaagctctaggtgcctaggcaagcctgggggggggggtcactttgcatgtactggggtgggtagccaatggtgctaaggtgagaccgaagctttagctaactgtcttagtgcaccaaacacattctttagcatctcaaaaagctttttttccttgcaaatgtttccttttgaagcagttacttgtacaacaatggtcctagtttcctaaaagactcaatagttctagatgtattatcacctagagagccagacaatgctaagcctttggagttgggggaaacctgctgcgaaggaatttacagtggacttaaaagggttaaagtactagagggtcatttgcacgtacaaaaggcaaatgcaaaaaaatgttaagtgttatggacaaggatgttttttcagctagacca

SEQ ID NO: 36078 - DNA, 1267 bp, Mus musculus
ggactgcatgcattaagtgaaactccatgactctggaagtcagtatggagtgggtatagatgggctatctcagtcttataggctgagtgatgggcactgcattttagcaataggactgcatgcattaagtgaaattccatgactctggaagtcagtatggagtgggtatagatgggctatctcagtcttataggctgagtgatgggcactgcattttagcaataggactgcatgcattaagtgaaattccatgactctggaagtcagtatggagggggtatggggtatagatgggctatctcagtcttataggctgagtgatgggcactgcattttagcaataggactgcatgcattaagtgaaattccatgactctggaagtcagtatggagggggtatagatgggctatctcagtcttataggctgagtgatgggcactgcattttagcaataggaccgtatgcaaagtgaaattctatgactctggaagtcagtatggagggagtatggggtatacatagggatatctcagtcttatagactgagtgatggacactgcattttagcaataggaccgtatgcaaagtgaaattctatgactctggaagtcagtatggagggagtatggggtatacatagggatatctcagtcttatagactgagtgatggacactgcattttagcaatacgattctatgtattaagtgaaattccatgaccctagaagtcagtatggagggggtatggggtataaatgggctatctcagtcttataggctgagttatgggcactgcattttagcaataggactgcatgcattaagtgaaactccatgactctgtaagtcagtatggagggggtatagatgggctatctcagtcttataggctgagtgatgggcactgcattttagcaatacgattctatgcattaagtgaaattccatgactctagaagtcagtatggagggggtatagatgggctgtctcagtcttataggctgagtgatggacactgcattttagcactgaatcaatgaagattcgaatttctctaagtagaagtgggcttgggataggtctgaaagtatctgggcctggggctaggactgggctggggcagggctggactggattgggttggttgggtggggcaggggcaggggcaggggtaggggctggggctggggctggggcaggggctggggcaggggcaggggctggggctggggcaggggctggggctggggctggggcaggggct

SEQ ID NO: 36079 - DNA, 1092 bp, Mus musculus
tttgtgtgtcacatgtcagcttcatgtctgagttagcctggagaggtggcacatgctcttgaatgtgtctaagatggcggaagtcatgtgacctgccctctagtggtttctttcagtgattttttttttggcgggctttagctacttggcgggctttgcccgagggtacacttggtgcattatggtagggtgtggttggtcctaccttgtgccactcgaagctgaggcaaggctaagtggaagtgttggttgccacttgacgtaactcgtcagaaatgggcacaagtgtgaaagtgttggtgtttgcttgacttccagttagaaatgtgcattattgcttggtggccaggatggaattagactgtgatgagtcactgtcccataaggacgtgagtttcgcttggtacttcacgtgtgtctttagtcatcattttttcgaagtgcctgcccaggtcgggagagcgcatgcttgcaattctaacactgaagtgttggatgatgtcggatccgattcgagagaccgaggctgcgggttcttggtcgatgtaaatcattgaaacctcacctattaaaagaaagaaaagtatctaaggccatttcaaggacatttgactcatccgcttgcgttcatagtctcttacagtgctctatacgtggcggtgcaaactaaaactcagcccgttccattcctttgtattgttcagtggctagtctacttacaccttggcctctgatttagccagcactgatctcaagcggttctctaagcctactgggtataagtggtgactttggccagagtcatagtggatcacaaatcactggtgaagaggtagaatcctaccttcttccaaaatctaccccatgactattgctggggttgcattttgatttcaatgaatattttggatgccaacgacacgtctgatagtgtgctttgctagtgtttgaatttaaaaccgaagtgattgttttcaaaatgtatttacgatttgcttacttgttgaattcattttaattacctttagtgaattgttactttggagtccttaaagttttcaataatttttttggcagatgatactcaaatta

SEQ ID NO: 36080 - DNA, 1253 bp, Mus musculus
tccatctaaggagctttgggggaacatttttagttcccctaccaccaagccttatggcttatttaagaaaacatatcaaaattccacgagatttttgacgttttgatatgttctggtaagattttttttttgacatgtcctccatactttttgatatttgtaatattttcagtcaatttttcatttttaaggaatatttctttgttgtgccttttggttgatacttgtgtgtgtatggtggacttacctttctttcattgtttatatattcttgcccatcggggccacggatacctgtgtgtcctccccgccattccatgcccaacggggttttggatacttacctgccttttcattctttttttttcttattatttttttttctaaacttgcccatctgggctgtggatacctgcttttattctttttttcttctccttagcccatcggggccatggatacctgctttttgtaaaaaaaaaaaaaaaaacaaaaaaacctttctcggtccatcgggacctcggatacctgcgtttagtctttttttcccatgcccaacggggcctcggatacctgctgttattatttttttttctttttcttttgcccatcggggctgtggatacctgctttaaattttttttttcacggcccaacggggcgcttggtggatggaaatatggttttgtgagttattgcactacctggaatatctatgcctcttatttgcgtgtactgttgctgctgatcgtttggtgctgtgtgagtgaacctatggcttagaaaaacgactttgctcttaaactgagtgggtgttcagggcgtggagagcccgcgtccgccattatggcttctgcgtgatacggctattctcgagccagttacgccaagaattaggacaccgaggagcacagcggactggataaaagcaaccaattgcgctgcgctagctaaaggctttctttatatgtgcggggttgcgggattcgccttgatttgtggtagcatttgcggggttgtgctagccggaagtagaaagccaaggagtgctcgtattagtgtgcggtgttgcgcggaagccgcagaggactaggggatagggctcagcgtgggtgtggggattgggcagggtgtgtgtgcatatggacccctggcgcggtcccccgtggctttaagggctgctcagaagtctataaaatggcggctcgggggctccacccgaggctcgacagcccaatctttgttctggtgtg

SEQ ID NO: 36081 - DNA, 1108 bp, Mus musculus
ctgtgacaatggatccctaaggagtccagcttctagacattgcccctttggctctgaaggggctgggaaccaattatgttactctttgcaagtttaccaactaattaacatagccaccttaagggttaggaggaaattgcttaacaaggtggaggggggggacttgttgctgagtcaccctgccagaaagaattagacttatattttacggcccacctccctccagattacagctgtgggacccttctggggtagagaatcctgggctgcagcttgcagccttggtgagctggtggtagctgtttgttgtggctcagcttttaaaagcagccccgagaaaggcacattgcagggggagtgcgggggctggggtgtcttactgattttcacattttttccagctttgagctcaaataaccccgggccagaggctacgtgttttgtttttctctccacagttgggtgtccagcattgctgtgaaccgcccctagactaactgtgaagatccattatgaacatctaagaaataggagggggcacgggtgtggggagccgaggaatccatgaataaatgagtattgttgacgtgggcacaggcaagtcaaggaccaacgcctcatttccactgaaagggcaaagttctcacctgtgagtgaggctcagcgagatggcaaagccttccccgggtctgaatatgaatgtggacagtgtgctacaagttctagtgtttacgaatgctggatcagtgtgtgcaagagctagcaaccgcagctccctcttggtcagagcacagtctaagaatggagtcatgggaaaggtattctcagtgcttgtgagaaaccctcgagaatacatgacaagagttttgtgacctcagtttctttaaaaacacagacctgttcttggactgtgtttttgtgcacttcctgaggtctgaggtgtagcagctaagagtgtgtttacttcagctgttgttattcatgtgcttctatggaaaaacgtggttttgccacctctgccttgttcttgtgattgaacaccttactcgtgtgattcctcttagccttcaggatataaatcgcctgatgctctgaataaagttagcca

SEQ ID NO: 36082 - DNA, 1136 bp, Mus musculus
tgagggctgctcccctaagagcacctgcagctcagcctccagcagcagctgcaccatctgcagttggctcacctgccgctgcgccccagatggcccagatggctaccaccgcagccggtgtggctgtgggctctgcagtggggcacaccctgggtcacaccatcactggaggcttcagcggaggtggtagtgctgagcccgcaaagcccgacatcacttaccaggagcctcagggagcccagctgcagaaccagcagtcttttggaccttgctctctagagatcaagcagtttctggagtgtgctcagaaccagagcgatgtcaagctctgtgagggcttcaaagaggtgctgcggcagtgcaggattgcaaatggtttaatctaatcaagaaattcaagctgaagagatgtaacattggttctgtataattgatagtacaagtgtggacccttatatttctaacagttccgttgctttagaatggccatgaaagagatctaactatggatgcttactgaggcttgtatgtagtgttggttactgggcaagtgtttggcctccttggactgtgttgtgattgtgagttaaaaaaataaattggttattctgaaaaaataaagagagagtcgctttgcaaaaaaagtttgacagcattcattccatttctattttatggaatagtttgaggagttattgatggtggtggtggtgctcctcctcctcctcctcctcctcctcctcctcctcctcctcctcctcctctttctccttctcctccttcattcttcaagacagagtctcactgtgtagccctagatgtcctggaacttgctctatagaccaggttgccctccaactcagaaaacttcctgcctctgcctcccaagtgctgggtttaactacttggcctggtgatagttcttttaagggtcttgtgaaacttagcagagaattgatctaggattgaacttttttttttaacttggtagattatttgattattacttcattcttttttttataaagtctgttttagttgtttatctcatcttagttcaattatagcagctaaaaattcattctctttagatcttctaatttggtgcaatttaaatcttaaatgtatatactaat

SEQ ID NO: 36083 - DNA, 1226 bp, Mus musculus
gctggaaggactggcttttggtgcacagcaacttttgtgatgcagagttcaaggactacagaaagaccattgctagaacataaaaaaagattagaaattttgtgaatgaagttggtagggatatagaagtagttaacttaaaagccttaattaatgcttttaagtttaggcaaagagaagacaaaagggtaaatgtgccactgcatctgtctacacagaaataaaaagaataaagggcagggaattgttttagaactctgtcccgtcatttagctccatcggactttccagctggtcaaatttgcctccaaggcactgtttccaaaatcttagtgaccctgcttctttggggaaaggttctacagtaaattcctcgctagcacttgaaatgtggggaaatgcttaatactcatcattagaaaaagacaaagacacacttaaaagttggtctgagccaggcggtggtggcgcacgcctttaatcccagcacttgggaggcagacacaggtggatttctgagttcgaggccagcctggtctacaaagtgagttccaggacagccagggctacacagagaaaccctgtctcgaaaaatcaaaaaaaaaaaaaaaaagttggtctgaggattagataatgtgatgcctaaattagatgatgtatttaaaggttttatccaactgacaacacccattaaacactaaaatagaagatcaaagggggtagggtgaatagtagttttagcttggctaggcacttgaagccaacagtgttggtgtccaaattaaaaatgagacttattggggctggagagatggcttagtgcttaagagcactggctactttttcagaggacctgggctcagttacccccatatggcaactcataaccatctgtaacttcagtttcaggggattggacacccttttctgaactgacggttcctgtatacacatggtgaacataaactctggcacacacatacatgtaaaatattttttccaaagccctcagcatcaccattatgaagtttgaaaatcggtgaaaaggatccagatacctagagcagggtttggtaaatctgggacaattatagacgtcatttttttaaatcctttttttaaagatttctcatatatatgtatatatataggcttctaaggaataaaatattttaagattaaataaaactccagttattggtctgttttgtgtattctggcaatgg

SEQ ID NO: 36084 - DNA, 2702 bp, Mus musculus
accctcactgatattgccttagcagtaaagattatttcaaagtacattctttcatgttttcttctggctttcagtcctacctaagtattaaggaaagtaaattgtaaatatcgtagttgtttacaaaggatatgtactgctcttgcaaggaaataatgtccaaacaaagcttcacttattttttttaatagaagcatatttcactgtttatggcgcttatgtaatacatttttatctttttaaaaagaattgtccatgtaaaagtcagggttcctttatatttgtgagcctccttgtcacctttccctggttttcggatctgcaggatagtcctggttaagtaaaaatacatcccgttttcctcttgataaaatgttccattgtagagggattcattttctatagctcaaaaacagctgcagcacattctaaacacagtgatggacagcaggcacctccctaacctccccaaatgtattactcatctctgaagtattgaagttagagggaactcaatcaggatactggttatgaatgtagatgttgaagctattcaaaaacactggaagtcagtctttacatttctagccttgtttgatctgcatgtggactatttcaagaagcactcgtagacattgggctgtctagaatggatacaagtatttttagtgggagttgctttttttattttggtgtccacagctattctatattactagttgcagctgttaaagatgaggttgttggtgtaggtgtcaggtgtgcaatgaagaacaggaatcttggtttcctcaccagtgtccaaatgcctattcttgagggaacattttcttgcgaaagactttacatttcgttttggatcttcgcactttttctttattacagaaaggttctgtgtttaagacctactttgaacttcatgcagtaatgttgggggattacattgttcaaagcataggggaaagtactaaagcctgattttccttgaatttttaattgttttaatccacttactagtgtaaaggtttgcagtgttttattttattccacacagcttacaatgttgagatttattagtgctgaaaacaaaatttaacatgttaagaatggcaggctgtttgtagtaaccatgcagaataagctgtggtgggaatttggaacattttctctgaaaaagaacatgttagttgcactgccctgacctccatataaatggaggtggctttggtggggagagggagaaggctcacatgctagtgttggaacaggtaattgtcagtttgataacaaaaggttagtgccaggagatgctcggtctctagggcacagttgttagactccatccaagctagggaactggtttgctctgttaccttaagcaatattttgctttgtttttgtttttgtttttttttctcctgggaaaactttgtttctgttccaagtattctctgcttttatcaatgtcttatagttatgaagggttagcatttagcacattttgtatttaaccacctgcttctatgaatgagtctccagataaccatgtgataaagaggtctatgttacaaaatgactgttaaaggccatttctgacagtttgctagaatacagtggcaccttgtggttgactttttttttaacagatggaggatagttcttttgtgaaaggaaataatttgtaatctgccttagctgatttaatgttttttcttactggcttccgtgtcacacgtcttaaccaaaaatatacagtacctggaagccatgttgcagggcacttagattcttggctaatctaagatttttcactctctggaagtattctttctatacctgtgtaacgaggtggagaaggcacatgtgaaggtgtttctttttcccctttagtacagttcaatatgtctaatgcacagtaacagtgttgttattgagttaactagtaaatggttcttctaaaaaatttttttaagtgtatgttgatgtatcatgggaagttaaagtgcaagatctggggaaagaatatttttaagttcagtttaataaaaacagttgtgagctcaatcaatagccaccctttaaattttttagcattgagttacctttcttgaggtaagatcttgctgtgtgctcacagctggcctggaactctgtggaccaggctggctttagatttgtggcagtccttgtgcctctgcctctttcttgaatgttaggaatgcaggtacttagcactcaaattcaccttcattggaacatttctaaaatactatccaacactccaggaagtggcctcctgtaagtcgccatagtttgtatctaaaagcccacagcttagaatagaactaccggggtttttgttttttgtttttttttaagtatcaggtttatgatttttttttcatgtccatgtagatgtctggattcaaatcttaaaaaggttaccaaccactcaaaattacagtgagatacatgggacaatttgctttgggtattttgagagggtcttgttttgtagcccaggctggcctggaattagtgatcctcctgatgactgggattatagttatgtgtcaccccaacccagcaaggatttgtttactgaagtcccacagctgctttataatcatttgggaaagcagctagagatgcgcagtgaaagtgaaccctgtcatacataccactgtgccttgtttcaaggt

SEQ ID NO: 36085 - DNA, 1128 bp, Mus musculus
gaggcccagcttgataaggactcttcaatcttgaagtagtactgtggttactgactgctgtcagctggagatggagtgtcatcagagtggcttcccactaacctgatcctatacattggtagcatagcgcagttttgtcctttattatatttactctgtagttatttcaattgttttagagacttgtaggtggaattgtggactataagtctagtactcctctgcaaagagcttgggcatgagggacattgccgaatctgttttggatttctcaactaccctttcaagaggtaaagataggaaatgacaagaaaagctaagtgtgcattactgtttgggtaataggtaatctctccttaatatggtgtcttacgagtgttgagtgcactatatatgctgctagcatgctgctggaaatttatgaacaaattgtgtgcatggtgagcagaatcttcccataaataaatgcagtaacacaactctgttctgttttttttcaattcaatgtatttgtattaagtattttacctatatgtgcatatatgcatcgtatgtgtgtctgttgcctatgtggccaagggaggatgtcgatcccctggaaccaaagttactgatgtagtgagccattatgtagtgctgggaatcaaatcaggtcttgtgtaagaggaacaagtactctaaactaaggagccatctctatcccctctgccattgttttggttttgctttttgttattgatagtttagcactgtctagcctagaactcgaattctgtctacttctgcctcctgagtgctggaattaaaggtatgttgcactatgccctgtttttttttttaataatgctttgtgtttttaaaagtgagagatgacagacaagcacagctccccatccatctacttgcatatattatatatttaatgaaatttcaacattctacaaaggaaaattcctttttttttttgaaacagggtttctctgagtagcccccacagtcctggcactcactatgtataccaatctggccttgaactctggctcctaagtgctgagattgaaggcatataacaccaccacatgactaagaaaaattcttaacattatatctttgtacataatggtacct

SEQ ID NO: 36086 - DNA, 1107 bp, Mus musculus
gtgtgagacccagtctgaaaaataaaaatataaaagaaagaaggaggatgaggaaggaaggaagaaatgaatgaatgaacaaatgaaagaatcaaggaaggaagggagggagggagggagggagggaggaaggagatactgaaatcattctgcctctttgagagatgcctagttttacagcacaaaagaaaaaggcttgaatgaaaactaaaaggggcctttttgtttttcactcccagggaggtggagagcttcagagtctccactgggatagctgtagcactgactggagtttgctgcctacagagttttgaatgtacttactagactttagtttccatagaactgaatgcacctcttcagtaagtgaaatgctttatggtgctaaagaaaatgattatccccatttttcttcttcgccaagccccttaagcatttaagaaaatttaaagtaaaagcatttagagaccctttttatgaatgtaacctgtttctgtttgacacatgacactgcaactttaaagttaggaaattatttgcctttttcttttagaattaagctttataaataatctgtagagtcaattgaagtataaagcttaaggatcactcttaagacgcctacaaaatcttgtatatttttaagtgtgccaatttgtaacatattttgtaagtgtatatttttcttagaaaagtgctgtgaagtgtctgtatgtgagagttttccttttttctgcaccactatgtgctaataaaaggatatttacttcaaagtttctggttttagaaaccacaatacaaagaaaaaacacttttgttgggaattttgtaacaaaaaatatgttgtgaaagagtgtagtgatcttgtgcaaagaaaatgaacatttgtgagcttcttgctgttttatagaatttcttgtaaattattcttgtaacacctctggttttgttgttcttgttgaaaaaagttttaaatatttgtgactgaatgtatggtgaaactgtcataatgttacctagctgagttttgttattgtttatggaataaataaaagaaaagtttaaaatactgctttagaatcatatgtaacagaattaaaaacattt

SEQ ID NO: 36087 - DNA, 1130 bp, Mus musculus
aaactcatcttgcttggttttaggaatggagtgctttctatgtaaccaaaaagtggaaattaaagaagaaataaagaaaatgttctatgagtataatgtgtttttataaaagtaaatatgggagcagttgtcccagatttttttaaagtatcatgatgttcagctttggagaatggggtaagactggggtaggatagcttgaaactgtttctaacagtttcattgtcagaacttgatcatcagtcctttggagtggatactctttcagttgctcctatggagcccactaggggccaattttagggcatggttcatatctttctccaaagagaactgccattttaaagcacctttttatcggcctgccatgcattgtatgttcttaacatataaactagtgacttgtaaccagtcattttgtattgaaacataacaagaaagtgaatttgaggagtgtgcaatagaccaaggcagagatgttattgtacactatgctctacattgttgagcactttgcattctgttggtcctgcctctgctctcagaattattttcctttctgtcacaacatagtaggccaaacttactggagatctcttattcaaccagctgccttagtggagtgaggaccaatgtatgaaaatagtgttttgccctatcactgatttcttcaactcaaaaaccctggattttccttgatctgaaatttctgactacccccttctaacctctcctttctgagaagctgcatcctattaatgcctcctcattggagtctcatttaatctttactttcctggaaattatatcctcccttgttcttctttcttgacttttatcagtcttagaatttttcttcttgtgtagtattctattcaatatcccaaactgtcaaagtttaagaactacagctagaggctttcttttggaagtttagaggactaccttccctgtcttattcactcaaaatacaaatgcacgagcacatgcacacatagcattgagaaaagactgaaactgctttctcttgaaggtgtgtgataacaggtccaatctcttattgtggtcaggtgctgtactacatggagcagagtgcagatacaatggccccagccaagggtcttcaagac

SEQ ID NO: 36088 - DNA, 1194 bp, Mus musculus
accagtattgttagcagaggagatttcaagacaatgtagcattgactgtcacatggttattattgatctctcttatgcagaactacaaggaaaaagagcaaagaaggaaaaaagaaatatgaaatgtgtactttgaggagaaaaagaacaccagagaatatgataagctcaaagagatatgaagtttttaaaaaggcctgatgctaattgtaataaagggatgccaccctcagggtaagaccccaccagctaattgtataatctgtgaaagagaaatgtccaagggatttccttggtctaaacaacagcaatccaaagtttatgcaaatgtaattcaaaaagggggctgagttccagctgcagcaggtagcagaatttggctacatggttctggatttagagccaagaaggaaacaggaaatgggttgtggagtcttcctccatggtaaaggaacgccacaaagaccagacatgtgacagggtagtcccttcctgaaggccattgcatgaagctgtgaaggtgaaacctggattgtgttggaaacctcaagatgtgggaaagagcagaagcatgccagtgagagctgcataaaggatgtggaaccagctcaagagaaaggagtgtgctacagttaacaaagctggaaggagcaaaagataggaagagccatctaagtcaggatgtagagttaggcctgctgggtttccgaatagctttcatccagtatttcctttctttccatttagaatgtatattctgtgccattgtatgttggaagtatgaaactagctttttgatgttacagggtgttactgttaagagattcccttgagtcacagaagagactttgaactttgcattttgaaacatacctgatactgaaagactatggggacttttgaagtttgattgaatgcattttgaattatgatatggccataagcctatggggagctaggaaatgaaatgtggtgttttgaataagaatgagccccatagtcctccctcttctcagagaagaaagggagagggacatgaagagaggggctatgtgaggggggacctggaggagggggttacaattagcatgtaaaatgagtaaataaattaattagtgaaaaagggctcatatatttggaagtttgtgtcccagttgatagatggtttagaaacaattaggaagggtggccttc

SEQ ID NO: 36089 - DNA, 1212 bp, Mus musculus
aataattttattgacttggcttgcctagctgtgactttacagctagacatgtggtagtatatataagtcttactaatcagatgtatcttttatgtctataaacacatgagggtaaaaaaacaaaatgcctggatttttagtcttctgtttgctttgtaccaagaggcctaagaactatgtctactttatcttctctaatggtgaaataaaacactttcactttttctattaccagaaattttctgctttttggattattcggttttctttactcctcaactgttcagtgccacatctaacaaagcatatggtttttctatcaaaggagcagtcattgctcttaggtatgcagggggaaagcaaaaattacaagggttaaaaaccaatccgttcctttctggtatttaacttctaagtcagcatctttttttttttttttcttaaaaaaaaaaaaacaactgtctggctttccctccttgcctaccctcactcctatacataaatattttctcctttttgtttctcctttcctcctttgctaatattatggatggactgacagctcaaaaatactctaattctttttttttttttttttagccctggctgtcctggaactcactttgtagaccagactggccttgaactcagaaatccgcctgcctctgcctcccaagtgctggcattaaaggcgtgcgccaccactgcccagcaaaaatactctaattctaaggaactagatttgttctttgatatttcattgcccccgtggttttaattaggtgtaaattctcctatgcttgctttgaaacatgcctcaggatcttagtgagattaatgcagggagatgtttctctcttcatggtgcccaggcaacatttattgtcattaaaatagtgtcattcaaatgaggtggctgatattggaaaataaatgcaaggttgtttgttgttctgggtctgagctatggtgaagaggtggaattggaggcaacacttgaaccctgcttatgcagtatgtatctatgtatctatagctcaatagaagactcctgacatgaggacaaagcttctaagactatattagggttggggcatgaagatacctgtctcttctgctttccaagctgagaggaaaatgtgaaaaaaaaaacatgcaaagtagccaatgtactcagaaggaaaaaagtgggtatcttctgagccctgggta

SEQ ID NO: 36090 - DNA, 2790 bp, Mus musculus
cctttcctatttccaacttcagtgcactgcattggctatcaagttatacagagacagaagtaaaatggatgttgtacacccacacatgtgtctgtgtacacgctcatacatttatctaaaccagtgtccacataacaactccttaaaacatttggtaaaaagcaaaggattccatatatacatacactgtttagatgaccaggtatcttaatctatagtgatacttcagaattgctgtttactataaggctttttcttattcgtaatttaatgaattctgttcagcctaatgtaaaaaaagacttaagtgatatattcaagttttactgagataaaataggaaattattttacatattagaaataattattaaaacgagatacacatttcacttaaaaagttgttcttgggctggtgagatggctcagctggtaagagcacccaactgttcttccaaaggtcctgagttcaaatcccagcaactacatggtggctcacaaccattcataaggaaatctgatgccctcttctggagtgtatgaagacagctacagtgaacttacatataataaataaataaatcggtttttttattttaaattgttcttttaagctaggcatggtactatgcaccaggagccacatcaggaaattgaagtcaggaatttgaggctatcctggacaatataggaagaccctgtctcttaaagctgaaaaagaaagaaagttcttctcttgattcagtatgaattaaatttgttcaaaacacatgtctatcgtgacttgccacataatcatttgtaatgtggtttgatttctcaggaaaggtcctaaactgcctataacgttatggttttaatgttaatgataatttagtatgggagagattattattttttgatttgtaaattagtattagttaatgaatatcttcaattatattacaatagtttgataaactgaggccagtatttcatttagtctttgatagcaaagtaagttatgtgggatcttgcttttaaagttgaaggtatgtcctggactggaaaccagctttggtttggtttgttggtatttcttactttcaagacataggtatgagtgctgttctcaaggggagatggagtacatcctttgaataagtcaggtccgttctaggagatgtggttaaatgtatataaacgtcttgcttctgtgttaattcctatgtttacactgatgctgatggagatgatgaaactcagttacacagacaagcagtgtgtactaatcattaggaagaattgttcttgacatgtatacagcagtgttcaaagcaagttattttgtgatatggagaacattttactccagggaagtaggaatattttcagggtagggataatttccccactaggattttgaaacttttttttttcatatgattgcagatggtcccaaggccactgtagtcattaacctgttatcagctaacaaaacttaaattacctgaaaaagacacttggtgcagaggccataactaagtcttaaagacatctttttaaaaactacatcatccttaggtagttctatagagggaaataatagacagattaagatgaaagaaaagctttctgggatgattcagttataggaaatgccaagaaaagggcatttaattataatatcctaattttacatcacaacattacagaattacacaaaaggataatgtgtgtattttttttaaattagtgttgcaggaatgttcttttaaatgtactaggggatgaataatttgagctctgaaaatagaggaagatgatggggttcatttctcacctctctttattttaaatattaaaaaatatattttcttcctaaaggaattccagtttacaaaagttaacttgaaaccaaggtaatttaggattataaaaacggggccagatgccttcctgatcgctcttaacataggactgtcttggtatgcagatgggcttctttgtgatcagggagagcttcgcatctggacatgaacaagctcaagatatgcattcccttttcctctgcagggatttgcgtcttttatataccttaagagaaacattttgtctttcccctctatgttgacagatctcagtttgagtggatggttgttttttaaaacttgttttgctctaagtgctaggtatttaaaaactgtgtgattccttggttctagagccttttccctgctgccatcttgttgctatccttcctacttgctgaatatgtcaccaagtagcaacctttgctagaatatattcctaatttcctcatcttgtaacttattacagggtattctgttgtgaattagcagtttagagtgtttaaatatgtttgtaattatagtttgtttttaattatagaaaaattccttcttttcccctctatgagtgtattgatttggaatgtaaattgtatgataaatcataacattgagtgaaacactctggataaagctgattaagacaaaacatctcagccaagcatttaccttagcacagttctcttgtttatagcaacctatgcagataatcactactgaataaacataatgtctttgtgcctagaaatgagtgtctggtggaaatcacttttctgcaatgttcatggaagctgatttttgtaccttatacacttgaaataaatacaggtaattactagcactctgggaagatggccttgcggctttatacaaaaggtgaaaacttgacattttttcaaaagcaaagtaaacatttgcagagttcattatgtagataaaat

SEQ ID NO: 36091 - DNA, 1171 bp, Mus musculus
atgatatggtgagggcagtggcaactgggaattccaggcatcgggatgaggatttgtgaaggaaatgtcacaaatagaaagcatgtttaaataataagttttaggttccaattgattagctaggttctaaatggttattgaattttgaatgtaatcctttatttgaaaactttcagaaatactataatctaatattgaaaatatatatatacatatacatacagatagtcatatatatatatatttctgtttttatttttaacaatttcatacatgcatataatgtatttttattttatttacctcccccacccgacttctcttctcatccccttcccactcctgctgacccatttttttcttcaaagttcaattttataaaggatctgtaataaagtttatctatatatcaaatgtaacaaaatttatactagttacataaaagagtatttattcggattcatccatagttactatttttatatatttgtagtattttaataatgaaaaatatgaagcacaaagatatgatggattcctgaagacatatgagactgcttcattgaaaagtacctctactctggcaatgctgaattttggccaaaatgctattttcagtgtcggattaacagctataatggtgcttgccagtcagggaattgtggcaggtaatgggtctatgggtatcacatttagagaatattataaatgggttaatggaaggaataaatgttttgtgttaattgtaaagtgtgttcaacacaatatttagccattttagagtgtttttcttttcctatcagaatgtattttattgataattcttttatttccttttggttaacactgacttactcattgaaagtaagaattctagttacacattttatggctctgtaacctgatgctttaggagaaacatttttttaaaaattaaccatgtaattttatgatacttttaaaaatgtttttattaatttgagatagcaatctttttagtatctaatgtttttaatttttcttatagacctggaaagtaatggcattaatttactgtttagttcaaaggacttgttttataataattaccagcatctttcttgtagttttttcatttacaattaatatctggtgtgacattaatatcattatttttggtcatgagagccat

SEQ ID NO: 36092 - DNA, 1841 bp, Mus musculus
ccgccacagccgccgaccgggagaggcgcgcgccatggcctctggagccgattcaaaaggtgatgatttatcaacagccattctcaaacagaagaaccgacccaatcggttaattgttgatgaagccatcaatgaagataacagcgtggtgtccttgtcccagcccaagatggatgaactgcagttgttccgaggtgacacggtgttgctaaaaggaaagaaaagacgggaagctgtatgcattgttctttctgatgacacgtgttctgatgagaagattcgaatgaatagagttgttcggaataacctccgagttcgcctaggagatgtcatcagcatccagccatgccctgatgtaaagtatggcaaacgtatccacgttctacccatcgatgacacagtggaaggcatcactggcaatctctttgaggtataccttaagccgtacttcctggaagcttatcggcccatccgtaaaggagatatttttcttgtccggggtgggatgcgtgctgtggagttcaaagttgtagagacagatcccagcccttactgtattgttgctccagacacagtgatccactgtgagggggagccaatcaaacgagaggatgaggaggaatccttgaatgaagtaggctatgatgacatcggtggttgcaggaagcagctagctcagataaaggagatggtggagctgccactgagacatcctgcgctcttcaaggcgattggtgtaaagcctcctcggggaatcttgttgtatgggcctcctgggacagggaagaccctgattgctcgagctgtggcaaatgaaactggagccttcttctttctgatcaatggtcctgaaatcatgagcaaattggctggtgagtctgagagcaaccttcgtaaagcctttgaggaagctgaaaagaatgctcctgctatcatcttcatcgatgagcttgatgccattgcacccaaaagagagaaaactcatggggaagtggagcgtcgcatcgtgtctcagttgttgaccctcatggatggcctaaagcagagagcacatgtgatagttatggcagcaaccaatagacccaacagcattgacccagccctacggcgatttggtcgctttgacagagaggtagatattggaatacctgatgctacaggacgtttggagattcttcagatccataccaagaacatgaaactggcagatgatgtggacttggaacaggtagccaatgagactcatggtcatgttggtgctgatttggcagccctatgttcagaggctgctctgcaggccatccggaaaaaaatggacctcattgacctagaagatgagaccattgatgctgaggtcatgaattccctggcagttactatggatgacttccggtgggctttgagtcaaagcaacccatcagcacttcgggaaactgtggtagaggtgccacaagtaacctgggaagatattggaggcctggaggatgtcaaacgtgagcttcaggagttggttcagtaccccgtggaacatccagacaaattcctcaaatttggcatgactccctccaaaggtgttcttttctatggacctcctggctgtgggaaaaccttactggctaaagccattgctaatgaatgccaggccaacttcatctccatcaagggtcctgagctgcttaccatgtggtttggggaatctgaggccaatgtccgggaaatttttgacaaggcacgtgtactcttctttgatgagttagattcaattgccaaggctcgtggtggtaatattggagatggtggtggagctgctgaccgagtcatcaatcagatcttgacagaaa

SEQ ID NO: 36093 - DNA, 3086 bp, Mus musculus
ttaccaaaattttgcagtaataacaattatttttattttttttttgaaggtgccaaatcaatcattcaagaatttccagagatcacaattttaactacagaagtccatcctgttgcacctacacattttggacagaaatactttggaacagactaagttcttaaaggaaaatgaaataccttacataatattatggttataaatggattccatatctgtttttactaatttgtttgagaaaatatgttaggaataccttttaacattggaagtaggtgtagcaacaagaaatattggaagtttatttatttgatttgatcatttcttcacatgtggtaccaaattcaacaatgaagcacaacctcagtgcttaaaaccgatggaaattttaattgtatgctaatagaagtcactgactcttcagttagtccatggagactgtagaacttaggaccccatctcttggtttggaagttgcttgtagctgccaagaaaacccaaatgagagttagttctttggtacactgcaggtttacactgtccttactgtgttttagctctagagtgtttccctgtatgtgggtcttgtcaccctctgtactctatatactatatatatatacacatatacatatatatatatgtacatatatatatgtacacacacacacacacacacacacacacacacacacacacacacacacacacacacacacacatgcaggtaccttgaagaagagagaatgagagtatatcccggaattttatgttgccatttatgtcctcacttaatttgcaggcccaagatgtccgcttaacttgtctgctaagccgttgtattcctcaaggctggctcatttccccaagtgggaattgagggaaggtacttaccaagctgtaacatggtgacaaagacgcagggtcttttcagtaactgaatctgtaacatgagtctacagagactaaaccaccgatgcctgatgctgacccaagagagctcaatcagccttctacaaaggaattggtgtagatttttctaagatgtgggggaaagtagaggctttgcttttcgtggccaataaggaaatcaaaacggttctttggttgttgttgtttttcaaggtagggtttctctgtgttcctcgggctgtcctggaactcactgtgtagaccaggttggccttgaactcatagagatccacctgcttctgcctcccaagttctgggattaaaggcatgcagcacaacacaatatgcaatacggttctttttaatttagttgtttctattacttgcttttggtttggaacttagttattttgcatgtcttatgactatacctgtattaaagtagagaatacataaagtcttttaaaatatataaggtttgtatgtgttcatatttaagcttctgaaaggagaggaaacaattttagaatcaatctttgcacttttgaaatgtgcttataaaacccagattcctgttttacatggatattgtggtggctgggtgattacttgattaattacactctcatggccctgcagagagctgctgtggggctctgttgaaaagtataagaaaaagtacataggaatttcttagaactgaagctgaaaaggtcagtgaagctcaagggaggaaagcaacctggaggaaattgactggactttaccttatggttctagcctactaaacttcactgtactgttgttgttgttgttgtttctttgaggcagagcttctctgtgtagtcctggctatcctgaaacatgctctgaagaccaggctggcctccaactcagagatccaccaacctctgccttccaagtgctaagattaaatgtgtgtgccaccatgcccagctactttgtttttggttgtgagcctagccttcaatggctgagccatctctccagccctatttttgaagactattatgtaataaaattaaaattcatcaaacagttccttccatagtagaatgttgccttcaagttcttcctgaaatttttttgagatagggtctcctggctggcttgtaacacatagacatcatcctgcctcttgagtgctgggattaaagttgtgctgaaagttatatttatatttgatattaggtgtcctaagaatgatgtgagtgcaaattcagatataacggatctgttgacattgttattgcactgaatcagtagaaaagacaatggatgctcactaacatgggtgtggtaggaggatttcaactttgaggctagtgtaagtaactgagtcagatcttgtctcaaaaattttgttttgcccactaacctaagaattgctgtgactcaattgaattggtgcttgtcttggctgcagtattatctttgaatatgagataatttcaaactccactgtagggataaaaccatattttaagcaaactcttttttaaattttgaatcatgtcttcgtacataggctagctttgaacttgctgtgtagtcaactctgatcttgaactcctgttctcactgcctccactgacttctggtatgaaaggcttaccaccagcatgccaatttaaaacaaattatttttctaccattagccatttagattcaaatgtctgttgcttttcagcaataaatgtgattaaaagttaactacatttgattctcacatggaagcttagtataaacagtaggaattattcaataaggtcatattcccttctgatgtttgtaccctacaactcctgcagatataactctggtctctgaattttggaatgctttagcaaacaaattcgtacttgcagggctaatcacttgcaggactctattttctaaagtcaacataagattaacagactattaaaagtaagattgactttagtgacatgaacttcagagcagtataaattgtgcaggttctttattgaaaaatagaagctagagcaaaatgatgtgcaaataacacaaagctgtgattctcaaagtatggcatacatcataattattcccaatgatgtgctacagattgctgaaccccaaatttacagtgtctgatttaatgtcttgatttccaacattgattcttttta

SEQ ID NO: 36094 - DNA, 1221 bp, Mus musculus
aattcaaattatatatactcatgtttgggtcttatatcttgttcttttggcctatatatatgtctggttttgagcccgtaacattgtttttattaatgtatctctgtactacatcttttggcccagaatggtaatctctgcagcacttttctttttgctgacatttgttttggctaccagtagttccatgtgaattttaggctagttttcccaatttatgtgaagaatatgatgggaggtcttgattgagattgcattgaatctgtaaatggcttttggtagaatggttcatttcaaactggtatttctaccaatccatgagcataaggtatccttccattttagtctttctctacctcatcagaaatttaacatattcattatagaggttatccactacattggttaggtttatttctacggattttaattttctttgaggctattggaaatgggagtgtgtcagtaacatcattcttttttaaaagatgtatttattttatgtatatgagtacactatagctgtacagatgattgtgagccttcatgtggttgttgggaattgaatttttaggacctctgcttgctccagttggcctgcttactctgagcaactcgactcgctcagttcctgcttgctccagcccaaagatttatttattattatacataagtacactgtagctgacttcagacacaccagaagagggcattagatctcattacgggtagttgtgagccaccagatgattgctgggatttgaactcaggacctttagaagagcagtcagtattcttacccgctgagccatctcaccagccccctataacatcattctttgtgtgtttgtcagtggtgtatataggaaagctaatgacttttgtaagttgattatgtatccttccatattgctgaatttgttatttctagaaattttctggtaagactttgagaccctctaatgtatgatatcatgtcttctgcaaatagggacaattagacttacattcctttaatttccttctcctgccttcttgctccagctagtgcttcaagcacagtattgaaaaggagtggggatatccctgtctcattcctcacttcagtgggattgcttcaaaatgagaattatggtggctgcggggttctcatatatatagcttttattatctgttgtatgttcccttttatcctgctctctctaggatttttatcataaa

SEQ ID NO: 36095 - DNA, 5185 bp, Mus musculus
ctgtacacagccccctttggttcagtgatgcccttgtgcaagtggaggactcaaacggacatctttctagctagcaagagaagctactctggccataatagcttaaacacccttagtggagtctcttaattcattattgcttgataccctgtttcttggctttaactgttgttgaaataaggcattttgtaaataaattccttttggtttattttactaatgactgatcttagaaagtatttacatttatttgatacttcacaatgtcaggtatataatctcatcacagtatctcatataaaactctctattaattcttctccctgttctcagtagtgaaattctcttaacctgttagcttgtacctggtatcaggattaaaagtctatataagaatagactcttagccagacttaagtgactcatacttgtaattccaatacctgagaggctgaggtaagagagttccatgactttgaggttagtgtgacctacagagtgagaccctgtctcaaaaatgaattgtttaaaaaaaaatggctttttcctttgtggtgactatagctctctgatttcctttactgttttggaaggatatgtatacctggaacagcagcctgaacggtcaggttagagagtgcagcccattcattagagaagagcaagggcctttacttccttttagagcattgttgtcatttgtttattggttggttggttggttggtttttctgagatggagtctcaccttatagaccattctggcccagtaccagtactcactatgtaggtcagactagcttcatactcacaatcctgccttgttcatcctctcatagctacgttgttaacctgaaacttagccagtagcaataaatgctaatatagtacttataatgtgatatatgactgagaaagtggtttcccatatataatgttatagacaagagcatatatttatatttgacatataaacatttgttgatttgaaatgggagggaggtgtttccttctcaggtgaagctgttcagagtgaagaaagacttcagttatctactcaggttcgtgtgcatctacaacagagtttgatcactgaaagttaaaggaaaccacaacccttgcggtgcatacagacaatactctctcaagcggaactataacattcttgtgtaagaaaggatttattgccaggtggggacctgggaggcagaggcaggtgaatatctgagtttgaggctaccctggtctacatatagagtgagtaagggcttcacagcaaagccctgcctcataaatatacagttctatttgaggataaatgtattgaatactaggaaaataacactttcaatgcttttattggaaaattcttaagagtatttcaaacatttattaaaactttccttttataaaaatgtatagctttgaaagagttggagagtcccttgtatttcatactagccaggctgttaaaaaaaaatctatactgtgtaattttctttagttgcatgtcaatatatattatcttagaagttgaggaagaaaaagtattgaccacatataattgcagttccatcacagagcctgaagcagcctgcacaggtctgcaccaggtcctgtgtggatttattatgatttccaggttaggattttatgggatttcttagtatgagactaagtgggtctcgatttcttccacttttttttgagctctttttcttctctttgttttgtccaattccaatgtgttagtttttattttatcctttttatttttattagtattccttaaaagcctgttttctaatgagagacagaaaaggggtgaatccacatgggaggggaggtgggatgagggaaggggaaccataatcaggatgtattatgtgaaaaagaatctattttcaataaaaggaaaaaaatagctctttccaggttgttcactgactggacaactagcttaatgactgtttagatttacagaggataagaaacatgacaatcggagtgtcttgaagtaaataataggaaatgaaaaggaataactacagagtatgcaggtggactctacgaggcaggagccagcttagaggggaacagtgagcagagtggttctctgatgctttaaatgagtcataagatgatttcaggattctcccctagccatggacggtcctgtgtaactccctgctgtttagtgtggccaaagcctgtgaatatgaagaaactttattcctaagttggggatgatttggtttttaattagtcaaaggaaacaccatcttagataggtccttcccaatagatgagtccttaaaagggtcaagccagagctccaggcatcctgttgtggaaacaaacagccatgctttgagaggaaagggtcatatggaagactgaaggggacatttttcctctggctgatggccctcaagaaaatggtatcaaaattaagttctaaggaacttacttctgtttactagtgagctgaaggtatggtttgggccctgggaaccccagaacagaggatctagttaagctatccctgtactctttttttttttgtttgtttgtttagttgggttttgggtttttttcttttttttggttgtttggtttctctatatagccttggctgtcctggaactcactttgtagaccaggctggcctcaaaactcagtaatccacctgcctctgcctcccaagtgctgggactaaaggcgtgcgtcatcgcccggctacatgttttatcattcatgtagtttagaatttctaaagcatggtggtaatttaagcagactagggttttattagttttgatgatggctctggcacttggcttcataggaacatgcccagagcctgagttctctggggttggacaagcctggaacttgactttatggtggcaagtctgaaggactcctgtctggagcctggatctctacaggtcagagactactggggtggtgtggacccttagatattttggaatttggggccagcctaactagggtagagcctgaagcatagatccctaagagacattttggagtctggtctgtgaatgccagcctaacacgttacctatagaggctggatcttttggactggcctgagcattctggtcactgcagctagcctgtgttcaacgtgtgactggaggccatgttcttcagggcagacctagaatctgagttcatgtagacaaactagataccaaggactggcctcgtcagtggctttgctgaaatgagtctggaccccgagtcctctccagtatggagctctgaggactactgtggatcctgggaaagtaagagctggtatatgtggcaaccagcctggaaactgggtctccatcataatggcctgtgctagtttagagtgtggggctgcaaaggctatcctgatgttgagttgaacctgtactgggaataggatgcaaatctgacactgaggttggcctacagtctaagactatggaatctggtttgtcagtggtctaggcctggtctgggatccaagatgggcctgaaacatgagtgtgcaggatttagctagagcttctttcatggggctctaaggcctgcctggctttgcgtctcatcgctcctatgctgtttgagtagcccatgcgaagtcaagctgtgcttcctttttttttttttttttaatttatttttttatactccatatttcattctccaccgccccacatctaccctctgctccacatcccacacctcctccccactccaccccatctccatacggatgtcccctcctaccaccccacctgacctctaaactccctggggtctccagtctcttgagggttaggtgtctattctctgactgagaccaaatgaggcaggcctctgctgtatatgtgttgggggcctcatatcagctggtgtatgctgtctgtttggtggtccagtatctgagagatctcaggggtccagattaattgagactggtgatcctcctacaggatcgcccttctcctcagcttctataatatatctttttttttaagagattgggtattttttatttttattatttaatgcatatgaatacactgtcattgacacatcagagagggcattgtatcccattacagatgcctttgagccactatgtggttgctgggaattgaactcaggacctctggaagagctaccagtgctcttgacaactgagccatctttccagccctaatacatctttttttatttccgtacctgagccaggtgctgcatgctgccacctgaattactgagcacttgcaaaaaatactttgatatgtgaatagtagttgaatgtgatgtttctgggacggtaggaacattgaaaagtcctattcagccatcttgctgtggtaactcatataaacttttaataggtttccttgaggttagattttctattttgctttatagatcaagtatatgaagcaacatgaactacataaatatatatatatatatacatatatatatatatgggggaatgtaattctcttctattatagaagtaatgtttagattgtgggtattttattcagcaaaaaagttgttgctagagactaaaggaaaagtctagaaatgtatcttctgggtttgattctcaaccagtcaccttgtaatccatctctaaaaggctttgaatttgtgctgatccttctgcctcaggtttccaggtgctaggattgcaagtttttctatgtatagccctggctgtcctgtactaactctgtagagcacctgcttctccctcccgagagctaggataaaaagtgtccaccaccatgccgagcctgattgtgatatttttacataatggaaataattttactaactttcagtaactagaaaagaggcacacatttattgagtcactactatacacagaatctttgtactttgctatttcattcagagttaggataatcctaaaagggatgtcttaccttatttttatttcctctttgtagtgagaatataaattatttagtcagtatggaaagagtagtgtggaggacctcaaaatgtggaagtagaaacatgcgatcctggtatactgctatcgggtgtatacccacaggagtctcagccagcagcctgtaggtgagacacttgcacatccatctttattgcagcattatttacagtagcc

SEQ ID NO: 36096 - DNA, 1159 bp, Mus musculus
acgggtgcgccaaaccaccagttgtgtgctgggttttgctatatagactgtgttttatcaggacactgtgtggaaataaggtatgatcttaggcttggtgaggaaaaccagaggggaggggttggcagaagaaaactgctgtcctctgtaggaaaaggcagcagtatattatcatgatagtgatgaagataatttatgcgctctgtgtgtgtgtgtgtgtccagctatttaaaaaatttttttaaaaatatcaggcatgattgttattgtctgcagtcctagaacttgctcagatttttttccataactacttaaaatgtggaatcaagccaaaaggaggctacccagctgtatggcctgcatctagttaggagcaagtttcaataactggagctgaaaaggagtaattggtattcacatgagatatctccctctctatttggctttcctaatttttcaagattgcagtatattgttattaacaatgctcatcatgttgtataatagatcccttaaacttatccttttatgtatttgcaattgtgtgtcatcattgtccatcctttctccaggcccccttactgcctgacccctgctaaccacccttccactttctacttctgtgggttcagctgatgtgatgtaaaagtctggaggcctgctacctcatataaggcctcatagcagactgttcaaatggccagtataaattgctagctaaagtcagagtttcctcagtcggctaggttggaatgtgctgtgtagcatggtcatgtggaaagtccaaaggaggctgaattcagcccatctggtttcttttcacaagggtcttctatactagtattgatttgtgcctgctctggatttaataaaaactcatgagaagtgaactcagagtcaaatgtggcctgttagttctgataaacaatactctgtttggttcaaatcacagttactgcagaccatgtactatcccactcttaggccaaacaaaccattcacagccaaggctctgcttaacttgtgagcctagagatgagaggaaaggtgacagaaggctctgagagacaaagaggagctagctcacttagatgacacctgttaaaccagtaggcaaattccactgcttttttttttttttttttttttttagttagag

SEQ ID NO: 36097 - DNA, 1217 bp, Mus musculus
actcagactttgggactttgaaaaaggccagtggtttacctatccaggaagttagaccctgttgccagcaggtggttttcttgcctgaaagctattgctgctatataacactgtttttcaaggatgctgataagctcactctgggacagcaaatagctgtagtggcaccccacactcttgaaagcattatccaaaagccccctgactggatgactaccaacgctcctgtgacacatcagaactttttgttgactgaacgagtgaccttcgcttcattccacttgctgtcccactgcgtgagactgcacctactcatcactgtgctgagaaactggtacttaaaatgatctgaaggatcagatcagccttggcctgagagttcaaactggtacactgatggcagtagcctctcggttaaaggtaagcagaaggcggggacagcagtacggtggtgaacagaaagcaagtgatctaggccagcagactccctgaagggatgtcggcccagaaagctgaacttgtgactttgagacaagctctatgaatggcaaaagaaaagtctacactgacagcaggtatgcttttgccactgtacggggcaatatacaaagagggctgttgacatctgcagagaaagacctaagatgctgtggctaaagaaaatcagatggcagatctaacagccaaacaggtggcccaggtagcaatgatcctaggcagtcaaggaacctaaagattattatgacatcagggagaccagctttagattactgctgagcactatcaagttatggacagtatttgacccacctgggggccaagaaattaaaaggtgtggttaggtcctttgactactatgttacaggactctctgacttggcagaagaaatagtcaaaagctgcaaggcctgtggtatgacaaggtagaatttctaaaagaaatcttcccaaggaaattgggtccaataacggacctgtcttttgttgcccaggtaaaccaggaactggccaagatattggagattaattagaagttacattgtgcatgcaggccccaaagctcaggacaggtagagaaaataaatagaaccattaagagacccttaccaaattgacagcggagactggcgctaatgattggatagctctcctaccctttatgctcttcagggataaaaacacccctggacagtttagactgacccccctataaatta

SEQ ID NO: 36098 - DNA, 1242 bp, Mus musculus
atgctcagttggtctctgaccttcccttggcagtggaaaagatgttaacaattagaaaaaaaatagcctggagtatacatacagaaatttagatgttggttccttcatgggactgagagatgagtgtttctcttgacctgaggtacattttcaccccaggcatgggatttcctataggtagtctaactccgagaggcgcttacaatgttagcgtgacacaagtcatagttctttgagaggagggaacttcaactgataaaatgcctccataagatcgggctgttggagtctggctagcagtgagcttgaaggctctggctttaacgttgggcacatggtaactaatgctattatttctacagtctccaaagaaagttggcgatgacattgccaaggctaccagtgactggaaaggtctcagaattacagtgaaactgaccatccagaacagacaggcccagatcgaggtggtgccctctgcctctgccctaatcatcaaagccaccaaagagctaccaagagacaggaagaagcagaagaacattaaacacagtgggaacattacttttgatgagattgtcaacattgcccggcagatgagacaccggtcttttgctagagaactttctggaactaccaaggagatcctgggtactgcacagtctgtgggctgcaatgtggatggccgacaccctcatgacatcatagatgacatcaacagtggtgcagtggagtgcccagctagttaagaagcaacaagaaaatatttcaataaaagactatctgataaccagaaaaaaaaatcaggctgttgggccagcctgtagaaagagcatttttaaattactgatccactggggagggccaagcacattgtgggtggtgccatctctggcctggtggtcctgggttctataagaaagcatgctgggcaaccatggagaacaagctcgtaaggagcacccctccatggcctctgcatcagctcctgcctccaggttccttccctgtttgagttcttatcctgactttctttgatgataaacagtgatatggaagtgtaagccaaataaacccatttcccctccaagttactttggtcatggtatttcatcacagcaatagtaaccctaactaaaacagtcactctgtctcaggaaactttttgagacatgttctctttatgtaggccagctcttgtattttggtaaattacagctattatacaaggtgtctcattct

SEQ ID NO: 36099 - DNA, 3051 bp, Mus musculus
ccaccacccttacagcgtgcaccgccccccacagtgagaagcaaaaatccaggaccttccccagggaaatcaatgtgattttgcactaaaagtttaaaggattattaaaatcatagaaagatcttttatttttttaggaatcaatgacttaacagaactcaactgtataaatagtttggaccccttaaatgccaatcttccatattagttgaaattttttttaactatagggcataccatttctctctgacatttgtcagtgaagttgcctacaatcttcttacacacattgagtacagaagatatttcaaattgttttcagtgaaaacaaatccttccataacagtaacagttccacagatttcctctctaaatttttatgcctgcttttagcaaccatgaaattgtcataaaattaatggatttagaaattaataaagatttatatatccgctcttataaaaacacagctgagttcttagagttgattcctcaagttataaaatacttttgtactaattccatttcttgattagagtgattgaaatggtcttaatattcttttgactgaagtttgaaactgggctcctactaaatattgtctctgtgattaaaagttagatctcaggcttctcttagacacagaagcgtgtgcaatattcttaaatactactactctaaagttgggggagccttgcatttatcttagccttaagtacagtctaagacaagaaaattccttttcttatttagtctttctgccatttttaattttcagttgtatgtgctgaaataactactggtaagatttcagggttgtgaattatcctctgcatatgagtttcctgtctcctggcactaatggaagtccaatctgtcagccatggtgccagtgctggtgcttcatcctgttgctggcagtgggatgcaaactaagaaaatcaagttagagctcttgaaattgtggtttttaggctcacaccctgtttttataaacaacatcaaaatggcagaacctttgctgactttaagttcatatgaggaatgtgcttaaatcctctccagtactgtcagtattgtggaagaattcctcttacagataaggatcactggcatctctgctcttctttgcactcgtcaccctcttccctcttccaagttcctttacagtttagtcaattgttttcaagtttgatccgagttgggttccctttcttttgattgttcttcctcctctcctctccctcctcttcttcctcttagataaagttatttcacttaatactcttaagagaatttttttttcttttctagaaaaatcagtgtatttctttttctagatccaggtttgtttaaaacaacctataatttcacttatgttcaatctgattgttttaagtttcttcaataagaagattgtgtttgactatgggagtcaactcattatggcaatatcatttttgaaatcatgatgtaaaacaagtagtagaaacagctaaagaaaagctgggtggagtgtttgttctaggcatcactggacttgattgagattgaattgaacatgagcttaaaacttgttatttgttgtttggataataaaagatttccatttttatcttgtaagaactagtggttaaagtacccacacacgctgggtttttgatcaagaataagtgaagtgtggtggctctactttcccatgataaaacacactcatgagctctatgtattttgatattgtgccagccatataagcaagcttatttaatgaggggggtgggccagatgtgcgtttactttggaagaaatgaaagaagcaagacttgtgagataaatatttgaaagcagtatgctctggccaactgttatcagaatacttttaaactgatttactagacatgggaatttttatatggtctaattatttactcaaaggcatagatgtgaaaattttaggcaacattatagtccattttcacaatggatgaagctataacttgaaaaatagtaattagaaggattaattggaaattggagagtttgagatagaccttggaccacttgcatacactcttctcacttgatattttagcaacataatatatgtactttgagtataacatcaagttttaacaaataaagacaaaaaaaatcacataagatactaaaagtctcattttatatttgttttagatgttttaaatagttgcaatggcttaaatgacgatttaaaatgttgcttgtaatacagttttgcctgctaaattctccacattttgtaagctgttttctttctttgggtgtaaagcgtttggcctagaattgtgatattgtatctgttttgtcccggttgtatagtaatgtttcagtccatcatccagctttggctgctaaaatcatacagctgtgaagacttgcctttatttctgttagactgctttttggttctgtattgagtatcttaagtactgtagaaaagatgtcacttctttaaggctgttttgtaatatatatataaggactggaattgtgtttttaaagaaaagcattcaagtatgacaatatactatctgtgttttcaccattcaaagtgctgtttagtagttgaaactttattaaatgacataagtgaccaaaatgtgttgtgctctttattgcattttcccagctttgaaaaatctgtgcacatattgtttcataggaaattatagattttgatgtcctgtctaatggtggttcttttgcacatttggttgtttactgtttgggaggtcaagaagtttggttttgaatctgttatacactaaattctgtaaaaggagatctctaacctcaaaaagaatttacataccaggaagacttgtgtgtgttgttttggttgtctctgtgtaaatccagcatcattccctgcttctccacagctctgccattcatcttaagtcaggcagggccactttccacccttgttttgagtaattactgcccagaagccctaggcatggagaccatagtacctgatccctaaagaagtcaaaaacagttttttagact

SEQ ID NO: 36100 - DNA, 1193 bp, Mus musculus
tggcatctactactaagtttataattgaaatatgaagtttaataccagttgttacttctctgcctcttttattataagtttagtcattttttttaataaaacaaagtctagtattattgatgcatacaggttttctgatagaaaaattcttattacttatctgaataagaatagagtaccaggctgggcagtggtagtgcatgcacgtgagttccaggacagccagagaaatccagtgttgggaaaataatagaataccagaaaataccacaaatttaagggaaattattttagttctaccgtagtttgtaggtaattaaacgctcgtatctggtgtttgctgggataattgatgccaggtataaggaacagctggattgcatcttgtctttattttagatcttctgctaaatacccttttggaggtaaatcttgggttttttttctcctttatttcttaaaaatgtatttgctagtaggggggagacagcccagtttatgagtaggcatctggacaacttgcaggagttggactggactgcaggtacctttgctgactgaactatcttactagcccctctgtttcttttgagacagccttgtccctctttagttgagactgctgtggaagtctcacaaattccagccttccccctgtcttagtctctatagtgctgagatggcagagctgtattaccacaccgggctcctagggaatacttttaagcaagctttgtgatcctcacaattctcaagaaataacagtgtccacaccccatgaagtaactgcaccaatgttcactgctagtttcctttagatagttgttagaataataccacttggtaaattcatttctctgaaaacaatataattttagaaggaagcatcatatgatgtctttataagatcaaagcttgacatatgaatgaaaacattcaggggacaaaggaaacaatctgagctacactgtgggagaaacagaatttgaggcttgagtttcctttgagatgaattgtaccagttgtcagaatactaacagtaattactaaagactaatactcgcttcagtgaatctgtatggacttgtcagagaatgaatattcttcccaataactaaggattttgtctccccgtttcttaaacactatatgagaagagctatcttttaaccatctaatgtttctgtagtatt

SEQ ID NO: 36101 - DNA, 1203 bp, Mus musculus
attgtggccttaaagttctgatctttctgtgtctgcctcccaggtggagccataattgtgtgcatgcaacctgtaccaatttggttttatttcataccaaggatccagggctccatgcattctgccagctaaactacatctccaacttgtagtttgactattcagaatgtctagttatggagtcctggcctggcctggaccatgtaattgccctcctgatgctgggattataggcatgtactattccacttggcctatcacccacctaattttttttaattaaatttagttattgtgtgtgtaggtgcttgggcatgtgagtggaggtcagaggacaacttgggggacagctttcttcttctacctcatgggtcctggggaagaaaatcaggttgtcaagctttttggcgggaacctttaccccttcagtcatcttgcttttaagtggtactcaagaatgaaaaaatctacaattatgaaagagcaacacatgaaattcctctgagttttcttactctactttcaggtgaaggaaagtggatccgaaatattgactattaccgcttggatggttctactaatgcacagtcaaggaagaagtgggctgaagaatttaatgatgaaaccaatgtgaggtatgaaacattttctgtatgtatagatatttttcaatttaggttcagtaaaattagctttttaatgtatttttaataatatttaatgaatgatgcaatcaaggccaaaaccaggtgaatttacaaccttcaccctaaaatctttactcacggacattgtagtcatgtcagtctcacatctatcacttactaaatgtatttgagcagacatggtagcatatgctttaattccatccagcatttgggaggcagaagcaagtggatctttttaaggtcagtgccagcctggtctacatagtaagttgcactccagcctgggcagcactgtaagattctgtctcgaaaatatttgtgattcatgcttcttttcatttttgagttctagggcatcatagccattaacttctcaaggtcatttgaactgttcccagttttggaattaaaattaaagctattctgaatgttcttgttcaagcttttgtcatcactagtattttccttatggtgaaaatgtctgaggatcttaaatgctggtttgtgtgatactcctgatgtttatctacctgtg

SEQ ID NO: 36102 - DNA, 1167 bp, Mus musculus
aatcatttctggaatcctagcatttgagacgtggaggcagggagatcatatgagtatctcaagcacaaagggggtgttgtatagcaaggtagatcagtgagtggaagctgttactgtgtgtgcctattgatttgagttcagtgtctggaacccatgctacaaggtgacagtcgattccagaatcagtttgagatgccatgatttattttattttgaaatttcatcttatctttttaaagagagagagtgtgggaggatgggggtagagaatgagcagaaatgaatgtgtgtgtgtgtgtgtgtgtgtgtgtgtgtgtgtgtgtgtgtgtgtgtgtgtgtagaggaagaaaactttggcagttttcttccaccattgggttgctgactggtgtagagctcaggaatttgcaacagggtctgagcactctgacatgttgaatcatctctctggcccccttttattttataaaatagcatgtagattagtccgaatattgttggaaactggaggctagcataggattccaatatatctctgcctttatccattacttttgatgttcttcaacattgtctctgactcgtagtggttgtcttggccaacaatttattaactaattcatttaactcacaagcacattctacctttgctgcctcttcttgaatttttgttttcttaatcaccagagacattgcctctcttaaataagaaggcagatctaagaggaggcacccaaaacatttagaaacaagacttagtgttatatgacagagaatggaggtgaagagacaggtcaccataaaatcaaggaaggtttttgtgtggttttttttttttttttggtaacttaaaaaaaaattattaggtattttcctaatttacatttctaatgctatcccaaaagccccccataccttcccccccactcccacttcttggccctggcgttcccctgtactggggcatataaagtttgcaagaccgatgggactctctttccaacgatggccgactaggccatcttctgatacatatgcagctagagacacgagccctggggagtactggttagttcatattgttgttccacctatagggttgcagattcctttagctccttgggtactttttctagctcctccattggaaaaagtccaatgagaagc

SEQ ID NO: 36103 - DNA, 1147 bp, Mus musculus
actgggtttaacattatatttacgttacttgtattttctgtgtgttggaaattatgatctttagttggctggcttagtgtttaatgtaaaaataagtcatgattccttaattttatttttaaatttttttgtggatatttaaatgaacatgtaactttactttcttataggtggttagttttcttcacacagttcttctgtgtgacaaattggatttcagtacagctttagtggtttgtcctcttaacactgctttgaattggatgaatgaatttgagaagtggcaggagggattaaatgataatgaaaaacttgaggtaacatttaataatgtttcctattgaaacaatagcatgagattcatattcatactgaaagaattgtcttaattactaatgcacattttaatggtaatatttagaactttatttttaaaggtatctgagttagcaactgtgaaacgtcctcaggagagaagttatatgctacagagatggcaagaagatggtggtgttatgatcatagggtatgaaatgtacagaaatctcgctcaaggaagaaatgtgaaaagtcggaaacttaaagacatatttaataaagctttagttgacccaggtatgttactactagttctgactttacgaagctagttgaaattttatgtttatctttaagagtttctaattgagccaggcattctggctggcacacacctttaatccgagcactgtggaagcagaggtgggccaatatctgagtttgatgccatcctggtctactgaacaaggttcaggacagctagagctacacagagaaaccctgtgttaaacagacaaaaacattacaaataattggacatttattaagtacttgctaacagtctcctttgtccttgagattttattattcatactgataatttaaataatataaaactatccttaatgcttctagctgttccgagtttcagtgtttggggatctatggttgatgtattattagagaattgtaaactcctgaatggtatcaagcatttcagcagatttttttttgtcacaagatttcttggggacactttcaaacaatagtcttaaaaaccaggcgctggacaggcagacagctactcagctgcttaagcttgcccaca

SEQ ID NO: 36104 - DNA, 1106 bp, Mus musculus
aattcacacattatctctttgaatttcattcaggaattatatttgatttgattttatttaactttaaaacttgtggaaagtgtcttgtttgtttgtttgtttgtttgtttcttgatttttttttttttttttagtcccacagtccttaatggcttattttctttttaattgttttgatgatgaaatcaccattcaaatgtttgtttttggtatgcatacaagttgtgattgttgggccatacaaataattacatgttaaaggattttcctctacgttttctatattggttacatcaattagcattcttaaaagcagtgtaccacctcacatttacttttatacatttttttttacttgataacagcaggtataatgaatataaaatgatatcatattgcagtcttgaattttatttttcagtgacccgcagttattttcatgtttttgttatttatttgtgtaggtttcaaaaataaatacccttttgactcctttgccctgattgttttcctttgtcaaggtttattgagttttcggatatggctttgtttctagatataattaataacgcttttctccctcctcttggcccattccataagcagcaggaagttcatgcagcacgtttgtactctttgcttctgtgcttacatttcacagagccattctgaggaggacaagaaggaaggtgatgaggaggacgaggaggacgaggacgaagacgaggaagatgaaaatgatgattccaagtcacctggaaaaggcagaaagaaaattcggaagattcttaaagatgataaactaagaacagaaacacagaatgcccttaaagaagaggaagaaaggcgaaaacgtattgcagagagggaacgtgaaagggagaaattgagagaggtaaaccaacctttcagttgctatataacttccatagacatgtgtcatagatgcatacagattttcaagagttgaatgccttaataaactacagatttctaggtaaaattcttttacaccattgctagtatgctttgcttcttagtccatgtataattaggtacttggaaacacttgagactcttgtatgatcaccagaattattggagta

SEQ ID NO: 36105 - DNA, 1217 bp, Mus musculus
catatacttaagattaggaaattgctttcaaactaagaatcagttgagaagttatctagacagattcatattctaatctttatttcccaaataaaatggacgtaggtaatatgacattattaacttcacgaagacttaaacagttgattgaaatgtaaacaatgaagcctatatagttttaatctaagggatggctgagagaaggaaagaaagacacccctgtcatagcatgtcaacatggttttatatacattttaatcatttcccatcctttaggatagtagtcataatactcagtgagaagatagcatgatatgtatagtgaatggacagcttctagtcttttaataattgtatgatctcaggctggtgactttaacttcttttgccataattttaatctctaatattgaaaatttgatagtattttctcttatcctggtaccaaaatacgtgatagcctggagatgatcttagcaaagaacactaaaatggccatctgtcttaatagaaagctctagttttaagaaactaaaaattatatgtgtttgctgtcatcattttgtgagagatgaaccaagtgctctaagcacatctgttctctgaccttatttgatgttgtgctgataccaacaggtttctgttagtagacaggataggcgaactagggtgaaaggtcatatttattttgtacttaattagagctcatgtgtaaacccaaagacttttcttctgctttcctatttacttttttttttctcaacaaatgtctgtctaagctatttgatgggataatatagtaagtcctacattggaatgttcaaagcatacaatgtttagtcagggattttcgtataccatcattgctagataatggaagcatttacaacttatttgtcttttagaatgctttcgtttttcacttatataagctgctgtttcctatgaatcacaagtcttccaatgtcactaggtgttactcctactttttgaactatggaagatgatcttttatatttagccaacaactaagcatgttgtcaaggtacaattttggtatcacttatcaaaaattaagtaacagttttacttttaaaatgagtggattctatatatctctctgtaactgatatctattttattggataatttcgttaattcaattttgtatttgtgtggttttttaaatgcaaccctggtggttattttggagagga

SEQ ID NO: 36106 - DNA, 1574 bp, Mus musculus
gttgttggttgtcttttgccacaaacccttgtttagttttacatttcggataaaagtaagcagaccatgtaaattactactttaaagatgctcgtaggaaattttaaattcttttatcatcaaagacatgaaaattcctttcactagaaataacatttgaatccttaaaccatttcagatggtgtgcagaaggtgggaacttgatttgttgtgacttttgtcataacgccttctgtaagaaatgcatcctgcgcaaccttggtcgaaaggagttgtctacaataatggatgaaaacaatcagtggtattgctatatttgtcaaccagagcctctactggacttggtgactgcgtgcaacagcgtatttgagaatttagaacagttgttgcaacagaataagaagaagataaaagttgacagtgaaaagactagtaaagtctgtgaccaaacatccaaattttctccaaagaagagtagttctagttgtaatggagaagaaaaaaagttagaggagtcctgttctggttctgtaagctccacttactctcactcagcactatctgtgcccaaagagatgattaagaagacaacaaaactgattgagactacatccaacatgaactccagttacattaagtttctaaaacaggcagcagataattcagaaatgacttctgctatgaagttatgtcaacttaagtcttttaaatctgtgttggatgatatcaagaaggctcatcttgcattagaagaagatttgaattcagagatccaagctttggatgatgtacacaaagaaaaaaataccaaagaccttaaaagcacagatgctaagtctgaaacaaaattaggaaaaggggaaaaatcctattctacagaaaagagagagtttttaaagttagatgctagatcatcagtaaaggccatagatggtgaagagcagagagcacacaaaagtactagtggggaacataagggttcaggtaggaaagatggctctcagtatgaacccactaacactcctgaggatttagatatggatattgtgtctgttccttcctcggttccagaagacatttttgatagccttgagagtgctatggaagttcagagttcagctgattatcaaggagacggcaacagtgggactgagccagaactggagagctcctctgtaaaattaaatgtttcttcaaaagacagcagaggaaatattaagtcaaaagtcacagcgaaagtaagaaaagaattatttgttaaacttaccccagtttccctttctaattccccaattaaaggtgttgactgtcaggaagtgtcacaagagaagaatggccgtaaaagttctggggtggcccgcagctcagagaaatgtagacccagagaggaaattagtgatcatgaaaacaatgtcacaatacttttagaagactccgatcttcgaagatccccacgtgtaaaaactacaccgttgaggcgacagacagaaagcaaccctgcaatgtcgaattcagatgaagaaagtaatggaactatgaaggagaaacaaaagatgtcaggtccaataagaaaa

SEQ ID NO: 36107 - DNA, 1232 bp, Mus musculus
tttaaaaaaaataatgttatttatttttattttctgtgcattggtgttttgtattaagtcttcgtgcgggcatcttatcccctggactggagttacacagttgtgagctgtcttttgagtgctgggaattgaacctgggccctttggaagagaggccaatgctctttttctttctttcttttttttttttaagatttatttatttattaattatatgtaagtacactgtagctgtcttcagacactccagaagagggagtcagatctccttatggatggttgtgagccaccatgtggttgctgggatttgaactcaggaccttcggaagagcagttgggtgctcttacccactgagccatctcaccagccctgaggccaatgctcttaattggtgagctatctctccagatccccgcttccaacttctgttttagttgctgttctgttgttgtgaagaggccctatgaccacagaaactcttagaaaagaaaatctttagttgggagcttgtttacggtttcagaggtttagcgtggtctgagtatggctgaactccatagcaatagcttagagctacattgtgatctgtaggcagggagggagagacagacacacagagattggctgggcctggcatgggctttagaaacctcaaagcccacaatccagagatgctacacctactcctcaaatagtcacttcctaattaaacattccaatatgtgagcctttgtgagccattcttattcagatcacaaggccagaagaggctgttggggtcccttgaagctagatttacaggcagctgtgaactgaactctggttttctacaggagctcttaagtgctgagccatctctccagacccaatttgtatattgattttcagaatactacttcatcttccccattttgcagaggaggaaacagaatgtgatagaaattttagagcttgtaattgtgttttgttctttctttttggttgagaaaaggtctcagtatgtggcccacgatggccttgaactctgttggtagtcccaattcagcttcccaagtgctaggattgtaggtatggactaccactcctgactccaggaattgaattcctttaattaaagttgtgtgtgtgtctgcctgtggcagccagaatctggatcccgtggaattggagttataggtaattgtaagctgtgacaaaggtactgggaaactagagccctctgaaagcgacc

SEQ ID NO: 36108 - DNA, 1171 bp, Mus musculus
ggccgggcccggaaggtacctctagaaggtgccttttcgccccccgactccagatcctggagggttatcttggggacccctgggcggctgagacggagagcgggcagcccaatgcgggcttttgctttctgagaacagcggccgacgactttgcaggagaagtccggtttttgacgggacatcggttgttgttaccccctgcggtttgggacacgttccgtgaagtagttagatcgtgcttttatttatttgttccacgaggcatgtggagcgggttaacggggattcaccagaagatttattgcaaaggtagaagagagcccaggcccgatgttagcgatcaaatacgtttacgattcaggctgtttttccacgcgtttctgatttgctttttgattgtttggagtagttaatctgaaatggattccgcttttatgcagataccttgcttttttaggcagtttgatatttgaccttttatcccaagattgaattcggtgatttttcttctcgaatgagatgcaagcttggtgaatagtggcaaaacgaaattataggtagcgtggatcataattgcatctgtaattggcaaaatgtgccgttgggtgactaggacatcatggctttgagcactttagattgtagaatttgagaacgagcctatccgattattttctaccttagcaaacagtgcatcgatgctctctttacttagggaaaatatacttcagttctgtttgtttgtttgtttgtttgtttttcgagacagggtttctctgtgtagccctggctgtcctggaactcactctgtagaccaggctggcctcgaattaagaaatccgcctgcctctgcctcccaagtgctgggattaaaggcgtgcgccaccacgcccggcttatacttcagttcttaaaatacaggcacttagttgtgtaaagatcattgtcttcctttatgaatttgtgttaactgacccaagtaaaacaaatctttttttttttaaatggaatattgagcagtattggctggttaataccaggcattcatgctcatttacttacagttcagtatgacttctaggttttacttcatgtcttagttgtctgtatttaaaaccatagttgcttctttgtggatggtgaagctggatactgaaggatttgaaaccag

SEQ ID NO: 36109 - DNA, 3685 bp, Mus musculus
agagactaatatactgatatatattttatttcagctttctgatgagttaaagaggattccagagaaacattgacactggtaatggaaactgaaaaataaaaactatttggtgtttgaagaatgcaactcacatattttatattacctctttttgtcaagtgatctaagtagttaatcattaaaccaaagatgtgtagtgccttaacaagcagttgtaaagatcatgaagtgtttggaattgtgctcctcctaaccttcccttcccaatgaacttaggaaacatttggggtttgtagtattaagtactttataaacatttaaaactactacttcattttacttagagaaaaactcaaaactactatagttaacttgattttatctcatctaaggttggggatggaaggttctgagcaggaatctccacctctgcctattgcaaacaactgcatctggaagccattgttccttttccttctttgtgcagatgtgtgtgctttacagacctttcctcttgggcccaggtatcatatacactgtgtcatctgaaaatggaccgtgtcgcctttggaaagatacatgtcttcctgtgtctttccacctgaaatcagctacatatatgcctccttttacacattcagaagtacctctaactaaagactatgatttgtgcatgagtgtgctataactaccttgtacatggaaagatttctcattctgtttctagttttatttaaagtagcccttctctaacaataatagtttcttgctaaaaatcagtataacttataaatggtctcaaatgtttgtgtaagttacgcattgttattgatttcattcttatgtaacagaaaaataagctgagttgtgttcatggaaaggactcccttagaagaatgagaaaacacaatcatgaaatactgatttgttgcctaggtacagaaatgaaatggtttgccaggctgtggtagatgaaggctgagctctgtgagtttgtggtcagcctgggctacatagtgagaccctgtatccaggggaaaagaaaaaaaaaggaaggaaggaagaaaagtagcatgttttcaagctgaggctggggctcagaggtatagtgcttgcctagcaagagttacactctgtgttcaatcccaatgccttagaaagatttcttgaaacctggtctgtgaatttttccttgttttgataaggactgttccttgaaacctggtcttttgttttttaaaacacatgttcgtaaaacatggggctatttttttaaaataagtgtttcttgaaacctattatggctcttgttttcatttttgtttttgtgtgccggttttctaaaagcaatgttcttgaaacctgtctttgagacagagctctcgctgctcttacctctcttagggagagctgtcccgccttcagctcacattcatcctcctgtctcagcttctcaagtgctggggttgcaggcttgtgccaccattgactgtaatctgcttttgctatcagtttagctttttatttaccccgtcaattagagatacaaagaatggtagcaggcacctgcctctgctcttagctaccctgctggctgaagtagaatccaagaagaccaagaacttgacacattctggcatcatattaacacctcatctcaaaaatatgtcagaaaagaaaactatgaagggattttgtttgaattttatctttttttcctggtagtgaaaataaccatatatgctaaccagttttctatgaggaatatttaaatcatggttataatatggctgactctggctttcaccatagttattaagaataatccagggagctggagagatggctcagtggttaagagcactgactgctcttcctaaggtcctgagttcaaatcccagcaaccacatggtggctcatagctatccataatgagatctgatgccctcttctggtgtgtctgaagacagctacagtgtcttacatataacaataaataaatctttaaaaaaaaataggtttgccagggctaaagagatggctcagtggttaagagcactgactgctcttccagagatcatgagttcaattcccggcaaccacatggtggctcacaaccctctgtaatggaatctgatgccttcttctggtgcacctgaagatagctacagtgtacttacatactgtacattaaataaataaataaataaatgatccaaaatgctactgttaagaaagtgtactcttaggccgggcagtggtggcgcacacctctaaccccagcacttgggaggcagaggcaggcggatttctgagttccaggacagccagggctatagagagaaaccctgtctcaaaaaagaaagaaagaaagaaagaaagaaagaaagaaagaaagaaagaaagaaagaaagaaagaaagaaagaaagaaagaaagagagagagaaggcaggaggcttggagtggagctcagtgctagagcacttaaaaggctgtgggttcaatcccaaataccacaaaaatctaggaatgtaactgaaaaatggaaagacatattagaaactacatttaaaatatagacatggatatgtgactgagttgatacagtgcttgcctagccatgggttcaaaccacaacatcacataagccgggtatgggtgtaagcacatgtgtgttatcccagtgcactcgggagacagatgggaaccagaagttcaccctcatccttgagcatagcgtgagtataaggccaacctgagctacataaagactctatcccaaagacaaaacaaaaaacaagaaaagatactgtgactattccctgctattgatcatgcaatagccttcccatgtcttatataatggagtttatagaaagagatggacataattgacccaggaaaaaaatttgggggtgatttgttgtggttgctacaaatttgatgactagaaggatcattccttgtaaattgagtgattcttaatttcttatctgctattcatgtacttgtctctgccaaatgaatttacgctgtgattcttaggaaactagtgtgaagacttgtcaagttgaactgggcaacactcctactgtgttatctctagctgctggtgcctcccgtggccagtgttttgtgtgttttctccttgtttaagagcaacattcttgtatggagaaaggcttgctctggctaaaatctgtgaaaagcagattttctcatttaaaatagtgttacttttgtggaaattttaaatttagcttttatctgaagtgccttaagtagattcttaatttacttttctagtactggtttgaatataattcattatgtatttttaatatactgttcaaaaatgatacatactatagcaaagataaccaaatgtctggcttactgctttctgtcaataaacttttacaatctaaattacatggtttttttattctctattgtcactacttttctgttactattataaaataccctgactcaagcaacttcaggaagacacggcccattttggctcaaagatggaaaagaatatatctagagaagacatggcagctgcagcatgaagccctcaggcagtcaggaagcagaaggagaataagaccagtgatgtacgctagcaagactgtctctagaaggttccacaacctcccaaccactaccactagctag

SEQ ID NO: 36110 - DNA, 1103 bp, Mus musculus
tcctcttttgtgtgatgctaaatatataacctattttatgctacacagatactctcctgaactccaactctagtagaattcttctttatcaataataagttagtattcgatattaattattgttagcatattagtaagcagatgctataaagtttggagtgtaattattaacaaatatattactaaaatagtaatattttatcatttgaatatagttcattgattttgattaaaatattttctgatatttcatttttggttattttatttttatttttatttacatgtgtgcacttatgtatgccatgcatgtctgaataattatgaagtccagagggctttggattccttggagctagagttacagagacttgtgacctccctgatatagatattgggaagagttacaagtgcttgtaactgctgagctatctctttagatatctcttttaaaaatattttatttttatttatatgtatatgtctctgtgtgtatgtgcacatgtctggaggttcctgaagaggccagaagaaggcatggatcctggagctgcatttctggatggttataagcctctggatttggtttctggcaactgagatctggccctcagtaggagcagtatgagttcttcagttacaaagctctttctgtacctttttggttttgtttttgttctttttttgagacagggttttacttctggcctagcttgcctggaacttcctctgtagcctgcttcagctcctgggtggtaggaatgcaggtgtgagttagtgtagctgactttcgtttggtttgagactggttcttgtgtagtccaggctggcttggagcttggtatgtagccaaggatgaccttgcgtttctgatcctcctgcctttacctccccaatattgggattacaagcattactggcttcctatttcactgttaattctcctgtttaagttttagttccaatttatagccacagtatcttgatagtggcttttaatcacaattctaaatacattttaatggatcaattatatatcttcaaatattgtccatctagagtacatacatttctagctgggtctattaatttgggtcatgaaa

SEQ ID NO: 36111 - DNA, 1220 bp, Mus musculus
tagttaagtatgttgttctgtcattcaaaatatttgtgtttataaactcttaatcttttattttcatgtactttaagctactagcataatgtctaacatataatttgtgctctgaaaatgttcatttctccttttcaagtcaatattgagtataaaaatcatgttttatattactggaatataaagtgaaatggagaatgggttttgtccactccaccacttttctctcttattccttcacacccaacacccacaaacgtttacatttttcaatgctgtctttccagatttggaaaagacctaacttctatcttagctatcttagagaggtgaaacttttgatgaaggtgctattaatctagaaaggcaaacctgttttaatgaagtatgaataagtttatatgcttaaactgtattttaaaccaatacttatgccgtcttaagagtttgagtttgtatatttgtttcttaattctaggagatcatcataatatagctcattggcttctagaagagagagctaaactatagatgtccagtagttttttcttgctctgcatccatgagaacataagtcccccagtcgtcagccagtttctccttctgttctgtatatgttgttgagtcctcctcctgcctccacatcaagttatagggcagtgagaacagcatttcaggtctcactaccagaaaagaacctgttggagagaggctgtattccttagagaggagggtcttttagagaggagatcaagcacgttactttcagttggccactggtttaagtaatgggccactgctcagaacaggttttgtaagtgcatgtatgtgtgtgtatgtgtatgtatatacacatgtatatacacacacacacatacatgcatacagagagagacagccggagagacagagacagagagggggagagagcatacatctttcgaggttctttatactttccttgccactcttctgaattcactcagcaaccgttgtccctgtcagaaggcgccatggacactttgctgtccagtgctaatgcggattcagctaggggccaccttttaacttaaatatccaaagatgccttttgaatttaagattaaaacacagctagaatatttactcttgtagtttgaaaaggatagttgttaggtgtgaaatagaaatgttgcttttcctactttagtatcaccattttaggaagttacatttgatgc

SEQ ID NO: 36112 - DNA, 1179 bp, Mus musculus
ggcggggcgggcgcccgaaggtcctccggaggcccggcattctgcacgcttcaaaagcgcacgtctgccgcgctgttctcctcttcctcatctccgggcctttcgacctcacggtgttgccaaaatgtcgctttccaacaagctgactttggacaagctggacgtgaaggggaagcgggtcgtgatgaggtaattccgtactgctgccctcaagccctcggggccacattctctctggccgtggcaagcacggttttcccatcaccttaagttgcacttatttttcagctgggtcttgggggtcctgggtttggaggttaaggctgttcctctcacctcattggggcggagactgtgtctgagtttgcttttctgcgtcctaactgcttctagcttaaaaagcgaccaaatgtgtcctttagggagttgatcccactgataaagggctcagattctcaggactcaatctttttcccatttctgaagtgcagtttcatctcttgtagcgagaatggacgtagtacttatcctgcaaatctctaggcccctgctgagggaccttgaaaggtcatttagctagtttcccttcccccaagattcttggaccatccgtgacgaatccgaaaccgcccacgtttcattggtcctggtacaaatgatttctttcccaaaagatgttgctcaaagtcctctcgagtggaggtccctctccccaaagaattgtgggtgggagggtgaggcccactggatgaagctctgtatggcttatataacaggcctctgctgccctaccttgcggttggactcctggccctggggtttgcatcaggattgtgacacatgcagggtgtggccgccgggagttggaggcctgtaacctcactcgagaggtggctagagaagcaggatgtcagaactgaggaaggctcccacgcacgtggcacatgtgggtcccaggtcactgacttaacttggcttctcccttacctgaaagaattactagggtgtatgcgtcttctcctttttgcctttcataatgtatacttttttttttttgccaggagtcaaggatgatggttagatacataactgatgggcctggttgttcatgtaacaactataggacccaaggatgggaatttttaagggccattgatggtcgcagtgactgactactct

SEQ ID NO: 36113 - DNA, 1099 bp, Mus musculus
ggacttcatgagctctgtttcagggtctccttagagaaaccaagatgtgtatagggctttgtgttgtcttaaaatcctgaaaactgccaggtgtggtggcgcacgcctttagtcccagcacttgggaggcagagactggatttctgagttcgaggccagcctgttctacaaagtgagttccaggttagccaggactatacagagaaaccctgtttcgaaaaacaaacaaacaaaaaatcctgaaaactttgaaccttttttttttaatgtagttttatttaatgtatgagcgctttgctgcatatacatctgcctgcctgaagagggcatcaggtcccctatagatggttgtgagctaccatgtggttgctggggattgaactcatgacctctggaagagcagccagtgttcttaacctctgagccatcccaccagccctgtgaaacttttttttttaaaaatatctttttttttctactttattttttattggatattttctttttttgaaccttgttgttttttttttgtttttgttttttcaaggcatggtttctctgtgtagccctggatgtcctggaactcactttgtagaccaggctggcctcgaactcagaaatccacctacctctgcctcccaagtgctgggattaaaggcgtgcgccaccactgcccggctgaacattttttaatgagttaaaagcatcagactctggtctttggcttcttcacgttaacatttgagctatctgggtttgttctgaatgaagatctggaatatgggagtgaatgccccctgctggtgatattgaggtttcagaataagcctgaaatacagcagtcttccttcaaccacaggggatatgttggaagatttctgaacacttaaagctaaggatagtgtgaacactgatctataggcagtaggcagggaggcacactgggcctagtatggaatttggaaaccttaaagcccactcccagtgacattccttccaacaaggccacacctcctcatcctttccagacagttcagctggggactaagtatgcaagtaggagtctatggagactattttcattcacacccttagttac

SEQ ID NO: 36114 - DNA, 1252 bp, Mus musculus
agctcctggaaggtaagcttggtctctgtgttttggcttctttgaaggcagggtgaagactgcattctgagaagtggggcaaagagtagagaactttaacttttgggcagtgctgtcactagcaatcacattaactagggtagcgcaagtaaagccgcgcggtgggaggggtaggtaggaactcattttagttgacctgggacccggaatgccatataacataacttctgccatataacctaataaagagctggtagatgtagcttagcggatcttatagtaacgctgtctctgtttgtgctttctcaaaaacaggtaaagtccttcctggggtggatgctctcagcaatgtttagtattttctttcctgcctttggttcctgtgctcctaagtcaacctagtgttttccacatctccatttggtgttagcgcaagattcagctagtggctgagatgtggcaccaggaacccttaaacagttgcacagcatctcagctcgtctttactgcatcaggatttgtctgtgttcttcaagatcccatttaaattccttagtgactaaaaccattgtgcattgtagagggcgtctatttatattctgcctgagaaaggaagtgagctgtaaaggctgagctctctctctgacgtatgtagcctctggttagcttcgtcactcactgttcttgactcagcatggcaatctgatgaaatcccagctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagaagcttagattataaagagtctggcctggtgtttgcttataatctcatccctgggtagtgtggaggaagaacttc

SEQ ID NO: 36115 - DNA, 1226 bp, Mus musculus
atcaagagtgaattgctaatgatcattcagatggaaacacaatccagcatgagaaaaaaaatcatgatattgctgcagaattggccaggaatttaatagatgaggacagcaacaaccagtggcctgaaggtttgaagttcctctttgattcagtcagctcacaaaacaggggaatccgggaaactgcccttcacatattttgatcaggacactgtctgccagagctactgctgccttcatacttgccaatgagcataatggtgctctgttcattcacttcgcagacttgctgcctggattcttacaggctgtcaatgactcatgttaccagaatgatgattctgtcctaaaattccttgttgagattgctgatactgttccaaagtatttgcaccctcacttagaagcaactctgcagttaagtctaaagttgtgtggagacgctaacctcaataatatgcaatgccagcttgtccttgaagtgattgtgacactgtcagagactgcagctgctatgttaagaaagcacaccaatatcatcgcacagactattcctcagatgttggcaatgatggttgacctagaagaagatgaggactgggcaaatgctgatgagctagaagatgatgatttcaatagcaatgcagttgttagtgaaagtgcattagacgaaatggcctgtggacttggtggaaaactcgttctgcccatgatcaaggaacacattatgtaaatgcctcaaaaccctgattggaaatacaggcatgcaggattaatggccctatctgccattgacaaaggatgccaccagcagatggaaggaactctaagtgagattgtaaattttgtcttgcttttcctccaggatcctcatccgagagtccggtatgcagcctgcaatgtcagatggctacagattttgcacctggttttcaaaagaaatttcatgagaaggtgattgcagctttgcttcagaccatggaagaccaaggcaaccagcgggtgcaggcccatgcagtagctgcccttattaacttcactgaagattgtcccaagtcactgcttagtctgtacttggataacttggtgaagtacctgcactccatcatggtgctcaagatccaggagatgattcagaaaggcaccaagttagttttgcaacaagttgtgacagccattgcatcagttgcagatactgcagaggaaaagtttgtcccctactatga

SEQ ID NO: 36116 - DNA, 1148 bp, Mus musculus
gcagattgacatcccacttatttttgatcgagaacaaatgcaacatcaggtgtgcttttccttatggtcctgaatcaaacctccctggaacctgctctttttcagttggctctttgtacctgtgtgcaagattttatattaattctgatttgagtttttcacaatcaattttgttttaaattatattacttatgtgtgtttgtatgtgtatgtgtggtgttctgaaaatattgagatatgattttttgcttcatctaatgagtaatattgatgaaaataaggaatgtttggggcaattgtatgttgatcagcaatttgcagtggtgcagtgacactaagaaacccaccagaataggcacagcaagctttcccgctaagcatgcatgtacttgtttgtgtgtgctgtgtgtgcttgatcgtacctacacttgaatgcacatgtggaggtcagaggttagtattgggtatcttctttgattgtcctcaactttatttatttatttatttatttttttgagaggatctgtcactgaaactggagctcaatgatttgggtagactggtagacagcaagccccgggcatattccaatgtctatctctccagaactgtgattacaagtgtgtgtgtgtgtgtgtgtgtgtgtgtgtgtgtgtgttgcatgaccttttgtgatttttctttttacacaggtgctcagaatctcaactcaggttcttctgattgtacaggaaaggcttttctcaccaagccatcacatggacagtgtctcatataggcaagactggcccccaaactcactgtgtagtgggtagtgaccttgaacttctgacttcttccccatgcttacattgcattatatcctgttttattgtggtgttgggcatcagatccaaggccttgttcctgttaggtgcccactctttcaactgaactacatctccaggttttcctgttcgattttattcagtgtttctgtcagagatctttttgatctccattctctccttgaatatatttattagctcttgtttcattccttctacacattttaaatactgtgataacagtaattatatttgggtcaaaattccctaagttttcaaaggatcctatagggctaaatgcatcaactgctattttggtaa

SEQ ID NO: 36117 - DNA, 1273 bp, Mus musculus
gtcactttttttttttatgccttcacaggtttcaacaagcgtgccattgacaaatgctggaagattagacacttccccaatgaatttatcgttgaaaccaagatctgtcaggagtgaaatgtgacagataaagagtatccttgataataagaagtcaggaacttaccgtctgacttggaaaattgaaattgatgggatactcatgctatttactcatacatttactctattgcttatactggaaaaggaaagggaaaggggggagaaaactactaaccactgcaagcgattgtccaattctactttaattgacattgcttgctgttttcaacaagtcaaatgattatcttttctcttgaatttatagggtttagatttctgaaagcagcatgaatgtgtcatcttaccatcctgacaataaagcccatcctctggttttatttaaagcaagctctttccaacatcacttggctagagcatgctttaaatttaaaatatttgaaatttgtttttgacatttttttgtgtgaaacatgtcaaatctcttaccattctttggttttcttctttattatgttcaactctcctgatttcagaagttacatttttgcatttctatcaggtgctgtgtaacgaatctgactgatatgtgaacaatcttcatgaggaagcaattttttactcatgtaatgattctttctcactgatatctgtattgtgaaatccacagaactgtacaggtgctgaatgctgtaaggagttctggttgtatgaattctacaaccctataataaagtttaccgtattcaatcatgttttattttcatcacttgacagatccttaatgtggaaattattgatttagcttttgttaacattaatcagttataaaattatgaacataaatccacttccattcccatctctacatactcatgtttcatgatctcatatttccgattttcactttgtagtaattatgttataaatatcttacaatgttcttgccatacaaattcaactacttactgggattcttcagctcagagcaattgaaaatcttactgtttttcccactttataactacataaacaatgataggcatctgtagcagctcaccaaagatgaacattgaacaagacaatgagacattttgaagttaaattaatttatttagtgtggtggtgtgtgccaagacaagtatgtggaggtcagagaacagctttctcgagtagattctctccttgcatctttacacatgtgccggggatg

SEQ ID NO: 36118 - DNA, 1178 bp, Mus musculus
tctctagctcgtgggactccacccaccacgggttctaaaccgaaacaggaagtgggctaggatccctcgaaacccgctacaaccgccaccctccgcgcgcccaagcgacccacaactcgcgggtccagcccctgtcccgcgtgttacctgcccctccccctcctcccgcccggtgaactcgagagatcatgtcgaacatggagagtatcctttctgttggtcaagatgctaccagggccttgggggctggggaggggggggcgaaggcaggggtgctggggacacgcccaggggcttgaccctttgggcccgcacgtggggcgagggagctgtgatgcggatgggtaggctccagcggcctggggttggccttttttttattttttttatttttcaccctcctcctcgctgcggccgccgcctccgcctccgctgccatcctcgaatgtggggagggtcagaggagccagtggacagacagagataattgagcccgtaccgccccttgttgaggatttctgtcacctgccttatcagtgaatttttggcctctttgaaattgacagggaatggtgccaggacctaggggaggcgactggagtttgcctatggctccaggcggaggtgtaggttctcaaagcgtacgtggacaaactgcttttggcgaactgccctttaatgactgcaggtgactggtgatgaggttgagcgattgctacgaaccctccgaactaactgtgctcgctttctgttcccgctgcattctaatttaacacttgaggaaattcaggttattcctgaagccataaagtccatcagccaaacctgtctggccacttgggcaattagtaggggctaagaataaagcttcctggtgacgtcatgaacacaatttggctttctttttctttttcactacttaaattccatcacagaagctccatgttgctgtaatttttgctccttccaggggttggctttagagaaaaataaaataaattgctttttcttcaactccaagatagcaaaaagataaaccatgggttatggtaactgttctgtagctcgtgttaagctcttttggcgctattagtctataagcctgaagtacaggtaaaaatggttttttgatgggttcaattttatgtcatccagtaaatcttgcagcactagtcagg

SEQ ID NO: 36119 - DNA, 1097 bp, Mus musculus
ttattcattcttagtggtgttttgtggatcatttttgtcctgtttaaattccaactagaatttgtacggtagtacgtaatttgtactaggaattttgtgtactctgtcaagtacttcgtggagagaaaacttgtcataagttgtttctagttttttttttttgttttgttttacaaaatgtcagtttcaatgaaatatgcctcccaaattgtgtactacccattttaacaggagattttgttatccttgggtactgttcatttaaaatgtcaataactaagtgctgatagttctggattgtttccatatgttaagttttaatttatgaacgagagccacccttgtatgcaaaaacataactgttatttgttctagtctgacctcataacatatctcctccttgacagttttagttactaaatcttttatcacattatttctaattgttcaactcaaaattgtcagggactgaatcacattcttgctctgcagttgtatgatgatgttcttcctatataatatctaccagctggtgtttgtagcctgtattggactgtacctccctgggattgttcatctgtaccttctgtgttttaagcactgtaatttttaaaagagctttagagtttacgaaatttattcctcaaatatagtcttaatcaccagaaagactatctgtcgactctcatttttttcaaatgagaaaaatgagtttcagtgaaagcaagtattttgcttaggggcttgtagctagtaagtgagtcaaaatgccttgattcatcagggcaaccttggttacacacgcctttaatcccagcattggcgaggcagcagaggcagggggatgtgttcgaggccagtctgatctatagagtgagttccaggacagccagaggtacacggaaaaaacctgtctcaaacaaacaaacaaacaacttgattcatccaggatacctactagtgttctttggatctgttggcttcctttctaaccgctatgaaacaggctcctaattcatgcatatacatatcacttaaagagaatttttctgtttgcttttggtcctggttttagtatatgtgctgccaaagtgagc

SEQ ID NO: 36120 - DNA, 1081 bp, Mus musculus
aatttgttgccattctttatgggatgtttacaataaaattccaagttgtttggaatcagttgcactctcgctgctttatgccttaattcatactagagataaattaacaagacgaaagaattataagaactacgaagttaacctttcgaactatccagctttagagattgtatcatgtaatctgtgggtcttcttgtcataagatattttattatcattttttttttaattcttagaaactgagttgcttcctatgaaagaaaagatgtttccttttcttgctgatattctttggatcacctttaggtaatcaatatgatggtaacactttaaaatttgggctgcttggtgccttaaatagcagccccaagcactcgtaagttctttattcggcagagcttcttgagttggttagatttcgaatatacttgctgttaaattttaacagctgagctatggatacccagtgttttttatttgaggttaaattgcctgttgactatgaatttattataaatggtgctttaacttgatgtaaatctaggagggagagaaatgaattgagctggggtctgaatgttttactaggaacactcatccttggccttaaatctataccctcaagttttctcccaatgtcaaggattctactgagttcaagataaataagcttccaaaagactggtccgcatcttttatatgtagcttgtctgttttgtgtttttagaattgagaagagtttttgaatagttcacctctcttctggcattagatcagctgactgacagcccaattttcacaatacccagattgaggtcagggtatatttgtgttatttttgtttagctgtttgactgctttaaaataacctcttttattatgtgaatatgttacattaaaaattctttgttagaaggctttcgtattttatttacccgctagatttcttaaatggaaaaattaaagaattcttatgacaaaactttattgaagtattcagaagattgtttgcctcattgagaagatcaagggggaagagtgccctttgctttctatattatttatcacttactccttaaag

SEQ ID NO: 36121 - DNA, 2410 bp, Mus musculus
ctcctaagttataagctgagacttctcaataatcatattggctctcaaattaatagttgtaattaaccagctttcctaagtgttatatgctctaggcttttatagaacatatttgtgtaagtagacttgctctactgcatagatttctctgctaccacttatctaacagctgtgagttactggttttcatttgaatcttaaatagtatcaaagtacctaacttgagctggaatattttggctagctaatacttggaagcaactttaataggttcttctgttctcattccaaagggttcttctgttctagacttccagaaaagagcctcattgcactgcaaacagatattttgaatcgttattttatagttgaaaaacaaaacaaaaaaaaacgtttaaaatcatgtatggtcttgtttacagcaatagagtgcacgtgattccacaagcgagcttcagttccaagatcaattttattcctcaaatttgagatagcagatgtgctacgttgttacataaattcttgaagttggagggggataatagttgatctctgcttttgtaacagcagttttgttacacgtagatcagacagacttgtgtgataaaacattttcttaatgtatgcctggtaatccaggacatttcttaagctgatgtgtttgtctcatgcttttaatcatttcatgcatctgaaaatctgttaagtgcagaggaaggagtacacacataactttgcttattggtggggttgggggtttattcttgaattaatacccttaagcaattttcacttgcagtagaaatgatgttcaggctttaagaaaatataatgaactgttaatggcactaatgtctgttgctagagagcagaccaagctgatatttttgttgtttttcttcactataccaaaactatttctggttataaactcaactgccattttagccatagtatagagtcaaactgttcccatttgagagtctacatttgatttttttattaaaatatactatttcagttattcatctcttgggcatttagactaaattgtgcctgtgttttcctggagtcagtaacattttgtcctataacaatcaacatactatagttgcttaaattcctggttatacccaaatgtatatcatgtgtaccattttagtatgaaattttggttgacattcttctatgaagagctgattcttgagatgtagaagaattgtcatttgtgtgatattagcagtctggagctttatttataatttattttgaaaaataaaaatgccacatttattccccaaatgtcaagattttctaggcttacataattagaataataaggctaaagacatttttaagcatattttatatgtagtgaaatactgtgaaatactagtgaacagcattttgctgtgatgttgatttcagtcattagaatttaaagagttagtcaccagggtatggtaggtgagcatagttatcatttattataaatcaaacagatacttttctgtttgcatgcaaactattttcataagtgtgaaaaaggtctggaaaataatatttttacttttttaatctggacttccctttccccaatttatattttagtttttttaataccacttcctacaaatgtgtcataatttgtatcatattgaatacttttatcatttcagttttctagagagcttttaaacctaaataagatctgggttcagccatagcaaagaaagtaggaaatgagttaagaattctgcacatgaagaccactgttaggcccatgaaaacacacacatgtagagctttaatcctgtgctatatctgaatagtcagtaagctataatatttcatgaatgctagtgttcagattccaagcttcatgaccttagcatgtgtagatgtttataaaattgaatcatgtgtttcttctctggcttgctgtacatatctcagctagcaataggaggctctccaaaacatgcacaaacccactagcctaatgactaaatttgtttttgtaaaagtctttgtgtgcttgtatgtatgtagcttttttctagtttgacataccttatcccagacattaaaaagagagactattttcgatggaggacactgtctaccaattatttgcctctttagagctcagcctgtgcatttcttagcgcttaatcatccatgtcattatgtcttctagatgacaattttggttttgtcacgtgtgtccctcttttcttttcatttaattttggtctttcatttgtttgtattttctctttccctccccagaaatcaggcttattctagaaattgttcctaaggtgcttcctttgctccagaggcaaaggaactgagtaaaatgctgaagtttccctctacacactttagttctcctatacctaaatta

SEQ ID NO: 36122 - DNA, 1190 bp, Mus musculus
attcaccttgtatgattttactttcctatgtccagttgtagaatgaagatacaaaattagaaataccaaagataataactcataatttttaggttgttcctcattctcaataatccaacaacttctcacgcagtcacaattccttattgcttccgatatcagtttttccagtgagtaagctgtaccttccttctaccccgtggtggcttgtagcttgagttctggcagctgctatgtagtagcctaacagtgtgacaaggcctactacattagtcacctcactttacctcactgtactagctcacataatcccaaaaagaaaggagaatatagtagtgcaatggaagactttaagagagaccatatcacaaacttgtagtattttatattttaaatgttttattatattatttctaatctcttactaagccatttataaaattcacgagttatgtatgacgatgataaatacaattttatttctggttttttttttaagaaatacgtcataatttgaatgggaacagagcttattctcatggtttgtttgaattcattataggtgatagattccgcagtataatagatgatgcctggtggtttgggactgtggaaagtcagcagccttttcagccagaatatcctgatagctccttccagtgttacagtgttcagtaagtttagttcatttgtgcttttgacaaataagtgttccattatatcaacttttttcttgtaagatgtttttctattacatcattgtatcctttcctgtagattaaatttaggtataatcttcatcatcaaaaaaaaatgtaactactgtgaagagtgggcttctgccctcttaacttttcattggtgtagcatattttctctatcagtggtgcattgctatctttatataagctgagttgtagtgtcatgaatattatgttgctgttttctgaatttcaccctcaaaaaataatgcaaattatgttaccatatgaatggaaatgcttgggaatgtgatttgcatcttcttcttttgttgatagctgggacaataatgaaagagaaaaaatgagcccctgggatatggagccgattccagatggaagtaaatatacctttaaagatgaattatcattcttagaaaagcaaagtagtaacagtttgatgttgaaaacttattgttttgggttttt

SEQ ID NO: 36123 - DNA, 1279 bp, Mus musculus
gaagatggaaaggaatatctgcatgaggaagatggagaggaaggtcagcctaaggaagatcaaaaggaaggtcagcctgaggaagatggaaaggaagatcagcctgaggaagatggaaaggaaggtcagtgtaaggaagatgggaaggaaggtcatcatgaggaaggtggaaaggaagatctgcatgaggaagatggaaaggagaaagatggtggaaaagaggatagaaaggaagaaggagagcaagaggttgctgtagatgaagggagtgatgaaaacaaggtggaggcagaagaagaaggagccgaaaacaaagacttcaaacaagacggagagaaagaggagcctctgagtattgtctaaaactgccctctgtgagatcataattcggtaacacgtaccttcctgttgtaatgttaatagagataaatatttttatcagatattttataaacagtgcttttctttagcatcattcaatcttagatcatcatcatcatacaggttattagttgcaaaatgcctaacatgacacctttatacattttgtgattatagtagtgcaaaatataaaatgtatacttgcaactttgtgaatttcatcatgtgtaagttatgtattaaatctttgagtttcaattttattcttatacgtggtaaatttgcagagtaggagaattccaaaagaaagagtttggcacaactttgatgtagttctctaggttgcttttataaagaaggtcaactattttcaggtaatgctaagagtcggaattgacattaccaaatacaactgtattagtagcttggaaagtataaaattttaatttcatttttgaagaaatttgaatgtttatttcaggagggcagttttgattatatgtgtatgcacaaagttttgctggatttatcataataaaagagttccacaaatatgattatggtttgcaatatttcaaaaactgtagtttaaagaaatattaatatccctgatttttttctcccatttggtgttcaggaaggcatttgaggattttttcattgaaatataattataaagcataaaattcaatattttaatcatttaaaatatgcaatatattggtttaggtacgttcattaaaccattcattttttaaaccattcatttttataacaaggatatttattctattcagtcaaagcccattttatttttcatgaatattcatattgtttctaatggtatcagttacaaatctgcagtgaacactcactagtttttgtgttctgtatgaac

SEQ ID NO: 36124 - DNA, 2299 bp, Mus musculus
gaactgaaaggagcgagagaggagagagagagagagagagagagagagagagagagagagagagagagagaagagagaagagagagagactcttattcccacaatgcctcattatctttagtgaacatgaatattttcatgtgatgttactgttgttgaaatgtatttacaggttatgttcatatgttagtcattgtaatttcctatgctgattgtgacattctccttcttttatcaaagaaacatgtatgccccgaaccacaagttttccaggcttctagatgtaacctttcattgcacagccagtgatcaaaatagctggcttcccgtcagacacacgttgagtgcatttaactgataaattccttgcttatacatgcagttatagtcatgtttctaagttgcttgcctcagtacaatgtgggtatataagtcatggagaaaagattgcagttcactttaaattggcccttccttgcaaagaacacagacttttaattaactgttatatagtatcttgcccttcattgtttaagatatattttcttttggtgtttgctgaacgaagtagtagtggctcttgtctcctgctttaacactgttggtgatcgtgaatgatactgtccttaataggtaagcttttagtttcactttaggtagactgtgtcaacacatccgtccaagtagaaagaatcactaagcacacattgattttttgagaaagtacaagtatcaaagaaaagcaacaacgtttgaagtagtttgaagataagcaagacccaaagcattcaaccagaagatgttgatattgtacctttttcccatacttgatttttataaagaaacacacatcttttacttcaaattactattatcatcatacctgctctttcctagactgtacttggcaaaaattcaatatgtaatggagccatagcttagtttactgaaactcaaacgtgaattgatgctttaacataaatggttttaaaatttgcgctactcaactctaaatgttatacagtaattttgatgaataatttttgtttataggtgtttaaaaaggagaaaaaccaaaatgaaccaaaccaaccaaaacaacaataaaaaacaatttgaaggcaacttttagtgacctaaactttgaagtatgaattggagtcaaaactattccatttcttcttccttttttttttttaattgttttggggatctctatggaagacaatactttaaattaattttggagtgcaaaatacttttagccaatgttttccctcatcattgctaaatgctacaggtaatacctgcagtattatatgtggacaatgtaactttctctgttttgcattggaggatgtttatgtctgtgggataataccctgaagtctgtagatttaaagtacaagtttgaattgagtcttctccaattgaagcctgtcattttgtcaactgagaaacattcctgatagatgaaaggaaaggaaataaaagtctaagaattaaatgagttttgaagaaacttccacagtatatgcttgggagtgaatttcttgttgctttgcataatatgtttggcatatttgtgtttctaaatgagacttggtaatttgtaaatttcacatttaagagctgatttgccctttagaaattttgttctttagaaagagttccactttcaaaaacactgtaaattgttaattgtactgctaaatgtggacacttcattgggaccctaagtatatgtgaatagggaattttgaaacaaagattacttttactgggaaagactgagtacagggagttttggtgaaatcagacttcactccttaagtaaaaagaacaacaaaatgtaaaactcacatgaatttttgttaagcagttgttggtgtttaaaattacaaagtacaacattaatccttttctatggaacactgattcttttcatctgatgaatttcaataaaactgattaagtgattcatgtttgattacttttaattttctggtcttctgtctctcttcctcaattcttgtttctgaatattaccagtcatcccgttgtaactaattttcattttaaattaattgtaattttaacatttctttagaaagagtaaccattcttggggttggggagatgacagtttaagagcacttaaggctcttcccaagaaaccaggttctgcttgcagcacacacatggtggctcacaactgttaatgtaatgattattttgctatgatgttttttaatatgttcattgaggtattttatataccttaaaatttacctattta

SEQ ID NO: 36125 - DNA, 1521 bp, Mus musculus
ccaccttcttgagttctttatatatatattggatattagccccctatccgatttgggataggtaaagatcctttcccaatctgttggtggtctttttgtcttattgacggtgtcttttgccttgcagaagctttgcaattttatgaggtcccatttatcgattctcgatcttacagcacaagccattgctgttctattcaggaatttttcccctgtacccatatctttgaggcttttccctactttctcctaacagactttctagaggaacctgtagaggaagcacctatgtccccaaaccagtcagctgggctgatgaaacagacgatttggaaggagatgtgtcaacaacttggcatagtaacaataatgatgtgtacagggcgcctccaattgaccgttccatccttcccactgctccaagggctgctcaggaacccaatattgaccggagccgtcttccaagtcgccaccctacactgctttcctagagaatctgccctacaatgtgacagaagactccattaaggatttctttagaggattaaatatcagcgctgtaagcttaccacgggaacccggaaatccagacaggttgaaaggtttcggctatgcagaatttgaggacctggattctctgctcagtactctgagtctcaatgaagagtctcttggtaacaggagaattcgtgtggatgttgctggtcaagcacaggataaagacagggatgaccgttcttttggtcgagatagaaatcgggattctgacaaaacagacacagactggagggcctgtcccgccacagacagttttgatgactacacacctagaagaggggatgatagctttggggagaagtatcgagatcattatgattcagaccagtatcgggatgggtatagggacggatatcgggatggcccacatagagacatggaccactatgggagctgggatcgctatggtgaccaaggcatcagagactatgaccgaggctatgactccaggataggcagtggcagaagagcatttggaagtgagtacctgagagatgatgactacagaggacatggggatcactatgaagaccgctatgacagacgagatgatcggtcctggagctccaggaatgattactctcgggacaattataggcatgatgacagagccccccccccccagagacccagactgaacctcaagcctcgcagtgctcctaaggaggatgatgcctccgtcagcacctcccagtccagccgggtggcctccatctttggaggagcgaagcctgttgacacagcttttagggaaagagaagtagagaagtggctacagaaggagcaggagaagctgcagcatcagctggatgagccaaaactagaccgccagccccgggagagacaccaaagttggcgaagtgaagaaactcaggaaagagaatggtcgaggacaggaagtgagtcatcgcagactggggcctcggccacatctggcagaaatacacgatgcagagagagtga

SEQ ID NO: 36126 - DNA, 1221 bp, Mus musculus
aatgaagttgtcttccttatctctttttagtagttttggtttgaacaatattttcttaaatagtagactatctcgatctgctctcttagttctatctgctcagatacacctgcatttcaatctgtgctgctcagattttggcaagctgagtcatctaagaagaggaaatcattgattaagggaaattaagagaaggtctttatcagagtgtcctgtaggcaagtctgtgggaatatctttttgttaaccgatgtggagaggcccaggctactctgagtggtgctaccagtggacatgtggtcctctgttgtataaaaaacaaactgagcaagcagaggaggcaaaccagtaagcagcatttcctgtggtatctgcttcagtttctaaatccagtttcctaccttgtgctactgccctgacttctcttcatcctggtctttaagctctatgatggggaaaaataaaaactcttatgctccaagttagtgttttataacagcatctcacttcttggccttttggctaagatcaagtatagtatctgttcttatcagttcaatatatgatatgtcctctacccaaggacaatatattaaatgaatttttggaagtagaagttggaataggagcttgctccatccactccatgaattggcctggtattgtagtacctccaggaatggtgcaccccttccgaggaataaaaaaaaaggaaaaaaaaaaggagaaaaaaattttatgggatatttctgtgggagacctcaatatgtttagtttgtgagaattagagaggtgtttggaacactggcttagataagccattgagtgtttaaaggttaaagggctgttctgtggaagcgtggatgataaatgtatatagagaaatataggtgatgaaggcttggcttcagaagtttcaaaaggaagaaaagactatcaaggctgtttgtttgacttatttgaattaagaatctgtagtttaactcacagacaatatgaagttcaagaagaaggaaaaccaaagtgtggatgcttcaattctacttagaatggagaacaaaataatcatgggaggtagagggagggaggaaccagtaagggagagggagggtaaggaaaagggggggcaggatcaggtgtgggaggagattggggagaagtacagagggtcaggaaatagaacagaggtgtgtagcagtgaggggtggccaacagggcact

SEQ ID NO: 36127 - DNA, 2018 bp, Mus musculus
gcttgtaagagtcttgtgctcttcagtcctcagctaactggatgaagagaaaattaaatgtgtgttgtggattggctttgttttctttttgtctaatctcatatcaaaggtattttgtttcctgccacattacttgaatattctgtttaagcctcttttggagaggttggaattttaaatgaacatacataggtccataatattcatactatgtcattgcagtagtgtccaaacgtttaactatataattgatgtccacaaggtcttaacttctctgcacattaactttccaaattcctttcaaataaagttaacctgtttttttattattttacacaaaaatggtttaggaattcattaatactaatcaagatgcttttcatatgttataatgataaataatatcagtattttaacatcatttcctaaaaaggaacttttgttcttaaaagaacaacagaagtattctaatagcttgtgcatagccaaagcactccattcatttgagtctgtttagatactaaatgtagtaaaagtagtttggtgcctgagcaaaatacattcgtgctaatatatgaattcctgatatggttggtgccaaagttttgatagattaattaaatcactaataatttgtgcagacagatttgtatattatccataagtgacttcaactaaagaaaggttccatacagcttctaatgttttacagctaataaaattgtagtgaaagtgaaaatgtttttatccaaaggtttcatgttggtgttgtaagctcctaaaaatgtcatagttaagcctttgaatatgcacttcatggtgttgatgcgatcttggtgttacctaagctgactttgaagttaatcaattgaattcaaccatcgttgttcccctttataagtgaagctactctgttgtattcctgatttccatgtggtttgagctacagtgtagcatattgagctaccttgaatcctatggcgatgtagttgaagttttattatagtggacttgtgcacttagcacatatgatacaatataatgtatttcagtaagcatcagacaattctatatacttcaagaaaataatttcacattttaaaaaggaaacaatattaatggttgacacagaaatttgagtacatttaaaaatcatttataataaactggccaaattggtattattaaatttatgattcagaaccagtgtgtaatgtgtattattttcttcaaatgctgaaaattttaaaagtcattttatattgttaaggaaaatatcattagctactactactgacagaatccatgaatgtaagctggcggataggagttttgtttagtgtgtgctaggtgtactgtgtgcttagttcagagaactgattactgactatgtgacgtagactaggagacatgtaatgttggaatttaataaaacgaactgtctgtattctcttcaaactgtaagtgatccttgtccatgcacaaatatctgtttcctacatgtgatatataaattctgtattcttacttgaggtgtcttttttaaaatgattggacattattaaacaacagctgatctgataccacacaacagcatcatttagtcttggtgtagtattttgtctttggtgtttcaatttggttaattttccccctttctttttgttttatcgcaataagtacttgcatttaaacagttgtattcctacattcaaattagtgtgctcttgtcatgatcttctttgtgctgttacacatccttaccagttgatttgttgaagtcaaaaacattagtttggttttgactttttaggacacatactatgtctgtatgtgctttccagctaattagagaaaatgaacctggaaaatgaaaagtgaaaataaaaataccttttagcctttgtgtaaacaatgtgttaaaaacatcataattttcagttagttcactcggaacattaaggattaaccagtgcgcatgctttctcatccttcagtgagtattgactgtacaaaag

SEQ ID NO: 36128 - DNA, 1146 bp, Mus musculus
gccctgactgtcctggagctcactctgtagaccagactggccttgaactcagagattcccttgcctctgccttcccagtgctaggattacaggcatttggtacttctgtcttgctataaagactactcttaattctagggtaaaaggcacagatagggaaacctatccataacttcctgtttccttcttcaaccaatgtgtgttacttatcagtgtctgtctgattttctaaattatcttgaacctacaagctttttgccttttgttatattgagtaaatagttggagtgggggtggggcactagataagaccttagtaggaccaagatttgaagttggaaagaatgagactttttactataaatatatgaactgctttaacaaaaatttagttatacaaatataatgctgttttcttttatgttcaaggtcgttcatcgtgatcttaagcccagtaatattttatatatggatgagtcagcccatccagattcaatcaagatctgtgattttgggtttgcaaaacagcttcgtggagaaaatggacttctgttaactccgtgctacaccgcaaactttgtagcacctgaggtattctttaactattactgtggatctttccttgttttcctagattaagtctttatggcatcaaacatgttggtgaagacaggtaaaagcagagttgccttttttctcaactaagaagctctttttctaattttgaattataataattcttgacctaaagagttagttactagcatctaaaacaaatatatcttataatcagagtaattggtgctattaggctatttactaatatagaaatcatgatttcaaaacagggttgcatcatatagctctggctgttactgtagctggaacatataacatgtctcctgtgtttgtctccttatagctggggttacaggcatgtattgtcatgccttgctgagaaccatttattttagggctgagatatacttttagattgccttagaaggtgtttttgctttgtttttaaatagaaacattgtctttttcctgataaaccatttctttttcctgagggaagagtcaagaaaggtgaggctggaaaagtttaggaatatagattgcacttttgggatgctctctgatatt

SEQ ID NO: 36129 - DNA, 1174 bp, Mus musculus
acaatttaaaagccaagttctctttgaaaactcaatgtctctttaaaatttcaaagttgctaaaatattcaaggtctcataactgtggattcccataaaataagaaaacactctaaatactttattgctccaagaaggaagaacaaatgtatagtcacaatcaaagcaaagcaaacctgacatccagcagtgttaatcaaatactgtagctgaatgacccacagctaggattctctcatgatcttctggactccacagaacccggggcaacttcacttctttgtctctgccatccacaacacacctagttcatttcacagtctcaagttggctccattctaaagctgttgctgtttttgggggtcatcccatggcactggcatctccaaaatgctgcggtgtccacatgctgcaccttgacaaatgaactctcaggctttcttcagggactccagacctattacttggtgccaatcctcagccttttcctgtaagcccttcaatcctggggtttctactacaacagagggtttaccttcacaagtgacctctcctggcctttcatagtgccaaagtccagtgcttttcaggactccttcatgccttcaaatccagtaccatgatatactagattatacaatgcttatacattactaagtttggctaccaacacgagatacaaccttgttcccctctggaccacagcttccacatactgaacctgagagaatattcccccaaagattttgcctcaatgatgctgggcttttattaatcatagttaatctctcagcctgattgtctcaagagggcaaaggtttcattgtagtggtgctggtctcttgttgatcatactgactttcacccccagctgaccaaaacccatgtattttatttcaacttctctcttgagcagcctagatctagtctttgctgggttctcaaaacttcactctaaaacttaacaagccaggcttccattctctgcatcttttttcagcattatcacagaacagctcattaagctctaggtaatcaatggcttttccagcccagtgtcacaaaacccatcatagtcttcctaagaatggcatggtcaggtctgtcacagtaataccccattataaaacaccacaacgaaagcaacttggagaagaaaatgtttctttggttt

SEQ ID NO: 36130 - DNA, 1193 bp, Mus musculus
ggaaattgccaagacactttatgtgtctgtccctccatgatttcctatacggtgcagcacataactgtcttaggatgtgctatgtatttctacttgccttgttttcaatttcacccatgttaggctcatagtgagagattttatgttttgtctactgctatattcccaatacaaaatataaatatcttctttttcactttcatactttataggtactacacagttcattcctgaccccaagctcatggatcatgggcagtctcatccagatgataaagatatgtacagcactagaagctgaactagtttgcagagggagcctgcatagagaactgcaagatgtaccaagttgcaaacaatggtgaaaaatcacataatgaacgggtaactgacaaaatgtgacttgaaatttttccacgacattttcaaataaacagtttggccaatgatacaagtggtaaaatcataaattaatgaatgcaacataaatattattaggtgattgatgtgggaactgaggtagaaatgctagaagtacatttcatgacttgtaatagaatttattagaaagcaaaatgaagtgaagatatgtccgtaagactgaattctataaacatgcatatgtatgtatgtacgtatgtatgtatgtatgtatgtgtctgcttcagttttcccaattattgccagttaacttacaatgggggtagacgaatgagtttttcacttgacttttttttttttagagctagaataaattatccatattttattgcacacgagctttgtttatttattttgactactcttaaatgcttgaaaacatctgttcaaatgggatcactaggatactatgtgatgctagtactcagtcgcaattttgctactgattcctgggtgttgtgtttctctgcttcactctgcttgggcctttaatcccatcaaacttgcctgttttcgattccatagaacaaaaatgtccaattcttaggtacaatcattcccactagccatctatcgtcctggttactctttgcagtccttctttgcaccctttcctaagactagtgtttcttctcaggtcctgatttccatcttttcaggactgtgtgtcatcctgtttaaccttcaatctttgttttcttttatcactcagttctcttcctcaactagtaaatagattgaccttaaaagaa

SEQ ID NO: 36131 - DNA, 2106 bp, Mus musculus
ttatgtggtgttcacagaaatttgttcgccaattgtgatctttttgttgttgttgttgttgaaagccacatctggagagtcagctcacatacttattttggttatttgaattatattttcaatctgagcatgatataacagataaaagcatgtgtaaatacggtagaataaagctaaactatcatgaactggccaggagcctatatttggagtaaaagttggttttatttcctatgttaaaagctgaatatgttaatactaaggtgtttagacattttgctaattttaatttcttagtaattagtgatttgtatataaatcacatacacaattggccaaacttcaaagattaagaaatagaagaatacaagcaaacatttgataggatgattctactgagtcaacggaagcactaagtccttatccacagaactaatttcatcatagctgtgttactcaaaatattaggcaaattgttaaacttatcttcagtttctccagatatgaagtgaaacatgcctcctataacagagcagtcttgaagatcaatgcagcactaacattagaatggttcttctggacattgatctgtggaaaaatatcaaaccaacctcatgatcacagtgttatatttattgcagtaaatttttaatgccagtctgtttcctaaactcattaataacaggtggaatggtagttcttgaagtcttaggaatactttataaattaacgttcctcttctggcaacaaaaccatcaagacctgaacagagtgtagcaattaataacctgtaatatacattttacatgagaaaaatgagggctatccattgacagaaaacctatttgcaatgcctacatttaaatgtctctaagctctgatggtctactttcttgagcaatagtttagacctagaactgcctataaataaataaacaataaataaacgcaatgcttcctgtcagggagccatggctccaaggaaaagcacagaattctccatgtgcagctgcttccctaacctggccaggtttcagcgatgttaaagctcccagcacagattcataagaaatgtaaaaatccaaggaatgtagctcttgctgacccttgaagaaggagttggattgagaaaatgggaaaaatttcccagacttccaggctgttcctctcaggttgcctgtacctcccgctgtacagctctctcctctggggtatccaatcctttttataatgtcacacaaatcagggacagaatcactttataacctactttgtcacaaagcttcagctcttatgtcagctgttgtttcctgaagcccacctagggcatgcactaaatgccaagtacgctcctgtaatgcaccaggtactggccctgcctctccataccagcaatatgaaagtttctcttggatggggacgttaagttggaatacaatcacagttatgtcacaccagtaaaagtgttatactttgttataatcttagagttaaggcctcctaaatgtagaatgcacatttatctaaggagactattaagctagatagggttagaataattagaagaactagacacctttggacactgcagctctgtacattgtagaacaacacagaaactattttttatttcatggcccagcgtacacaatatctttttttcatccttttggtgcaatcagaaaaaaaaaaaaaaaaactctcttccaggtcatttactgagtatattattaaaatgcttaaagctcctgaatatgattaataatgactgaaataccacaaaattgttttcaaaattgtagacagacctatttcttgttgcctcagagtgtcatactaaacctttgaagagcattttcttttgttttcttaattattgcttaatacttggttttactgtattaaggtcaaaacaataccaacaacaaaccttaaggttgtattataaaaccttacaacacaatgtttgctgttttacacaatgcaaacatttcagtaattttaaattttgaagttgctggtatcaaaatttttttatttgtttgttgaaagtatttaaatatgcatgcctgtttctggaaacgaaaaatggtatatcattaagtg

SEQ ID NO: 36132 - DNA, 1141 bp, Mus musculus
aggcgctgattataaatgctgttcttatagggaccagcagcttctcaagttctatggtaagggaagagatggctgtttttcctacaaaaattggattcatcagatgacaaggtgctcctctcttgaaattacagctaaaaaaaaaaaaaaagaattttgtttggtttaaatggacaaatgtatacgaccatttcatttttgttcctaaatagtttcaaaagtataaatatgttttatatgtcttggttatagattagtggctcataagttatttgttatgattaaaaatttgtaacattggtaacaaaaagttgacttaaaactggtaactctgtgttagagtaatttagaactacaacatgcagcatgagacaacccatgggaacaggtctctaaagatacgcctgaattgggtaatattctgtgtaattcttattctagaaacccgatttataatagatatattggcggctacaccttcttgtgtttgtgtgcaggaacggacagccaaactttgtagcaagtaatgtttttggagttcatttttaaagaaaatagattgtttacactgttaaaattgggttttgcttctcaaaattgtggttgtgctctcatgttacaagagaaattaaaggcttctcccgaattggagccaccagctaaatcggctcctctaaaatctataaagcctcctgagtggcctagtccacaaccttccccttatccacagcctcgaccccagccgccgacggggcgttgagaggcggaccactgtgagtacatggagccacagggacccgcagagcagagtacgggcggactctggtggacccgcccaaactttaaacccttcagtactggtcattttcctctgctggtatttataactggaaaattaaccaccccctttctcaggatccccaacgcctcacagggttggtggagttccttatgttctctcatcagcctacttgggatgactgtcaacagtggttgcagatgctcttaacaaccgaagagcgagaaagaattctgttagaggctagaaaaatagcccaaaagccaacggtggtctacacagctacaaaatgagatcgacatgaaattccctttgactcaccccagttggaactgcaacatg

SEQ ID NO: 36133 - DNA, 1135 bp, Mus musculus
atataaaataaaatataaaaatggtgtatatcaatatataaatacattgatatctaaaacacaaagactcaattactataaacatacatgcatttggcttagctaagatttggttaatgatttaagttaaagttcatcttaaataggaaagaaatcagagatgagcagtcagtcctcaaagattatgctatacctagaaataaaaatactggaactataaatatgcttttatatataaatcatagacttagatctgtaattatttttacgtgaaagggaattataggctttaccctaggtccctagaatatttactctcatgttcttggttacttaagcagtgtcttctgtgttctatatggtggagtgggccttcagccaaatcagttattgattggttactcctacaagctttgtgctatgactgcctctacatatttttgtaggcagcatactattgttgataaagagtttgtggctttcctggctggtttggtgtttacttttctcttttcttagcctgctgagtatcttcctctacaaagatactaaaacaatgtaaggatggaggttctgtaggcaccaccttaatatctccatattcaatgagttgtattagcatcttcagcaactgagccttgctgtcaatttctgaagagaaacctgtagtctcagcaacagcctgggttgtttggggatcccagtgtatccccgttgggcaactcaattatatatagctcaatcctggtatagaactctttgtttggttacaagagataggcagttgggactctgtctaactttattatttgggagattcatttagattcccttcatatatttatgtatttttagaaagtttctaatgtattgggtttccacactatcccttaaatgcatataattttagctgtctctttgcatattaccctctcaaccctccttacttgattggtccattccagtctccccgtttatccataattacctactctccctttctgaagtagatctatttgttccctctagtcccttattctctaccttctgtgatactgcaatttgtagctccattatcattgatttaacagctaataatcacatgtaagcaaatacataccattttagtatttct

SEQ ID NO: 36134 - DNA, 1191 bp, Mus musculus
atcagagctttttgttgtctaaatgagtgacctttgcttcattccacctgctgtcccactgtgtgagactgcacctactcatcactgcgctgacattctggcaaaagaaatgatctgaattatcagatcagccttggcctgagggtacgagctggtacactgatgacagtagcctcgaggttaaaggtaagcagaaggcggggacagcagtatggtggtgaacagaaagcaagtgatctaggccagcagccttcctgagggacgtcggcccagaaagctgaacttgtgactttaagacaagctctataaatggcaaaagaaaagtctacactgacaacaggtatgcttttgccactgtaccggacaatatacaaagagggctgttgacatctgcagaaaaagaccttagatgctgtggctaaagaaaatcagatggcagatctaaccgccaagcaggtggctcaaggaacaatgatcctggcagtcaaggagtctaaagattattatgacatcagagagaccagctttagatacaccgctgagcactatcaagctatggacagtatttggcttggcctgggggccaaaaaattcaaaggtgtggttaggtcctttgactactatgttacaggactctctgacttggcagaagaaatagtcaaaagcttcaaggcctgtgctataatgaggtagaatttctaaaagaaatcttcccaaggtaatagacctgcctttgttgcccaggtaaatcagagactggccaagatattagagatcggttaaaagttacattgtgcatgcaggccccaaagctcaggacaggtaaaaaaattaatagaaccattaagggatccttaccaaattgacagcggagactggcgctatgattagatagctctcctaccctttatgctcttcagggatagaaacacccctggacagtttagactgaccccgttataaattactctacagggggcccccctccactggtaaaaatagcctttgtacatggtgctgacatgctgctttcccagcctttgttctctaggctcaaggtgctccagtgagtgagacagcgagcgaaaaagcagctccagaaggcctactcaagagaagaagacctgctacattagagtctccacacagaaaaccttaagactccggtggaaaggcccttatcttatactc

SEQ ID NO: 36135 - DNA, 1164 bp, Mus musculus
tttcttctaataaaaagatgggcgccacggtcctctacccctgcgtggtgtatgaccatgggcccgagagcactcttgaataaaaatcctcttgcaatttgcagcaagacccgtttcttgtgggtgattttggggtgtcgcctctcctgagtcagaacgtgggggagccctcacattgtgggtctttcatttggtgcgttggccgggaaacgcgaccacccctcacacccgagaaccgacttggaggtatggggatcccctcttgtgtgcgtgtgtgccagccggtgtctctgttttgagtgtctgttttctgaaacgaacattggaacatgtgcttgttgtgttgggttgtttgtgtcttgtcctatgtttctgaagtacggggaagtctgagtttggatccgtctgagtttattgaatttgtgccttggttttccggttgcgagatcatgggttcgagtcccacctcgtgctttggttttacacctggcagaatgagaaacaagtgagattctctggttttggttgtctaggtagaagtggacgacggtgtttgtagacgatggggtgatggggttttctgaaatgtgcgcgtctgtatttgcagctgtccttttgggccgtaaggaccggaggactgtggtcggcagatgtgctaagaggaccacaggctgtggccctgggggacgccctgggaggtagggagagtcagggacgcctggctgtctccggagatcggtcagagggaccgagttctgttaaagcagaagcttccccctccaacatcgtctaattcttttgcctgcttgtggaggacaaggaagggtcgagtgtgtctggatctgttggtttctgttttgtgtgtttttgtgtatgtgtttagagctatgtgaaaatctaaaaaaaaaaaacaaaagcaaaggtaattctcataggtgctttataccctgactagagatagtttacacctgagatgtgagagaatgggttttaagaaaagtagtactctccaactatctgggggtaatttggtaataaaataaaataaacagtattaattggtctttggatccctgcaactgtagttaggaatctagtgtggctgaagaagccctgctaggcgctgattataaacgctgctcttatagggacgagcagcttctc

SEQ ID NO: 36136 - DNA, 1221 bp, Mus musculus
cagttcagttgtggcaggataacaacaatccagttcgaaatgttgcacaatccagcagaaaataccaggcctccaccaaataggcatgagtgagtggagaaactaggactagccatagtgctaggtcttctctgccatgcccctgttaatgaagtgaagatcagcaaatatcgtagatcaactgagcattgcttatatacctatgtcatcaaagtcccatagagatctacttatactctctccaaacatcacgttcttctcatgggttttgcctcagcaaaacaccatgtatgtctgcttcagcaaaatattatgtgaatcttcatcacataacacagtcagaattttccacttcatatcccccttttaaaaaaaaatcttttcccctaacattaacaacctacataaaataagaactataaactagaactttacatatttttttaaaagatttatcttcttttttttttttaaagatttatttatatattatatgtaagtacactttaactgtcttcagacactccagaagagggagtcagatctcgttacagatggttgcaagccaccatgtggttgctgggatttgaactcctgaccttcggaagagcagtcgggtgctcttatccactgagccatctcaccagccccgaactttacatattttaaatcaacagcttatgtacaatatagtcaaataaaaccatatatttctattaatatacagtaatttaaacaaaacaatcttaaattcctatcagtatcaaactaaaaaatcttaaatttctcttatgatacaataaatgcaaaacaaccttaaattccatcagtgtacaaaaattcaaacaaaacaaccttaaattcctatcaatatacaataattcaaataaaacaaacttatattatctataaattcacaataaaacagaacaaccttaaatttctatcaatatgcaataatttaaaactaccaccttagatgctaacaaccataacataccaaaaaaataataataataacaacaacaacaaaaaatccatcccaatttaagggattagaacaatagtcttttttataattgctgaattgggaagaattcctttttgggcccaaaggaaaaaatggtccaaatgcacaaaacaaagattattaaatgcagtaagtgattgggtctttctataattgctgttcctgtgggattgtgtggtatatcagtaaca

SEQ ID NO: 36137 - DNA, 1174 bp, Mus musculus
atggaaagaccccctgactaatgaatggaagggtccagatccagttctaatttggggtaggggctcagtttgtgttttttcacgagatgaagatggagccggtgtctgccagagagattaattcgtcagatgaacacagattctgactcttctggtaagtatcattctaaagactaaaattccttttgtgcttagaattcacctgagagcgaaagctcccaaagctgttctccagctactctctgagccagctcccgacaggaggccggagactagcctcagctttacaatttgcatttgaataaagtacctagacttccctgaaagaagttctgctttcctactttctcactgtccagattttgtctttcaagcaggtaaatcaacattctcgaagaggaccagcggatgtgcatccccgcccccctagagcacacaggtggctgctgttatctcctttccaaggacacttccagcacgtggctttcagtctgagttaaaaattaggtttaccaagagggctagaagagtagatatttctatattaataaagattggtttttattttgatagacaggcttagcccctcagctgacctctggcttttcacccttgctgttactgcaaggtgtccttagctcaataaggctatggaaaaaacagggatgaggaggaacgacttccagctcctattttagccacaaatcgtggtgttactaacgacataattcttgcttaggctttcctaattctgaggttgataattctcctttaggagctgcacagcactcagaactgtgcatactggtttgtgattgtacaaattcagtatgggcatcgcttggtgcagaggcactgcaggggaaggtccagcttgaccatttctgagtttcctgtgagataaacccggtttgaaagaggttggtaccaaattttggctaaaaatgaaaaatatttttcggctctgcctcacctccccaaaaggtacccagaggcacaggtgtgggtcttaccagtacccacgagaggaattgggtcaatgtccacccaagccaaggttaaaagcccactcatctacggatgagaaaatcatttgatcacctcagttaagcgttgccttatttaacttaattaataggggggagagagattggagacgtactattgaaagggc

SEQ ID NO: 36138 - DNA, 1126 bp, Mus musculus
tgctgcatattgctttttataaaatttagttatgtttcttgaattcctaatccttccaagacttttatcatgaagggttttggattttgtagaatgctttctcagcatctagtgagatgatcatttgttttttgtctttgtgttgtttatatagtgaattacattgatggatttctgtatattgaaccatccttgcatccctgggatgaagcctacttgatcctgatggatgattgtcttgatgtattcttggatttggtttgcaagaattttattgagtatttttgtatcgatattcataagggaaattggtttgaagttctctttctttgttggatcttcttgtggtttggttaacagagtaattgtggcttcatagaatgaattgggtaaagtaccttctgtttgtattttgtgaaatagtttgatgagaattggaattaagtcttctttgagggtatgatagatctttgcaataaacccatctggtcctgggctttttttttttttttttttggttggaagactgttaatgactgcttctttttctttaagggatttggggctgtttagattgttaatctgatcctgatttaactttggtacctggtatctgtctagaaatttgcccatttcatccaggttttccagctttgtttagtatagccttttttaataggatctgaagatgctttggatttcctcaggttctgttgttatatctcccttttcatttctgattttattaattaggatactgtccctgtgccctctagttagtctggctaaggatttttctatgttgttgattttatcaaaaagcagttcctggtttggttgattctttgtatagttatttttgtttcacttggtttatttcagccttgagtttgattgtttcctgttgtcctgggtgaatttgtttccttttgttctagagctttcagatgttatatcaaattgctagtttatgtttgcgccagcttctttttggaggcattcagagttatgagttttcctcttaggatggctttctttgtatcccatatgtttgggtatgatgtctctacattttcattaaactgtaaaaatctttaatttctttctttatttcttccttgaccaa

SEQ ID NO: 36139 - DNA, 1193 bp, Mus musculus
tgtttgtgtggaccccagatcaccaaaaagcctttaaagagattaaaaaggccctactgatggccagcctatgcctgacctaaccaagcctttcactctttatgtaaaagagagagcaggggtcaccagaagagtccttactcagactttgggactttgaaaaaggccagtgacttacctatccaagaagttacaccctgttgccagcgggtggttttcttgcctgaaagctattgctgccataatctgcttgtcaaggatgctgataagctcactctgggacagcaaataactgtagtggcatcccacactcttgaaagcattaccaacgctcctgtgacacatcagagctttttgttgtctaaatgagtgatcttcgcttcattccacctgctgtcccactgcgtgagactgcacctactcatcactgtgctgacattctggcagaagaaatgatctgaaggatcagatcagccttggtctgaggacagtagcctcgaggttaaaggtaagcagaaggcggggacagcagtatggtggtgaacagaaagcaagtgatctaagccagcagccttcctgagggacgtcggcccagaaagctgaacttgtgactttaagacaagctctataaatggcaaagaaaagtctacactgacaacaggtatgcttttgccactgtacggggcaatatacaaagagggctgttgacatctgcagaaaaagacctaagatgctgtggctaaaaaaattcaggtgacagatctaaccgccaatcaggtggcccaaggagcagtgatcctggcagtcaaggagcctaaagattattatgacatcagagagaccagctttagatacgtcgctgagcactatcaagttatggacagtatttgacttggcctgggggccaagaaattcaaaggtgtggttaggtcctttgactactatgttacaggactctctgacttggcagaagaaatagtcaaaagcttcaaggcctgtgctataatgaggtagaatttctaaaagaaatcttcccaaggtaatggacttgcctttgttgcccaggtaaatcagagactggccaagatattagagatcagttaaaagttacattgtgcatgcaggccccaaagctcaggacaggtaaaaaaattaatagaaccattaagggacccttaccaaattgacagcgg

SEQ ID NO: 36140 - DNA, 1231 bp, Mus musculus
tatgtggatagatctctccaaatgggcaaaggatgtgaagatatttgtgtcccatgtaaatgctcaccaaaaggtgacttcagctgaggaggagttcaataatcaagtggataagatgacccgttctgtggacaatcagcctctctccccagccatccctgtcattgctcaatgggcacatgaacaaagtggccatggtggtcgagatggaggtaattcacacacagcctttctgtctcttctctcccttacccagccaggtgagaacaagaccagtaccacaattattgagacaaatctgaagcaaggtttattaaacactggccagacccacacccaggattcccagagagctgtggagaattacattaatccagcgctcatataggcaaactttcccaccttcgtccaatcagggacaagcgtacatcctgatgtaccgccagcctagcacccccacctgtgtgcgatcaagcacatccggttttagcagagcagggaagctccggagaggtgggctgagaagcggaggctgctgaacagactttggagccatgaatatatttgatcggaagatcaactttgatgccctcttaaaattttcccacataactccctcgacacagcagcacctaaagaaggtatttactaatgcgtttgcgattgtacgagggatagttatatcatgttaggcgtatttacaaccttgttattgtttcatgtgaacatgagatattatttgtgtcaagttgacaaggggtggattgtagtggctattcctggttgtcaacttgacaatatttggaatgaactacaatccggaattggaaggctcaccagtgacccttatctggaggcttggagatccttatctggatcttggtttgaagatcttgagccatattggctatggattccagaagattgaatctccgagtttaaggaacacacctttaatctgggctacgcctttcatctgggattaaaggtgtggtggaacacacctttaatctgggctacaccttctgctggagacaatataaggacattggaagaagggagtctagctcttgctcctgctccttcgcctgcttgctgcgtgagactgagtaactgctagatccttggacttccattcacagctgtgactgaacgattgttgggaattgagctgccgactgtaagtcatcaataaattcctttattatctagagactatccataagttctg

SEQ ID NO: 36141 - DNA, 1235 bp, Mus musculus
tgtgagtatattaaattctgatattagaagaatttgtctacaaatcaaatatgtactattgaatttaaaagcttatatttttgagctcagactaccatagtaattcttgttggaagttataagctaagattttttttaatatgaacttacctatctacaaaaaatgttaaatcatattactgttttaaggaaatgaaggtatgtaacttaacttcattttcttaccaaaatatagctgaagtacaaagccattttttgcattagaatgaaaggtgtagaaagctcaagtctgtatgttaccaatgctgatactcagtataaatgctttcactgtataagtactttaagtggtgtataatgaatggagaaaagatatattaatttaatggccaactacatatttaaatgctttcatgtccaccaaatctttttcttttttcaccatatctttgagtaaaatttgactcagtttatttgggattactgattgtttttttctttcttttttttttttgagatgtgagaagcaattatctaaaccaacttaagtttcctcaaagagttacacaacatttaataatacagttgaaataattttaaagaaatacttgtaatatgaacgctgagatcagaaccagggactcatgtatttaagggagtcacctgttgtgtgaattgagggaattggtttggatggcatttcatttttcttcccagctctaaaatattgtggtttctataatctctctgtaagcaaccatgtactcaaataatttctgtaatcccaagtaagctgcttaaaactgctttcttcaaagtacacgtgttaaaaaaaaaaagcacccattatttcaatcaataaaataaagactatgttctcttagggggtaaacaaacataaactgtaataatgtctggaatgctttcatattcttaaggttatttaaaaggatggtggtaacatggcagtgtacattcattgtcatcatagctaacatgtgtgtttgcttattgtgacctgatgatattgcatgtgcttcctaacagacacctgaataaaactgagttgtctccagttttatgaatattactaatgtttgatgtcaaatatttggtggtttttaaatcagatggtccattgacaagcagctaaagtccttgactcacttggtatgaaagagcaagctcattgttagagattgtacatggtatcaatagtttaaagaaaatacctg

SEQ ID NO: 36142 - DNA, 1148 bp, Mus musculus
tcttcctttacaaaaattccaagactgtagatttttccaatctttttttttgtttctatgagccaaatattttgatggaagacaactgactgacaggcatgttttgaagctttctcaccttggagaaacagtaattagtactgtgttctatcattaaaactatgaaaattgtttacttaatttccttttaaagataagagggctgccattcactgagcaacaatattcaatacgaagcaatgcttttaccttttcatcatgacagtcaattttgcaccaattatcactgaatgtgtggctgttggcccgtgtggagcttaggtttctgccctgctatctgacttacattaggtgttaaatatgctttgtctgccctatacatttttactttttcattatgtattgatatactcattaaaggtgtttcctcatttaatgcaaataggatggtacctgtcacattataaaaaggttttgtctttataaaaagccagtgttcccatctgaaaagtaaaaccagtgttaaagtggaaaaatgttccgtgccacatgtaagatataggaggattatagctaaattttagtgtaaagctatgttttcccctctaactaactgctcttgttcttttatatgggatttaaacaatgaaaaagtgagctgtgagaaagagtcatcttgctaggaaagggcattaagagatgatgatgcaacacacagctatgtgtcagaacctgtttctaaaacaagcaagtctgactttgcatcattaattatgttacaattagtgttggtcaggaggatattaaggaaaccacaagttgatgttgtaaaactattgtttgattctccacacatacttagtataatgtccaataatagacagctatatgagtattaaaggaatagcagattgagtaactccatgttgagtgaacttttaatatgtatgtggagagcctagtctgtgtttattgctctgaaaggcaaatgcttgtcattgtaggaggggtgagggtagacctgacctatgggagctggcatgcatagattatttagtttcaaataacaaagaagattttatagtttcaaggtgcaatgaagaaatgaacagcttttgtgagtattgttaaagctgtcctactaaatt

SEQ ID NO: 36143 - DNA, 1128 bp, Mus musculus
gaaaaagttactcacctcacattaggcagccacatttcctcatccttatgataatatgcagaaagcagtttacttctaattttatgataattttaacgagtacttttgaaattgagattttagaacatgactgattacaattttcacaacatgtgaggcattgagcagtttcagaaaaatctcaatactatagaataaagtggttatatcgactatatctacaggtttgtagacttaataaatataggaagtagttgaaagttgtagtacacatgtcaatatatatgcatttatagtgactgttgttggtttttttttaaaccattattagataatttttcatcaggtccttttcatccatgggatggatgtggtaaaagatgtgaccaaattattttctccatgcttctcttgactaatgaatctcatgtatttctgtatgtgctttagctaaatgaaatctttttcaatccaaataaatcattaaaaggtcttcaatggtccacattttagttgtttcatggactatgaacctgtcttaattgttaacacagactctcattctttttttttggtcccatatctatgataaagaaacaagggacaaatataaccgctgtcttctttggtgggaggaaataatttatgtcaatagcgtatctttcatttcagaggactgttgtagtaccaaagaagacttttattcatctaaataattgctgcttataaacagggtgttaattttttttaaagaatttgcttctcttttttgaagagtctgaaatcatttggattgctaaatcatttctctttttggattcttatgaaatcatttacttggaagctgccattatatttttgtatcttgtgatatctcactaagccaggatacttaatgggctttcagttaaaattgatgtttgttttaaaacactagctgaaaaatttaacacatcttgatgataattactgttatcaaatgaatattattcaatggtggattagttgttttttgtacactgctcaatatttgatcagataactgatttgacttatctttagattttaacatagattatgtttatgttgagtttcctgttgtttccttaaacagaatactgcctcaga

SEQ ID NO: 36144 - DNA, 1197 bp, Mus musculus
ttctttaacattttagaagaaatcttttacatgcctccttttgccaatcaatatagcttctgctctcaagaaactaggtctaaaggggatgaagacagatgacaacagagaggtatatagaacagagagaggaccaaaagaggctatattgtcagcgttgcaaagtgagagaccagcaactgtgtgtggtttctacagtgttttgaatggtaatgttttttcataagtgctaagtctagatccagagtacatcttgtttcatggtcattttctgatctttcatctgtttctcacatttgagctgtcagcttctgctacaaagaagagtaaacttaaggaatcccttctacaggaaataaggaaggtttaatttagaggtaggtgggatgctttatggaattttttttgtttatattctattttgcagcttaagagagagatgaacaaacaatgtataaaatcaccccagttatacaacagctacagaagggcttattgtgtcatgggcacattaatcttcaaatggtgggaggaatatttttacggataaaataagcaggtagaaatttcgtagaggtgctgtagacagtcgaattttcaaataactaatttatgtattgtggttacttagagattgtagcattagttaaaaaaatgagggctggaagagccagtgaaattggaaacatggaatatataatgaagtaggtctgcctggccttttcccttttgtttctgtaacgctgattgcaagctgaaataatagcatttgagattctgctgctgatttctttttttttccccccacgatcagtactgcttttcaattttcatatttacaagctttactttacaaagcaaatctgaaagctgcctgttattgggcatagctacaacttcatccccaggttatatggattctggctttgtgacttttctgctggtatttactgcacagcttttgtgtaaagcctttcttaattctgataccctaaaccaccttctattttcaccttactaggattcctgtagctctttctcttacatatgtatttctttcctatttggtaatttctgtgaccaaattcctaagagctttttaaaaaatgtcattccaagtttacattatagtaatttcaacacttgaacagtaacctctatcattgtttggttctatctttctgtgtccacaggaca

SEQ ID NO: 36145 - DNA, 1191 bp, Mus musculus
tatacctatttttaatttattttatttctatacttttttgttaaaaactaaaatacaagcagcattatactgggcctagtcaaggtcaatttaatataaccacctaccactgtgacatattgttccagtagaaggctgtcaaggtctttaacatgtataacattcattgtcttcactgttaacagtgccttcttctagaattcttcatgaaaatcccacattactttgttttacagttaaattttgtttaataaatagtttcagtataataacaataaaactatagtacagcagttttataaactagcaacagtcatttatagctagttattttgtatccttgtgcttgctattttttcatgcaaataggatataggaggtttttttaatatcaagattgccacaatcattaataataagttttattctgatgtacataggtgataaattttctagtccattatagtcttcctgggaccaccagtgcttatatagtgtgtccttactagatctgttagacaatatcggaccatgcatgaaaattttaatattttttcttggatgtgggttaattacatggtgtgtgtgtgtagcttatgttcctctgtgtgtacattatatctgtgtatatgtgtgcatgcatgtacatgtatgtttgtgtatatgagagactcagtcttgctatatagaccagttttccctatctttttgggaaccagattgggtaatgtgtgtgtgtgtgtgtgtgtgtgtgtgtgtgtgtgtgtgtgtgtgtgaattttataacaacatacaattgttttgccctgcctgccatatgttaaaatgccatggcaaatactactacagttaatcaagttgcgatgaccttagtgtatatcaaatacagatgtaatgtaactcagtcataagtgatatatagaattatttttggatgagggactagtgagtgatgcacataaatatgaatattaatattgaaaatttatatgtgtatgtgtgagtgactgagagagagagatagatagagggaggcaggtggtgagatggacaggggagttggagaggtgagatggagaggaagagaaagagggagagggtgtgatgagtatgaaaccaagagcctctcacttgctaggcaaatactctatcactgagattcattttgtctccaaatcaatgctgaagtta

SEQ ID NO: 36146 - DNA, 1117 bp, Mus musculus
gttttatggatctctgtaatgaaaccttaaatgttacttgggctctcataccttattgtctgttctaggctatataggatattaatgaagacctttccttttctcctgagcacagaaagaaagctcaggtcacctccatgctacatgacttagttgtgctacaaatgaagagatgtggaagtcagatgtgtagcccaatttcacaaacttatacttttaaacactactggtgttctctgtggtatacctgtatatgttaaagctctattatcagaaatctcaactggggagtcatagtctccttatctgtctcacataacaaaacagtatgctttgaattcttgtgtattgacgtgtcttcttcttgcataccctatatagctaatgtaagaatttagtgtatatagcttttctaaaaattttagttattttagatattgtaatataattacagtatttttccctctttgttcctccaatccctcccatatacctcttctgctatctttgaagtttatgctaccttttctttaattgaaggtattgatctctctctctctctctctctctctctctctctctgtatatttgtgtgtgtgtatgtatttggatgcactctaaatgcacaaatacaacccctcagtctgtgtatgttacatgaatatatatttgttctgggctgaccatttgctattagataacaagctgtggggccctttgggggagaccataatttctctctagttgtctgtagttctttacatagctgactgaaccaattcatccactaaattctttacagtgtgtggaaatatgtgtctcaatatataatactattccaaaagaaaaaaaaagaaaaaaaatgttgctacctacccttggttaagttttccatgcaaaagttatctttgcttttcttatcatagcaaaattaatactattatgatttatctctgcataccaacatcatttcctaatactgtttccatctattggcatgagtttaacttcgataatttctaatttaagttacttttatatgagcctcaacaaaatatgtgatgcattcaaatggcagacttaactattatgaattatcaatatctcctccattaga

SEQ ID NO: 36147 - DNA, 1152 bp, Mus musculus
ttctctctttgctttaccctgcttttcggcatctaggtattgcttttttgtaaatattgtttatgttatattattttcaaatatccataatagttaattcttttcaggaaaagcttattatctcaagatatgtattcttgaccatactttcagaaacagaacttcaaggaagaacttttacattaaaatttgatgtccaacttattttattattattttatagctttttggatatttgaataaagaaagtattctaccttgttttttcttgttaaacttaactgaatattaatactcattttaaaatgatgttaaaatagccatcaagtggacaattagcatagttattgtatcttttttttataaaaaaaaacccttgtatttatttttattttctagtgtatctcacttagttcatattcttaagtaacaaaatgatgctttaaataggagaagctgaaaacagcataaatatggtatatgtagatatttgtattatgaatggacaactaattatgaattcatgtgtacgtctatgttacttatggtttattagatcatggcattatggaccttgagtaaaagctgcctacctgcactaacagaaactctgcttgtcatgcagcatggcttcacattagaacattttgtcactgtaaaatctaccacttataatggatttacaagggaaagtcaaatgctaaaataggtttcctacaaaagatggaaattaaaaaaaaaacaacaaattcaccgttactaaatatatatatatatatatatatatatatatatatatatatcaatgaatgcttgctatattgtagatatatcttaatcatccatacaaatgctggagtccagttgctgctaaggacttgtttttaaactttgttaaactataatttcaacttctatctcagaaatattagaaactagagtagtggcttagtacatactggaaatattttgttcttgtggaggacctgagctttgtttccagcatatcatttgggtggctcatacctgcctacaactccaaattcaggggaatcaaaagcctctgcactctacgaatctactgttttgtgtacacctagtcacccactcagtgcccccacatacatctcatatgtgcacacacccatacat

SEQ ID NO: 36148 - DNA, 1204 bp, Mus musculus
aataaatttaaataggaatgggttcgtctgaactaatggctgagtaaaatgatgacatttctatattaaatatgatgatttggtatattacattacacattttcatttacctcatagagagtagaatttttatgagcagtaactcagaaatgtgtgaaatgagttcgtggagccattctctccatttaggaaaatcccttagcagatactggttttagttgttttgtggaatacctagtaaaagattctaaattttctgtacctttttctttagtttcagctcaaatactcaagagcaaccttgtagcaatggaacaaagcattcttcatctggagaaaaacatcaagaatttcccaccagcagaatcgcaccatgataagtttgtggaaaagatgatgatatcctttatataatcaagcatttgtttctgtgtttgcatgtgtctatccatctttttactttgtggttagttctagactcactattctgtaacattagatgaatctgcgtgtatgctgcttttgtttttttattagcagattaaattttatttcacagtgttttgaatttggtagaagcaagagaacaactggatcaaaaaattaccagttttcaaggacagatttgattttgtttggaaaaccacaagatatacaaggtaaatcttaggtggtttaattatatctgaaagaacaaagcaaataatcttctttagtaatcaagcgcttaaaagataggatcattgtgaaaaaaatgaccttttaaagggggttataattatttctctcttctatggacatattcacatgcattgtctgagggtatccatgcattttgggtgactaatattagtagactgaaagataaatggatagatacatggatgcgaagagaaatgaattgatcagtatttgatggatttaaatcagctgaaatacatgaatagagataacagtaaatatatcttgatatatacatatgtatgtcttgatatatacatatgtatgtgtatatatgtatatatatacatacatatacatatatatatatgaaaaaggaaactgtgagaaactatatttagtttgaattgttgaatggtaaagctggtgtcttaagataaactacattcagagctgattttctttttctattctgtattttcagtaagagccatattttcctcctctgggtttaaataagtaa

SEQ ID NO: 36149 - DNA, 1146 bp, Mus musculus
ataatttaaaattaaaggccgaaactttttcatatttaaaaatttcatatgccagcaagattttgctgaaaggaccctgatatagctgtctcctgtgaggctatgccagtgcctggcaaatacagaagtggatgctcacagtcagctattggatggatcacagggctcccaatggaggacctagagaaagcatccaaggagctgaagctgtatgcaaccctataggtggaacaacaatatgaactaaccagtacacccagagctcctgtctctagctgcatatgtgtcagaagatggcctagtcggccatcactgggaagagaccccttggtctcgcaaactttatatgcggaaatacaggggagggccagggccaagaagtggcagtggatgggtaggggagcagggcaagggggagggtacagggaactttcgggatagcatttgaaatgtaaataaagaaactaataaaaaaaaaagaaaaaactacaaaatggatagaaagtacaagttaattatagcttacgcatctatggcatgttggacaaataaaccttaccatagccagtggggtggcctttgactgaatttactcaaataagttgaaatattgtgagatttgttgacaggaaggaagagtggattgatttggccaaagggaggaagagaattaagctgagtatgccattctatgagtgatatagctaagaatgagaatttgatttctttcttttttgttagatattttctttatttacatttcaaatgctattccaaaagtcccctataccctccccctgccctgctccccaacctacccacttccacttcctggccctggcattccccgagaatttgagtcttatttgggatttagtatgaattcaagacatgttattcctgagaagttatcatctatggtgattttctttagaaaatacaaaatagaaactaaatggactcttaattttgatctctgacctggttccctcttctctctctctctctctctctctctctctctctctctctctctctagcatcttaaataacccatactaacctctttcctcctgtcttgacttagccactttgtagctctcatcatcttctttatcttattctctttgtaccatgtcttttgat

SEQ ID NO: 36150 - DNA, 1686 bp, Mus musculus
acaggaagaatttctattgtctagtttcagctcatcttatgtatatagtgtaaagtctaggagaataggcgcattaatgattgtaaaggagcaaatatcacactcagaaagagaagcccaactcaaggtatttagaacccatctcaagtgaaagctaatggattcttccatgtggcagaaattaaccttaccattactctaatgttgcagtacagggtcacgggcacttagcattgctaaaataaaccaaagtttaacagaatccactagatttcactcttatttaaaatgtatttaagaagtctccacagacttatagaaattttttatataactatttttgagaaaagtgtagactttttcatgtatatgctagggatgagcctgaaattctcttgcctttatttagattttagaggaaaatattgatttctacttcttccattacttcattctcccttcacccccttagaggtagggaacagaactgcagaagagtgtagagggggaaagtgacattttaatgcaggaggcagtaggaaacttttgaaagttcaattggttggtctctagttctaccccttttcccactccactctggtagtgaaaaagcaattctctctccctcctgccctcccttttaccctccctctcttccttcctccctccttccctacttcactctcttcctctccctccctccattccttcctttccctccctcccctgtccctccttccctccctacctttccctatgtccctccccagcatgtgtatatgtatgtgtgtgtgtgtgtgtgtgtgtgtgtgtgtgtgtgtgtgtgtgtttgtgtgtgtgtgtgtgtatctcttactgaaataacccatacccaactctctgtcatcatcatacttacttaccttatattattaacgcatttcagtgatactgccaaaacaacgctaacaggtaaagaagctcggcattgttttaaatatgtgagagagcagaagttatacttaacttgtctattctcctacaatgtgcatttgtaataattggtgtgacttctctggagtgtaatttcaagactaattcatgcagatgattgtgattgctgtaaaagattgcttgtatgtatatttcttatgtagataattctatttctattctgccaaagcacattatagacatttagagaaaagaacaaataactggcttgacaagccaccttctgagacaaagtaaacaagtgtccagtagctcatcgactctttctacagatataaagtaatttacatggttgcctttcactcgttcttacttaggtatgatacttcaaaatactctgaagctactataagtagaaaaatcagaacgtaacaatgtctgagttttttcctttttttcttatgtgaacacacacacactttagaacataccactttcacacacttttaaaacaataaccatgaagtttaggttctactaattaatgtaaataactactgtatgcattttcaattttacaaagtattttctgaaatattgtggtatggcttatttgaggttttttgtttttgtttttatagcttttcgggctgtaaaaaaaaattaatcttgaaatgtaaacgttgactgaaatttagggcatttgccctgccatattttctaactggtcaaggttgaaatactgaggtatgt

SEQ ID NO: 36151 - DNA, 3170 bp, Mus musculus
atatttgtatttaaatgcattccacatgcttttcacaaatattagaaaacctttcaggggacagacacagaattaactcatgtgacttataatggtcctgttctggtcacttgcattttttgttttcggtcgaaaggtatcatctgaaaacaaaagtacatagtggcatttttttaaaagaaaaccaaattaggctgaagtattttatgtatttttgtttatatctgccacacatgaaaaatgccctttctacagctttttcttcagcatattacaaaacaagttaactgtttagaatattttcctttggctactgtaatgattgaccatcaatcttgtagtttaagaccacaacaatttattgtcccatggtcctggaggccagaagtttgacatctggacatcagaccattcatgctacctccagaggctacaacagaggccccttctgtgatttgtccattttttgatggccaacggtattgtgtggcttatggccacatttttctctactcctttttatatcatcttctctgtgcacctgatctctctcagcctgtcctgtaaagatgttgatggtggcatttagagaccgccatctgaagacaggataatcctctcaccacacacgctgaactttatgatatctctatgacccttctttcatgcaagctaacatctaggttctttcctagatagcttagcactgtacttgagatagttgaatgaatccagaaatgtgtgcctgatcttttcaccactattcaaaagctggcaggccgcatccttttggtgcacgcctttaatcccagcacttgggaggctgaggcaggcggatttctgagttcgaggccagcctggtctacaaagagagttccaggacagccagggctacagagaaaccctgtctcaaaacaaaacaaaacaaaaacaaacaaacaaacaaacaaaacaacaacaaaatttatcttcacacagaatttcctcattttatcatctttcactattaacaaaatttaccaaatcaagtgctaattccttcttgatataatggttctttcttcacttcctcctatcgggctcttttaaaaaacttagtacaaaaataatgagtttcattgtggcatttttcatgccttgttgttgtcattgatgatgatgatgatggtgatggtgatggtgatgatgatgatggtccttctccccaccttatgtgccctcgcctctaccactacccactgctatggtccccctagtatatcccatttcactggcatgtctcatatgttctagtatcgtctcttctcctccccattctcctaagacttcttttccccagcaaaaatgaacgagctatacctacaacagggcctgccaagttcctcaactttgtcccttacaaggtcaagattagctttccataaaactgtaggagacaattcagataagttgtttggtttggttttgctgctatataacaacaatctttcttgcagttcccactacagtattcatttcctcttgtgccctcaccagaaatgcctttaacatccacatttccatcaggggtttggctcaggcaatctatagtgtctctattaagtttactatcaacaattgtaccatcctctacccagcatcaaattccaaagccactttcacatctgtaggtatttgtcatagcagtaccccacctcatactaaaatttatatcacattcctatggttactgtaacatattcccacagacacagagggataaaatagtagatttctggttctgtggtgtttttatagccacaactccaaaaccatgatattggcaagagagcactcctctgcaaactctagagaaaaatccactccttgcatcttctcatgtgattgtcattattccttggattgtggcttcatcttactactctgttgttttgacagcttcccctctgtatatataatctacctctacttctctcttatgaagataattttgatgacccgtccggattatctattataacatcctgattttcagagcctaaatttaattacaacttcacatacctgctgaacagaataaggtaatatcacagattctgaggattagcacacaaatgaacatgtctttttgggagggaggagcataattcagccactacagtagtcattgcatataaatgtactttatactttttaaaatgcatccttggtgctcaagccagatttaaggttgttattaaaagctattgtctgcacaggctactgcatgctttgttactaaatagacaaaatggctattctaaattttggttgatattttcaccactgtaaccaattagctgaaacaattcacggatctcaactctgctctagtgtgtctcttctgcccttttttatgaagcctttgttcaaatgtcttctatcatgcataatgtaggcacaaaactacctctgatacagaagggttctttacaagcttcctttagatattgtgaatccctcagctgaagtgagaggtaaaagcaaagactgtattgaatgggtattgagggagattttgtccatagcaagcaactatttctttaataaatagttccagtagcagtaaagctgtcaatttgtgctgtcatttcacctcggaataaacacctgtatttgcgctggaccaataatgacttgcattctctgtataatgcctattaattcaataaagcttagatctgcattaaatcttcagtctctgattccgactaaatatgaatgaaaaggcatgggtgctgaagtgtcaaaaggattgaagacattctaggaaaagcttcagctaaacagagcttcaagagtggttttggaagggccaggtcaagtggagatcatgggctgtcttcaaagacttaagagaactctaaggtttttcttagcattcctgcacacttctcatcaaaatagtagataaatgcttatacaactaaaaagtggagatttatatgctacatgctcaacacaaacagtttttgcagagatttgtgtctgtgtgtgtgtgtgtgtgtgtgtgtctgtgtgtgtgtctgtgtgtgcattatatacagtgctaaagcaaatgggcttcagatgctcagagtggtaaatgtccagaacaagtaaggaagagtggcaggcttttattctctgga

SEQ ID NO: 36152 - DNA, 1160 bp, Mus musculus
tggaaagttttcttttccctacgcagactagtaaatgaaactgttcagattgaaacttagagttccgttgatcctctgaagccagtagaaaaagtgaaggtttatcttggtactgaatagatagtgggctttggaattcagtacttcctgcagaacagtggttctcaaaatactgtctcagagcaacatcacttaggaacttgttagaaatgataattctctatccctgcctagaatgactgtataagaaatactaaggaactggcccagaaacccatataaatcagaggcccattcaagtttgagggcttgtaaaagcacaggtttgtagagcctaatccttagagtttattattcagttgttttgtggtaggaactcttttcctatctacagatgcctaggagatactgaggagacaatgctccagaggaaacttgcctcataggactaactgcatctaaagtggccatttatacagatttgttgatgtggtgaccacctgatcactaatgaaagatgtagttctgaactctgaaactggaaagtacccagagtaccttccagatgctgtcatctcagcatatggctggtagaggggaattcagatgacttttcctctacatctcccatttcactcaaaaggaaacacaaatggttcacttgacgtggcaaagacaaggagcagtttggggagaggcagggatggaaggaatagcttttttgggcattcaaggtggagaaaggattattactgtatataatccattttatggggatcattttgatgtcaaatgttcccccaagacactctcagcaagtctggtccacttggctcttttcacagggtaataaaacccttctgactttgacaaactggcataaatgagctgaagaagtccattgtatacagtcctagtgtttgccttcttggtaaaattacattttaaggatgtcatttcatgagtcaaattgtatctgctgacactaaagtgtattgagatgttgttctttagtttaagtatgtatcaaagtaatattcaaaggggatgttatgggggtgggactgggactgggtggctttatattgatattgaaatattccagagcaaaacacattgtcctaatgaagttgttacagctctctttgttttcttgtgaa

SEQ ID NO: 36153 - DNA, 1149 bp, Mus musculus
tctctcttttgtaattcaagaatacttaaaaagaaaggctagaagttagagcgctagaattcaaaagagaatttattttcttaagtttagtagatacagtcagctttttgaaatgttttcattatttttatctgagttcctagctttatacattactaggaatactttcttttgtgggaggtgggagggtcttaagggagggggtgggtaaggcactggggatggggttaggtaagggagaagatttctggaaaaaaaagacacctataatgaagctacaaatccatcctcatttcctattctgtactgaatactacctcatgcaaaatattggcatggctgcaaatttccccctgacactgacagagatcagttgtccttccatcttcttcttgccttagttaattttctctcatatattttctcctattctgatttactttattttagtgtagtagattatgaattagctatttatttttgttcttccagatgactatttaatgaacacgttcagctttttacaagtgtcctttaagttaggaagactgcctatagaatttccactgctcttcaccatgatccatctgatagtatcttgttagctagcgcctcaaggtcactttgtagtcagactgtacagttttctacaggtgtatttcttactagagagtttgaaagattgtggaagatggaaatggaaggttggaatgtagagcagccactgcctgcaatagtcttaccagccacttaaaaacagtagcggtggcattgattttttttgccttttacctttttttaaaaaagcaactaaatttcttaaattttatccccagaatttactttcaagctttagattcatccttttaccctatctaaaacattgttctcagtgggcagtcagatgttttttttctgtttctaaactattatgttcagagaatttttctcattaaggaaattccccctgccccctccaaccctccaattgtctgatggaagtacaagtgcatcctaggagggcgggttctaagggcaggctgtgcttgcaaatcggacttttgcacaagggtcttaaatttcccaccaaattgggattcttcccctccccttttaatacatgtgatgaaaggctacctaggccaatgg

SEQ ID NO: 36154 - DNA, 1623 bp, Mus musculus
tgttaatgtttcccctagaccttaatggtcattcatacagccttagtgcctaatagtgttgctttctaggtaaaaagttaatttttttgtagactaagatttcaatgagttaaagttaacctggcctaaataaaaaaccagatgtgggggaccattgttactggctgaattaatctccagggtacctggaatatttgaactggggcatgacctgggagcattgggggggtggggggggggctgcactagcaggaatagaccagaatgcagacaaatgccgatgatgaaattagacaacaactaaattaactatgttttctttaatttttggacaccaaggttacctttgtgagttataacagcgcctggatggagactgacatctgcttagcctgaaaagctacaccagtaggctgattcaatcaagatacttgtgtattgtattctgtgtccactttctgtcctattcttacacccctgtatctctgaaacactggaagtgctagtaaattgtaaatgaaataataccctgtttcccttggatttgatttctcagtgtaggaattgtgagaagtgctgtgaacttgccatttccctaacagtgtcactggtggaactttaacccctatgaatttgtcgttgatgtagtgtgatagaaaattggtctccttgagtgggccttgtactagtcaagattgtctggcttgattatataatatccaaaaaaaggaaaacatttccttagcctctgctggtaggcagagttgcattgtataatttcatcccagctggtcatcagatggtgcccatcaatggcgttcctgcatggtggtaccagtctcaggctttgggtgcaaaggacagagactaagagccaccacttgtattctgtgatacatcagctttcagcacacaatgtatgtgcttttatcaccaaactaaggcattcatacggattctactttattatttgaaaggttataattactttaatggcatcagaactcttgtattttccttatgaatttactggaacttacttgattaactttagctagctattcctcaccaagcaaatcatacttaataccaactgtcagcattttggttaattttaatagtattcattttgttttgtatccttgattaataaatataaatcctttacacaataaatactgcatttcctctaaaagaatcgttttaatttttagaaactactggaatggtggggttttttttccactgagaaagtgaaaccctacatttccacatggaatcccatttttagggatgaaaggtaaggccaaggccttgactctgttattaagtatccctgttgaaaatagcattctctatgataatatcatattccaagtcattaaatagcatgtgtttaccattttcttaaaaggtcaggcatttgtagtggtatagtttgcattgaaaagttgcataagagatcatatgacctgtatctttaggataatgaaataattcctttgactttgagtctatgcatccaatattaacccccccccctttttttatcacatagtccctgattttgtggtaagaagtcaaacacatcagtaaaatggacaaagcctacccagtttatga

SEQ ID NO: 36155 - DNA, 1133 bp, Mus musculus
taatgacgtctgcatccgaacctccccggatgaggcagatggcgccaggtggaggtcttacatcgccattgctccaaaggaaagcagtttattctgttgtcgtagtgtgtatattttctgtgacattaaataaactttgaacacaagtttaacatactacaaattgatatacataatccttttgcttttaagaagctaacagcaaggatgtaagcttaactgtgatttctaactgcagcatcattctttaatcttacattgccatagctctattcttactttagcataagcatttattcttcttaatgatacttgagaatttctcagaaacaatgttttcaggaactttgatttttgttgaatttgctttcagtaaagtaataacactttaccccgtgaaaactttctagagtctcagagctttctgggaggaaaacaaaaaagcacgtggttagaactaaaaatgatcagaaggccaacaagggaagagcgtaccacaacagtgtgtttgcttccagaaatgccagttatccaagtgtgttgtttggtcagtagcaggtgtgaacatacataggacaaaggctgtcgtggcactggtttgcaaaagattgtcgtaaagctctcctgtctaggtagcccgctttacaagtttaaaaaggcactggttttccacatggtcaaatttaataaagaaaaccaagtgaacaaaatatattccaatctttcagaaaatcacaaagctttcagccctgtcatcttaactaaatccattccaagaacttcaaacagaaaaccctaaaactttgacattttcaagtctttaaagaggaccaagtatagagcaccggacggcaaactgcccgttatggttgcctgcttctttccaagtccgaccaacttggaaggcaattagtgccattagcctgtgctaacctgcaggttgccttgccttttgttctcccacagtggcattaaggaggaacttggtttctctccaccagtttgacctcaagacatttgaagagttgccttaataattattaagtttactagcactaattgtaagcttatttgtattcccagatccctaccctctgcattaggattatgggcaggtgaattaaaatcactac

SEQ ID NO: 36156 - DNA, 1708 bp, Mus musculus
gatgttaattatgcatgcacttctttgtcattaccctctgtgcctcctgcagaagcagtccttgctgtgttggttttggcagctgtcttgacttaaaagcaccaatgtatttagatgcagagaccaagagcaaagtatttctagttaggaacttgggttttacacaaccagttccaaatcaagataagtgaagctgaagtgatttgggaaacagttgtctagtagaaaccatgtcctggaaagccagcacattttcccgaagcctcagtaaacttaatttgcttagcaggcattcaggtgactaagttgacaagagcagtggcatcccaattcatcactatggaaacactcatcagtggttggttggtttgtttgctgttattttttactgttgtaataatacagttagctaccccacgttcatgatctgcctttattatgttcaaaactaatgactgaaaaataatcccacaaatccttcaggctgtaagttcctagataattgaaaacaaaaatgtgttcacttttggttaattaatggtacaaattagatggtctagtgctaactctatagattcattctgctaaatgtatgaggtcaactgcctgagtacagtgaagtgtggagttttttctccctgaagagcctgcacctttttgtgtaattcaccataactaacatcccagagccagcgtgcttattgtcctggttgataggaaaaatcaacatttttgtaggaaaaagagtgacatttagtggatgattcctgattgagtaagacctggaaaatagccaaaattataacttttttctttttataatacattcattaacaaactcctttaacaacaacaaaaagcataaaagagcttcagttcaattatctcatgatgtacgtcaggcctttccagttattccaaacaatacaaagtgacaatatagttggcttctaactatagtacaaatttgattacagttaatatacttaagatattactaggaaattgttcaataagcaaaaaggaaagtcaattattttgacaaagtaacgtgtaaattgttggtcacactggattaactcatgtaacaatgtacttagtgggtgatatgggagtgggaagcttggtcgttctatgttgtttatttatgattgttgttctgtcgtggattcaataaatattttaaaagtcaccctacttagaaatcttttgtgagggacaagtgggagggaagattatcaagcaagacacctgatgttaaattgtgcaagtgtcagccagcaaaattcagctaaaggcaggttcccaggatttacagcccccccccccccaataaaaaccaattcatgtgttttgcacttgtgaattatgcagctctcaggtcggccaagcccatgtatgatcaaacttgaagttgggagggaaggccttgtgaggcaaagggttatctagtaactgacccccaagttagtgaagagcaaaggaaagtgtggaagctgtgctgcttcctccaagtcagaacgtttctttgttgaagtagaactgaaccttcctaggatccagactcgagtatcgctgacagcgtttgcgcaggctttttgccaaagtccgagggccacataagaaaacccccaccgcagacctgtaagagtagagcagtactaattacttggatgcaattgtgagctgaaaacagtggaaatgtaga

SEQ ID NO: 36157 - DNA, 1150 bp, Mus musculus
caaggtctcacatagtgcacactagccttgctctcacaatataactgaggttgacttcgaacttgtaagccttctgcctacactttgtgagtgttgggcttacaggcatgtgccaccacacatggctttatgcagtgatggggatcaaagccagggaaagatgcgtgtgagggaaacccgtttactaactgagctacagccctagccccttgcaaatatttttaggaagtagaaccacattgagctttttacaaagcagaataagaggctagggagatggctaactgggtaaagtgcttatcgcacatacacacaagaagctgaatttggatctagcacataataacaaggcatagtggtacctgcctgttcttgtgctgagacgtgtatgcagtgggatcctgagggctttcctggacagtcaatttagctaatagtggtttaatgagagaccctatctcaaaaaaagttgaaaaatgataagacacctgatagcgacatctgtcctccacaagtataatcacacacacatactacacacatgcaatgcagacaaagttatagaatgattacagggttgttgggctttctagaatttgacacttctagaatgtcctttcatgatggggttatctctggggctagagagatggctcagtgttcacaagcatataatgctcttgcagaggccctgagtttgattgttagtatccatgtcaagttgctcattactgcctatgactctagttccagggtatctgatacccttggctggtctccatggacatggtacttatattcacacacatgcaaatacacatagtttaaaaataacttttaaaaagcttaaagagaaaatgtggttatctctagggacaataatgccattcatctcttacctgtagaaggagaatcagtcattagagatccccaaaagggttaaaaactcggaaaggaaggactgaatacttagattgtcctgtgtattctggaggaaggaagcaccagtggtcctatagtaatccagtatgtgttataataaagtgaatgttgaaattaactgtattcactatctctagtccatgtttttttcaattctggagttgtccttgagtacttgtctaacattgtcttttgaatattctaatgg

SEQ ID NO: 36158 - DNA, 1099 bp, Mus musculus
aagttgaactttattgttttaaagaatacatttttgtttagtgtgtgtgtacatacatatgccagggcccatgtgtggcaatcagaggacagcttgagggagttgggccactatttccaccatatgactcctgggactagtactcctcttgtcagcttgacagaaggcacctttttttttttttttacctgtgaagccattttgctgccccctacattttatctattttgtgtggatatgtgggtgtgcatcccacaacatatatgaggaggttagaggacaacttgctggacttggttcactctttgcatctttgcttatcagacgtggcaacaaggaactgttttttcattacctgctgagctgttttggttgaccatgactggctttttaaaatgagaactatgtgtgtatgtatggtggactgccatggtggactgtatgagagtgtgtgttatgtatctgccatggtggactgtatgtgagtgtgtgtatgtatctgccatggtggactgtatgtgagtgtgggtatgtatctgccatggtggactgtatgtgagtgtgtgtatgtatctgccatggtggactgtatgtgagtgtgtgtatgtatctgccatggtggactgtatgtgagtgtgtgtatgtatctgccatggtggactgtatgtgagtgtgtgtatgtatctgccatggtggactgtatgtgagtgtgtgtatgtatctgccatggtggactgtatgtgagtgtgtgtatgtatctgccatggtggactgtatgtgagtgtgtgtatgtatctgccatggtggactgtatgtgagtttgtgtatgtatctgctatggtgggagtgtgtgtatgtatctgccatggtggactgtatgtgagtgtgggtacatatctgccatgatggactgtatgtgagtgtgtgtacgtatctgccatggtggactgtatgtgagtgtgggtatgcatctgccatggtggactgtatgtgagtgtgtgtatttatctgccatggtggactgtatgtgagtgtgggtatgtatctgccatggtggactatatgtgagtgtgtgtgtgtatctgccatggtggactgt

SEQ ID NO: 36159 - DNA, 1167 bp, Mus musculus
ttactaattatattacttgtaacttactactatatgaatactgttattcaagtgaaaataccagttatcccagctaataaattttcagcgactcaattttgaaaaaaaaaattctttcgcaattctctcctaatgttccagttgagttcttttcaaactgttcacccgtgccagcagtttaaagagctgcttagctgtggacgctcgggcgaggtgtaggcacttgttatttctgtggattagggtggttgctagttagcagttgcttttgattcgacctactacgcatgtatccattcattttccttatatcgatttttgtctgagagtggaggaaggaggaaaggaaacagaaaatgaggcaagaagagagagcactttttcattttcaggcccccaatgggactcagtgagcatagttagggaattgtaaatgaggccctgggaaggcagagtaaaaattctgagaactcggagattagaactgtttcttttccagagctacagaagagtaatcgttatataaccagcaaaaaaggaggcagcttgtgcttagagaccacggagaaaaagggtggaaagctcttactgggagcaacttgagatgatctctgagaggacaatagggatggttttgtctctgcaattgtcttctgcggctcaggctggcatcaaacgtgccgtgtactactctgttccaacgccttagctccctccctctgcctcctgaaggctgccagtacagatttctgccaccatgcatggccaagagtgatggtttatttgatgatagaaatgacgttataaaggggtgtggttttcagaaacctctgttcctaggctaagccacaagtcttgttggcaacataagcttgcattcatctctgctttggagagtgagcatgttggagtggtaactgtttgagttctaagtggggcactgccctcttcacagtcccttccacttctagtctcctttaggtctaactactatttgctttgaatgattttgttttgttttgttttccctcttcagtgtagtgttcttcaaagtctgcaagaattactgcagaattggctgctttggctctctacggatgcgcatgtgcagcccacgacagacagtcctctgtgagttaatcctgtggccggccacagaagtgttct

SEQ ID NO: 36160 - DNA, 1108 bp, Mus musculus
gcttcgttcagcctgccctaattcaacaacaggggtcagctgcttctgtccataggttgggtgcaaatatctacatctgactctttcagctgcttgttaggtctttcagaggacaaacttgataaatcccttttcatgagcactccatagcctcaataatagttgcggactattactgggcctgttgctagaccttcttttcctcaggctatttggattctcttatcttctgccagccacattattcattagtgcttttaaaatctcatattttagaaaattgtaagcataatcaaaggtagagctaagagggactatccctgaagagaggtggaaagattggaaaagctagagttctttgtaactttaatttttaacccttatttttaatgatggtttttaagcactttaacctccctggtagcccaccacccactaacggtagtggaaaggagaggctatgggggaagtggacctgcttagaaaggttttttggagcagctcccatctgtgttgtctggaaattagcagtttagtttctaagttagtagcagaggcagctcagtccactagcaaacacttaacagatataccagcagtccagtttggtagagtctggatagcaaacacgaatcagtagtggtggcactatagcagagcagccaggcccagccttggcacgagtcagcaggaaggaccagaccctgagggacaccaggaaaaattttgtgctgtgtctctctcagggaagcaaagatcagtgagtttgtgagactcacaagttttgtatatctaggtgtataagtaagcttagctcaacctccgtcagtgtccattgagacctatttatacatcatgtatcctccatgggtcttgtctcagcatgtgtcttaccttagcacatgtcttgtagtagcatgtgtcttgtgttagtactgtgtgtctgtctcagttgatcgcactctgccagtcagcccaagtctgtggaagcaacaggaaactgcagtacaccaccagaattgtgtgtgtgtgtgtgtgtgtgtgtttctctctatggagtcccgacaaatgtagctcgactacacatgtaagacagatcaatatatgt

SEQ ID NO: 36161 - DNA, 1209 bp, Mus musculus
gcctaagttggacagtcgggctgaggcctgttttgtgaactgcgttgaacgcttcattgatacaagccagttcatcttaaatcgactggaacagacccagaagtccaaacccgtcttctcagaaagcctttctgactgatctcagcattacctctttggaaaagtagttcaagaattgaagagctgctgatgaggtggttgaagaaatggctatgggggggattaaactcccaattttctttatcgtcttgggacatcttgtcacctgagaatgaacaaagaccaatttttatgtatgggagttgagagtcatgtgtatttggttgtgtttttaaagctaaccatgtgacaataattgacagataaatgaaagtgtgagatgcatataactgtatatgggactgctttctcaaggtccctttactgctttataaaataattttgataggtggactgctttctagaatttgatagtgggaccacatagggtaaatcttgatttgtatgggttcatttctgatttttttagggagatctttgtgtcagtcaaattggcagtggggaaagatcctggcactgtttaactgtgagctttctttcatgtctgacctggagctgaaaaaaagtcctatggagtgttcctgcaatccaacttcttaggttgtctctcccctatactgtgacttacttaactcgcaaattgaaaatatggtctcaaggtagaagaggaagcctgagaatccaaagggctttagtcataaaagaatctagctcatgagtactattcttattaccagacagccacgagaagaagttaacttactatgtatatccagatgcaaaacattcacagatgtgcctaaagaaaccgcgacttaggccagttcagaactaacaactgtttcaggtagaggtgcatgcctgatggtagacatcgattccattaactgcattcttttggtcactgaaataaaagctcgcaagatcaatgttgtgacgaagaggctttctgttttgggtttttaactgcaaactccgattttgggctcactaccaagacagaaatgtagttggtttctactctagaggtccccgaagttttcatgagaagaaaatacttggtgataagaagggaaaaactctgtgctaacaccttaagtccctgatagaggagcttttgtggacatcccctcttgtttttatattctc

SEQ ID NO: 36162 - DNA, 1187 bp, Mus musculus
aggtttgacttggtatcttttctaggctaaaactacaaagaagattgtgctgagactggagtgcgttgagcccaactgcagatctaagaggatgctggctattaagagatgcaagcattttgaattgggaggcgacaagaagagaaaggtactctccttttgaatgtaaagccttatttgtagagctaactgtctcaggcctcggtgtatatagggtaccctccaagatattatattgtccacagctgagttacataacccatatctgaatgcatgggaccagaagtatttttttttatgttctgtgaatctggcatatgctttattagtaggcacaaaagtttgcacaagtgcaaaagtttgaacaccaatatataaaagaaatggcctctacgatttcagtatttggattttggctgtggctgggattgaacacaggaccatagattatgtaaaaaggttccttaaaaattacaaaacacaacattttgtttttctgttctgtttacagggccaagtgatccagttctaagcagattttgttatgaagacaataaaatcttgacctttcaacccctttgattgcagttgttcgtttgggagggaatacattaaaagctttcagaaattacctgaagtttttctcctgttgagtggtatgaaatgtgacatgttggcatcctacttggcatttaaagtcacgggttacaaatgataagaaaacgcagtgtagagacttttatttgaaattttttattttcaatacattccagatttttatccccttcccagtccaccttggaatattgcacatcccccacctccccagaagatgcccccaccccctgaggtagagacttgtatttcaagggatttgaggccagtaataagctttaaatatgttttgcttcaggcattttctttttttttaaaagattattatgcaagtataatgttgctgtctagagaaccagaagagggcatcagatctcattgcagattattgtgagccaccatgtggttgctgggatttgaactcatgacctttggaagagcagtcaatcctcttaaccgctgaatcatttctccaggccctcatttttttcccctgagacagggtttctctgtatagccctggctgtcctggaactctgtagaccaggctggcctcgaattcagaactcatc

SEQ ID NO: 36163 - DNA, 1169 bp, Mus musculus
ccttaaagaaacacaaggaaagaatagggcataggtacatcgaaatcttcaagagtagccgagctgaagtccgaacccactatgatccacctagaaagctcatgactatgcagcgcccgggtccttacgataggccaggggctggaagagggtataatagcattggcagaggagccgggtttgaaagaatgaggcggggtgcctatggtggagggtatggaggctatgatgactatggaggttataatgacgggtatggttttgggtctgatagatttggaagagacctaaactactgtttctcaggaatgtctgatcatagatatggagatggtgggtccagtttccagagcaccacggggcactgtgtacatatgagggggttaccatacagagccaccgagaatgatatttacaattttttctcacctcttaatcccatgagagtgcacattgaaataggacctgatggaagagttactggtgaggcagatgttgagtttgctactcatgaagacgctgtggcagctatggcaaaagataaagcaaatatgcaacacagatatgtggagctcttcttgaattctaccgcagggacaagtggaggagcttatgatcatagctatgtagagctctttttgaattctacagcaggggcaagtggtggtgcttacggtagccagatgatgggagggatgggtttatccaaccagtctagttatggaggtccggccagccagcagctgagtggtggctatggagggggttatggtggtcagagcagtatgagtggatatgaccaagttcttcaggaaaactcaagtgactatcagtcaaaccttgcttaggaagcaagggaccatccaataacatctacatgaataaaagctatctttataggaactggatagagtagggagggtgtctttatatccagtatgattggtaaatgggaagtacaactgcttctgatcactattggtcagcttctttcttctttttcctttttttttttttaaaaaaaagaacaaaaatttaagttttaacagtttcgcattacaagcttgtgattcatgcttactgtaaagtgaaagttaagattgttttcaaactttaagctcagcaattttgaacactgaaaatattcatctaggatgtaataacaagtt

SEQ ID NO: 36164 - DNA, 1198 bp, Mus musculus
aggaagtctggaaactgctgggatccattgtccttgcctcaggccaggtggcagggcagcttctgaggcctggacttgcctggaactgcccagttcctagaaacagagatttaggcctagtctcctgaactaccaatttgaagcctgttgtggagtcagcttagccatttcattccttccttttagtaatgggccttgaatccttaaaatgttcttgaggcccctacactagcagctccagccagccctatgtcaaggagagaacctggtagcactggggaaatagctacccttttaacttgattgttggaggtgctagtgaaagtataacaacgtaaaaacagaattctaggcctttaggcccaggcttggaaatgtggcctttgtaaaggtatgctaatcataaaacagatagacaatcctccacccacccgcttcctgggttcaaagagtgctcattcatagaaagtcacccagaacctgcaatgcaaatgtactattgttaggggctcttagaagctgtcttgagagttaacacttaccaggtattccttgtgactcttgtaactttacacttccttgtgactcttaactggtacctttggtatcttccaacaactccctccctacttccttgagctgtggtttcttcctttaaatacccccttacccagctacttggggcgccatggtcctctacccctgcgtggtgtatgaccatgggcccgagagcgctcttgaataaaaatcctcttgcaatttgcagcaagacctgtttcttgtgggtgattttggggtgtcgcctctcctgagtcagaacgtgggggagtcctcacgttgtgggtctttcactagccggttgaagacatcctctccagagtaataagtcactctgagtacaagctgtactagaatatgaaaatccacagaagtatttacaagcatgccataaatgcatggagtaagctccaaggtgcaagcccaccaagcattcagtgggggcagcatttattctgcaacagtagtgggtacagtgtggttgcatggatgggaaagggctgagggtaccttatttccaatgcagagtccctgttcggtaaccaacagttctgtgttaagtccgagaagagaagagtggctatccaattggccttcttgccagccactgagaacttgatgacaaggctgttgcatcgac

SEQ ID NO: 36165 - DNA, 1169 bp, Mus musculus
ttaagtgtcataaaattgtgtaaaagaaagagtctttaaaatttttacaacctggacattttcatggcgaatgaaactgtctttactgcattttccccttactgggggcgaaaatgatgttaacagaaaagggaatacagacaaagaaagtgaaggctttgattgtatggttttcctctttctctagctgatttgatggtggaattgttgctaagggaaggcaggttgtatagaaagccagtggggagcgttagtattgtagcctaagagggaaaagaaaggattcttcaaagatgcagaaaaggctacagtcgaggcctgggagtgggtgggggtacagacccttcctagtaaccagggaccggtaaactccaaccgctagatggtgatgacacttgtgggctctcagattggagagcgcagagatgagtgacagggcggggcgctctggggcttggcgcacggacgcgaggagggggttgcctgtgcgtacagaagggggtcctgttgactgctttctgaccagtggggggttgtgaggaggagggcgagcgatgacgcggagcccccacgtgacccggagctgcagagcgacgcagccttgggtgcagtcgtcactctcgtctggccaccaactccccgctgccctgcgcgcggcgggctggcatccggcccggggcgagcagagcaggtaagggcccccgggcggctgcgccgcggcccctgttagccgccgcctctcgatccctcagcgcaatggagatggattggggagggggctgtccatgctggatcaagttcaaggagtcttcccctctgattctcccgtgccccccccccccagcccctagctaaatctgtgccggggaaccctgtgctttgacagggctgctggtagggagagtctctagagggaaatacagagggaaacgtccatcctctttaattaactccatcaatgggcgtccgcacatgtccgcgggcttcctgctcctttcagaggagggacgcgcgccaccgtggcatttgctgagaaaatggtgggccttaatgcctggacggcgggctcggtaggggtggtgtctcagaaggaggggagggacctttgacaaccggattccataaaggagagtgttgggatgtgtggccttggtactggcagaagcatt

SEQ ID NO: 36166 - DNA, 1517 bp, Mus musculus
aatgggattggtgttgaggactggattgctgctgagaggtggatcaaattcaggtttcagactatagatggagactgggagaatagtgtttcctggactgaggatgagagtggagccactattgggccctggactggggcggctaatgacaaggctggccttgttagctcctgggctgtggcttgtgatgaaagtagcattaagtcctggactggggctaggcctgagaatgaggttgctcttgggtcctgggtaagtgctggtgaccaggccactggagcaatctgggcaggagctcagactactgatgggacctgggttgcagacaaagccagtgcaggttcctggactggggccgagaaccagatcagtgcaggttcttgggttgtctctggaaaccaggccattgctgggccctgggctgtgagtcaggtcactgatgggtcatggcctgcagtccaggctagtggagtgtcctgggttgtggaccaggctactgggacctggactgtagctgagaaccaaactggtgcagtgtcttgggctggagctggcaatatagttagtattggatactggactggggctgtagaccagaccaatgcagtgtcctggacaggaactactgatcaggttggtgttgaggttaagccaaggtttgaagatcaggccagtgaaaaggggtcttgggttgtagctggtgtccagactagtggagagaccaggttgggatctgaggatcaatccagtggaaggtcttggactgagactgtagaccaggccaatgcggcatccaggcttggaactgtagatcaagctggtggtacatcctgggctggaaccggagaccaggttggtggagtatctacatcagggtctgcagaccagtccagtagtggatcatgggctggcacgaggaatctggctggggaaagatcttggactgggactggcgatcagtcggatggtgcagccaaacctggttttgagaatcagaccagtgatgaagggtcttgggctggcactattggccagcctagtggaggttccaagtcagtgtctgaggctcagtctgctggaagatcttgggcagattctgcagaccaactcagtggagggttcttggttgggcctttggaccaggccaatggagagtctcagcctgtctctggggaactggctgctagtggagtagatcagactagtggaggaggatgctggactggttctggggaccagtctggtggagaatctaggctgggtcccagggaccaatcgaatggagagtcttggcctggcactggagatcagactggtggatggtactgtacttacactgggactcagactattggaggaggcccttgggttggggtcagtggccaggatgttggagggccaaagccagtgcacatgaaccaggctactggtggggcctggcttggcactgggactcaggtcagtgcagtgtcctggactggtgatcaagttggtggttgttccaaacctggatttga

SEQ ID NO: 36167 - DNA, 1200 bp, Mus musculus
aactttttccgcttgttatctcaggggggtggaaaaatcaaggttgagattctgaaaatactttcaaactttgctgaaaatccggacatgctaaagaaacttctcggtacccaggtgccgtcatcatttagttccctttataattcttatgtggaatcagaaattcttattaatgcccttactctatttgagattatcttcgacaacctcagagcagaagtgttcaactacagggaattcaacaaggggtccctgttttacttatgcactacatctggggtgtgtgtgaagaaaattcgagccttagcaaatcaccacgacctcttggtgaaagtgaaagttataaagctggtaaacaaattctgattgatctgtgccctcaagatgtgtgatctctcggttttacactcgggaagcattaacagtgagacactattgtttttctacttgtgtgtgtagtacaggaattattcagatgccacgtttgaataattcagagtgatgttatctgtgatagtcaccagctttaagctgaaccattttctgaataccaaatagtcccgtagtcctgtagtcctgtggtttgacttgtgctgcttgggtgggatattttccctgggtcctctatgtgaactaatagcaatcctgttcgtgaatggcctactcagctcttacttgttttgacttgaattttgtcaccaaagacttcatatgtgtaccatcaataaagtgtatgttgcaaatggcaagaagttgttctggtgctttaagtaagtctgtctgccaccaatcacagacactatagcatatgccagcaagattttgctgaaaggaccctgatatagctgtctcttgtgagactatgccagggcctagcaaacacagaagtggatgctcacagtcagctattggatggatcacagggcccccaatggaggaactagagaaagtatccaaggagctaaagggatctgcaaccctataggaggaacaacaatatgaactacccagtaccctagagctcgtgtctctagctgcatatgtagcagaagatgtcctagtcggccatcattgggaggagaggcccttggtcttgcaaactttatatgccccagtacaggggaatgccagggtcaagaagcaggagtggatgggtagggagcagggtgaggggagggtatagggaactttcgggatagc

SEQ ID NO: 36168 - DNA, 1150 bp, Mus musculus
aaagaagattaaagaaaaggaatcattaggattttgatacaaattaccttgaaactatagattgaagatatcactatctatataataatgtttccagtctatgactacagaacatttttccatttaagtttttagaatgtagtcccttttattaggcagactctcactaaatagcttagcctggtctggagctctacatagcccagctgatcttaacttgtgttctgatttctcagtgccctgaaagatagatctataggcatgcacttctagtcactttttgcaattaaaaattacatttcagatcatttattactagtatatagaaatataactgataattatgagttgagtgtataacctgtaattttgttgaattaatttactgactttgatagttttcttgtgggttctctaagaattggtattatgtaggaccatgtcatatcatctgtaaatgaaagtgctttttctcctttcttctcccatctactttagaaacaaagtctcatgatgtagcctagactgccccagagcttctgatcctcctgctccaccgtctgagggctgggattgtagggatgtgccattacatggtgctatggattgaacccagcccttcctgaatgctaagctaagcaagtactgtaccaactgagccacatcccagctccttcttccttctgtttccttgtgtgtgtgtgtgtgtgtgtgtgtgtgtgtgtgtgtgtgcacgcgcacgcacacaaacatgcaaacatgcttgtgtttttttcatacacctcagaggccagaagagggcatcaaatcccttggagctagagttgaaggtgtttgtgagccagctgatatgagtcctgggaatcaatctgtgctgagccatctctccagtcctgcctctttctgttattacttgcctacatttttttcttatctactttccctggctagaatgtccagtacagtggtgaagaacagtggtgaaaaacgagtcattgtcttgctcctcactttcctgtgaacagtttttagttgttttttttaactacttaatgtgttagatgtgagttttcatgtatgccgtatcatgttaatgaagttcctttctatgcccaaatgtatgggcaggttttattatgaaagggtatca

SEQ ID NO: 36169 - DNA, 1757 bp, Mus musculus
agtctcccaactcttccccaagccccctaactacaagaattacaaacatgtgtgtccttccatgtctggcttaaggttcaacttctttttaaatttaatatattttaattttgtgtatgtatggatgtatatggatgtgtatatgtgagtaaagccacccaaagaggccagaagagggaagccatcatcctagattcatccgttgtcactgtagaccttcagttagatttcaacctctgaaattaagttcatggagacttattttagaagactattggggttgagggtttttgttgttgttgttgttgttgttgttgttgtttgatatagtgccctatatatgttaagtctgactttttaagaacctatttctatttttagctatatatatatttgtatgcaagaatatatacttctatatttatatttaggatatctttgctgagctcatttatagatattttattcacttttgggtatggtatttgcagagaatatcctgtgggagttggttctctttgtcaatcatattgagtcctgaggcttgaactcaggttgtcaacctaactgctaagccatttcactgtctttccctgtcttacactgtaaccccattctctctatactttcttccttttctcttgggaaaatatacatattttttccaatggaaggacaaaaagtattttaccaactccgccctgatatactttttgagctactccctaactgtgtatcccaacagtaaagttgtccttgtgatttctttcttatcttttagtcttgccacggttttaaatcaggcttctgttctacatgaaattcatgttacaacatttttcagggccatagaaaattctgcaatcttcgtgtgataaattaggacctcggagccttttgtttagtggggttttatttcaatgagataacatagttgaaggaacttcatgttctccaaagcatcttacacgagaacttgctaaagattactgaacctgtgaccaaatcaaaaaaaaaaaaatcatgttactagataaaggctctttattcttcatttttctgaacggatatttcttgtgaattaaaactctagcataaaaaacagattgagtgcccgtgtcttgcattggtgtgtaaatcctagggcgagaaagaagcaagatggaaaggctccaagatggcacccttttcccttgagactcctggtaaactcatggtcattctctactgtgtcacaaacctttctcttccctgcgcctccactgacatggatttagaattgagttacacttttattttacacaaacgagctctactgtgtgaaaactaatttttttttcttttaggaattgtggtcagatacaacagaccttcatccaaattttccttcaggtgtcaaggtagattaaatcaggcacattccaagagggtataaaaacttgtttttctgatgtaacaagtgtttcctgaacaaagcaagaaaactttccaacaacgtaaaagtggcttgaaagagtaaagcaaagtggcttcctagagagtttttggtggctaggggattggtccaggattagtttcggttggttggttggttggtggtggttggtggtttttttcccttgcttttggtttgaacttttcttcgatgcctaacaagagcaccctgatttcttctcagtgtgtccatatgtgaaagaaacagttatcagcttgtccatatgtgagacagtgtacaggagagtgattaaggtcagaac

SEQ ID NO: 36170 - DNA, 1099 bp, Mus musculus
agacattattggttcttggttttgggctggggatgaagacaggtttgagccagctgctaagattaatgaagagaacaagatagcatctgaagatgaagatacagttggatcctggttctggggcaatgaagaggccagtctagaggcagtgagaaggggtacttttgagtctgctcctgggattaaggaagagaaagttactgggtcatggttctggactgataaggccaaagtaggggctgggtcccagactgtcgaaactgggtcagaaactgaagaggaagcaatttttgagtccttgatctgggctgcaaaaaaggacagtattcaagcaggagtaaagcgtgtgtccaagccaaaagatgacggtaacatagctgttgggtcctggctctggtctagtgacaaggccacaaaagaagctaaaactctgattgtcagtgaggccagtccagaaaatgggaaagagtcagttgttaagtttgggtcaagagcaaaagatgaggtgattaacaagactggcagtggtgacaattgtaaacatagtacagaagctgaaaccatagtgggagcctggttctgggaaggagatgaagctagctttgaatcaaatcctgtacctgtatgcaaggccgtttgtgaacccgagtcttcagctgagcacgaacctgacccttcccgcaggcctcagagctgggatgaggtcactgttcagtttaaggctggtccgtggggaaaagctggcttcccacccatgaaccccttcagattccccaaagaagcggcatctctgtttgcagaaatgtttgggggaaagcctaagcttgtggaagttggtccagaaagggagcctgaaccccagttcccatttcagtatgatccctcttaccgctcagtccgagaaattcgcgagcatcttaaggccagggaaagtgcacagccagagaattggtcttgcaactgcatccagtgtgagcttagaattggttctgaggagtttgaggagcttcttttactgatggacagaaatcgtgatccttttatccatgagatatctaagattgcaatgggcatgcgaggtgcttctcagtttacccgg

SEQ ID NO: 36171 - DNA, 1235 bp, Mus musculus
taaagacatacccgtacatatacaagaagctgagagaataccaactagacaggactggatactaaattccccatggtatattatagttaaaacatacatcatttatctataaatagaggatatgagagctgcaaaataaatccataagtcacacacatatggtttatatatgtgtgtgtgtgtgtatttcatatatatacagacatatgttgtacatgtatatatatgaaaatccatccttaaagtagctactttctcaatgaaaaaaattaaagccagaggaacctggagtaatgtgctccaagttctaaaaggccagtgacatcaacttagactacttacccagaaaaattatatctttcgtagttgaacatcaaagaaaatcttttcatgatataatatgcttaaaaataagtcaatcaaaccagccttattagagaatactggaattaatacttcagactgaagagagaaataagcaaagccaagagactatagaaggaaaataaatttagttataagtactgagatgcaaagtatgactatgaacaaaaaccacaagaaacaaaaataaataaaacaacaaaatgactgtaatcaaccgcaggccggtaggatttgctgaaggaggcagaggcaggaggatctagagttcgaggctagcctgggacacacatttcaataataactttacaattattaatggcttcaactctccaataaaaatatacaggcgacttaaatgaattaagaaaaaagaatccgggctggtgagatggctcagtgggtaagagcacccgactgctcttccgaaggtccgaagttcaaatcccagcaaccacatggtggctcacaaccatccaaaatgagatctgactccctcttctggagtgtctgaagacagctacagtgtagttatatataataaaaataaataaatcttaaaaaaatgaaaaaaaaaaaaaaaagaaaaaagaatccatggtttttgttgtctacaagaaactcaagctttgtgttgcctataagaaattgaactgctgggcgtggtggcgcacacctttaatcccagcacttgggaggcagaggcaggtggatttctgagttcgaggccaccctggtctacagagtgaattccaggacagccagggctacacagagaaaccctgtctcgaaaaaagaaagaaagaaagaaagaaagaaagaaagaaagaaagaaagaaagaaagaaagaa

SEQ ID NO: 36172 - DNA, 1216 bp, Mus musculus
agcttttccatttgctgtctcagggaaatcgtaagactaggaatcttgttttgaaagtatttttgaatatgtctgaaaatcccaaggcagccagagatatgataaatatgaaggcgttagcagcattaaaactcatctttaaccaaaaagaggcaaaagccaatcttgttagtgctgtggccatctttattaacataaaggagcatattagaaagggttcaattgtagtagtcgatcacttgagttacaatactcttacagccatattccgtgaagttaaggggattatcgaaagaatgtaaagtgacccagaaattaaagagaacactgaacagtgtccaaaatttgattggctgtacatgcccaaagagttttgcataatattttggtaattactgctcacacatttttgtcttaacatcttttacatattattacctgtggcaggttctagctcaaagctagaccatttttgatgtatcaaataaatattaacatcttgagataaaaaagtttattgatttctatcttatctagattagcaaatttgtaacattttacttaaggaaactgtgatccaactctcagaagtactgtgtcttgagggttagtatctgcttagatctgttggtggctccagagagcaaaagagaaactactgctcttgtaatctagttacagaaataaggcatacgcaaataaagatatctgatggtacttacattgtgtgtttgtgtatatgatatatacatatatacctattgccaaacgtgcactcttgtttcaaaacggagggaggttactatatgctattagatataagagtgaattctgttttccccctttatccaactatatcaaacatttcattacagaatacaaaatggccctgaattacacaaaaactacaatatattcattttaaaatttacttttataaataaaattcaaattttagacaattttatctgtcacatcaaacaagaaaaaggtaagcatgaaaaggaagtgttttattagttgccatcacacacttagattggcatattttataagttttattccttttatggtgatcctgtgagctagctagctcatatttttattatctcttattctgagcatttcccaatcataattataaccagtaagtgcttttccctagctcttcacagcacagggggcacaggtggcttttctcccactagaaccagtc

SEQ ID NO: 36173 - DNA, 1118 bp, Mus musculus
tacgtcagagttatttatttggtcaggacagtatccagaaggtccagcattcttggttgacaaggttcttatgtttccacttggccgcctttatatatttctcaaaaatcagttgtcgcatatttaatttaaatttttcctatttccctgtaagcaaaaaattaagtagtgaaacttttgaatattttatacccatctgttgttactatgtaaatgtaacaatatttctagaatctaccatgttccattgttagacttgtatatgttaatctcaatgcagttactatagcttttgttctttatggtttttcttttttccatttttgtacgtaggtgcatgtaagattatatatgcatgtttgtttatgtaatggcatgtgtttttattagatattttctttatttacatttccaatgctgtaccaaaagtcccctataaccccccccccccccgctcccctacccactcactcctactttttgaccctggcgttcccctgtactggggcatataaagtatgctagaccacggggcctctcttcccaatgatggccgactaggccatcttctgctacatatgcagctagagacatgagctctgggggtactgattagttcatattgttgttcctcctatagggttgcagacccctccagctccttgggtactttctctagctcctccattgggggccctgtgttctatccaatagatgactgtgagcatccacttctgtatttgccaggcactggcatagcctcacaagagacagctctatcagggtcctttcagcaaaatcttggctggcatatgcaatagtgtctgggtttggtggctgattatgggatggatccccctcccctcgggtggggcagtctctggatggtccatcctttagtcttagctttaaactttgtctctgtaactccttccatgggtattttgttccctattctagggaggaatgaagtatccatgtgttgggtgttccttcttcttgattttcttgtgttttgcaaattgtatcttgggtattctaggtttctggtctaatatccacttgtcagtgagtgcatatcaagtgacttcttttgtgattgggttacctcactcagg

SEQ ID NO: 36174 - DNA, 1138 bp, Mus musculus
gtttttaattttattggttatctttgattttttattggtatactcttgcttgtttgtgccaatgactttagtgccacttctgccaatattaaggaacatcctacatgttcttctatgagttgtaaattgtcaggtattaagttgatatcttctttgttatgtttggtgtttctgttttgtgatactttctatatgctaaacaagcaatctatcagtgaaatataccacctagcactttatctttaatctactttaaatttttgggagggggcatagtgcaatttagggatccaaattctcaaaaagaatttcattattttgtatgtaactatccagttttctcagcaacatttagtgaggagacaattttttctcaattgtgttcttggcaggcttgtccaacattattaaccatcagaagaaggcagaacaaagctactttaaggttctgtgtcacactagacagacttgcattcatcaagaaatcaaataacaaaagatggtgtaaggatgtgggggagaaggcgctcgtattcactgttggtgggagtataaacaggaacagccactgggtgctttgaatgagaatggtccccacaggctcttatctttgaatagttgtttcccagtcgttggaactgattgggaaagattagctgagctctggttggaggagtgtgtcaccaggggtaggcttgggctttcaaaggactcaaatgtcactctcattatgctctccacttcctgtctgaagatctaaaagtgagctctcagctgcagctccagcaccatacctccttgcttgcatgcgtgcctgctgctatgctcccatgctatgatggtcatggatcccaatccctctggaactgtaagacccaataaaagtttccttctataagttgctttggtcatgatgatttatcacagcaacaaaaatgttactaatatagacccattataaaaatcagtgtcggggttgctcaaaaagttagatatagaaatactgtatgattcagttataccactccttgatatattcaaagagtttgacaccctatgacagagatacgtgttcaaccatgttcctagatatttatatagctaggaaatggattctgccttgatgtccatcaaataa

SEQ ID NO: 36175 - DNA, 1134 bp, Mus musculus
atacaaagaatcacatatacactttaaacttattcaaagggctttttttgtaattatagtaacccccttcctgtcttgtaatgattattaacaagaattttgggggtttgttcttaataaatgtcattgcagttttatttcaaaagtacaaatcttcatatgaaatgtggattttttgtatgtttaatctatttagagggataaagaagaacaaatagacattaacatttggcatgtgacttggacatgtgcctccttccatattttccattagaactaatagactgtgcttcttctcatgtatattttctattagagcaatcgaaacacaccttcctccatgcatattttcaattagaggactaaaatgagccttcttgcatgcatatattctattagagctgttacaatgcacatatccattttcttattttctaggctttaatgagcaagagcatattctgtggctgttcccagggccctggaccaaatgtgactctgcttttgtactgaatcccaggggagactctggagcttgagtgctggacagtttcactgtctgtcaccttgcctcccctctggactcattgctggattaattaggtaggtaaacacagggactaatgccaattaaatagcctttatgcttggagaattcagtgggaaactcatttcacttaatgtacttcaatgaaacccagcaaagcaggtatatactgactgctaacaatgtgggttatctaggagatgtacctgcttatcccttgagaatctttaacatccctggctgatggtacacctcttggactgtcatgtagatagaaaaactagttctaaactatctgcttcctagttcccctagctttaagtttctcctgctatctctgtcttgcttttctgtaggatggtctggggatacttacttggtcctatttttttttaattcccaaatcagggattctcttgttgtagacaaaagtgaggaatacatgaaagaaagaaacttgtaaaatataccttaaactctattattcatggagaagcattagcattattaacttagatatactagtagacaaaaatgaatcatatctttaagaaacagaatgatacaataagataatgatgtcttta

SEQ ID NO: 36176 - DNA, 1775 bp, Mus musculus
aggagcgcgcccgtgcgcctgcacgtctccaggatcctgctcaaaaaagtggaagacttcaccggacccagaaagaagagcgacctgggcttcatcaccttccacatctctgcggatctggagaagactttcgactggaacgtcaagcagctcttcctttatctgtcggcagaatattccaccaaaagcaacgctgtgaaccaggtggtcctctgggacaagatccttctgcgaggcgagaaccccaagctgaacctgaaagacgtcaaaagcaagtattttttctttgacgatggacacgggctcaagggaaacaggaatgtcactttgactctctcctggcaagtgataccgattgctgggatcctgcctcttgtgactggatctggacgcgtgtctgtcccgtttccagattcctatgaaatagccacgactttttgaagaattctctctgcattggaaacggggacatctgtggactcaagaaatcgcatctcctcatcatttccctcaagtcttgctgacttctcttttgttttgtttattttaaaacatgctggttttgttctgggactggctgcactcatcctcatgcttccctgagcctaacatagagactatattcattgatcttagtgtgtgtgtgtgacattggttatcactcttcctctgtataagaattaacatcaaattttatagttggagggaaaggctaatagagttctggaactttctttattctaccaatgaaacaacaaagaagttcaccagagtaggttattattagacagttggataatgaggattgaaaataatacacagttttgtcatattcactacattatcccatgtgatatataaaatttggggagaattttaaaattagatgttttggtattgtcacaataactgtattttattcctgagattccttgtaggtccacattgaatgccgttttcttatatcttctagggtgtgtttgattactagaaaaattgtgatttgtttcgtaagagtctgacatgcaaaatagttaaacacgagtcagaaatcttactgctttccttccttgccagcaaatgtgaccatttaaatagtgaacgtatcttgaggctgtaaatgattctgcctctctttaagtgtgtgtcttacagtggtttctcaacaaagattgctgtgcagtgtatctttgtcttagcactgttgctgaagtttgaaaatgtttgcatgtttaacatgagatcgtatgttctagtatgtttaatgccattaaataaatgctaactgcttaaaactcttgtaggtccattatttaatcattattgggatgttgataattgcacttgtggtatgatttttacaaacattcatagattttttttctctataacctaaatagtaagcagtgcatgcattagctctcttcaaataaacagaaattcagaagttttgttacatcaagcaaacacgagaatttaaatttgaaatacaacttgatttttttgttaaatatttttattgtatgtaattataatttcattatttcctcttcctttacatttctccaaaccctctcagataatctcattgttctttcaaattcatagtgtgtgtgtgtgtgtctatgcctgtatctctatgtgtttgcctgtgtatgtatatgttatacatgtatgtgaatatatacatatattcctaaatacaacctgctcagtctgcataacctatatcctcagggctgaccatttggtattgaataatccattgctgtgtt

SEQ ID NO: 36177 - DNA, 1122 bp, Mus musculus
ggacccagaaagaagagcgacctgggcttcatcaccttccacatctctgcggatctggagaagactttcgactggaacgtcaagcagctcttcctttatctgtcggcagaatattccaccaaaagcaacgctgtgaaccaggtggtcctctgggacaagatccttctgcgaggcgagaaccccaagctgaacctgaaagacgtcaaaagcaagtattttttctttgacgatggacacgggctcaagggaaacaggaatgtcactttgactctctcctggcaagtgataccgattgctgggatcctgcctcttgtgactggatctggacgcgtgtctgtcccgtttccagattcctatgaaatagccacgactttttgaagaattctctctgcatcggaaacgggacatctgtggacctaaggaatcatagtttaaaactgtcaagaaacacgtgctgtaacaatttatgtgtcgcattcctgcatgcctacactgaatgtgatttagaagcagacgtttgttcacctcgtgtaaagcatgcttgattccttggggggggggggacagttaatatcgtttgttagataccataagtggtggaaataaagtgactaaagaccgagtacatgatgattctgtaaatcactgtaacacattattgatatgccgactgtctgagaaatatgggtctttccaggtttttcctccaaaagtttttctgttttacatttttttgaaaaaaattaatgttttaaccattgttagtgaaggttgaaaacgtttgcatgactttcccattgagtttcagtctgtatgcttactaccactaggtgctaattatgtacagttctccacaagtctccattttaataagttttggagtaatattaacactcatcgtttaatttttttcatttacaaactctcttatatgttattgtatcctattgccagcagtctcgggatgtatataatagaaacatgggctgtttgcagatgaacactgtgaacccctgaagcttggggaatcatttcaagcttaaatagctagcaaaaaaagtggagtctaactttgatcttggatattctcattccctaagtttattccacccctgatacctg

SEQ ID NO: 36178 - DNA, 1256 bp, Mus musculus
gaaagcaggaaagggaacgtgcgcagagctggatctgacctccgggagttcaactttcctgcctactttcctcccatcccatgcttctgttttttgtacctgtagaggtcttggaaatgggtttgcgggcaaaatggtagcctctggggtgggaggggttctggcccagtctcgtgcctgggttctgtgctgataagtccaggaagtaagcaatcttatctctcctaggagtgatggcatccaaatttaaacaagtcatactggatctcactgtggagaaagacaaaaaagacaaaaaaggtgggaaggcctccaaacaaagtgaagaagaaccccaccatctggaagaggttgaaaacaagaagcctgggggaaatgtccgaaggaaagtcaggcgacttgtgcctaactttctctgggccataccaaataggcatgttgatcgcaatgaagggggagaggatgttgggagatttgtagtgcagggaacagaagtcaagagaaagactacggagcagcaggtgaggccttacaggcgtttccgaaccccggaacctgacaatcattacgacttttgcctcataccttgaaatctaagattttctctgagctcataaaatggctactgttttacaagctcttatcaagtgggggtattttttctgtaaacttttggtgtttccacttaacggtttctatgtaaaattgtttaattgttgcatttaattcaaacattcctgttagcatggcaatttaacccattttagaaaaaaatctttttcataatttgaaattaataaagcaattttaaaagcaatatatgctcagtcatcttctacttcagttcttatacttccttcatagtgtctttcctctcccagctgcccggacactgcttttcttcacatccccaattaatcagtaaggaacagtcatacctttgattcattcattatattatgttctagccatgtatgtatagtgtttttcaaagagtgtgaccttaatgtctttcggataacaaagatgtttttaatataagacctctgccctctctacacccataatcataacgtagacttccaaaaccttaacattgtaacaagatctctaattctagaggatagtatgtgtgtatcatagattaagcacagacaaaagcagggtgactaattttagtagccaaaatattaaaaaccacaaggtcttacattatgatagtggggattatgacaaacgagggtagtcactgcaag

SEQ ID NO: 36179 - DNA, 1226 bp, Mus musculus
agtcaggagctcagaacctgacttgtctagttagaaaactttttggcaattaagtgacctgaaacaaaagtcagtcgctatgggaacacaaaagcttgtccatctgcctgacacctagtcggttttgtttccttgtttttatccccctaggattaattcattaagaaaataatcaacatgcaaaagtcttgtgacgagaacgaaggaacaccccagaacacaccaaaagcagacgaaggccatccttcagaagatccaccacagcaggcaggagaaactcttcaggcttctggagaaaatgtgagggaggaaactgaagggagccatagaggagagcctgctgaacccagcccagagcccaaagaggacactcccgcaaggcatctgaaccccgaagaagtgataagaggcgtagatgagttggaaaggcttagggaagagataagaagagtaagaaacaagttcgtgttgatgcattggaagcaaagacattcccgaagccgtccttaccctgtgtgcttcaggccttgaaatcgtttttttctctgatattgaaatgtggctgctgctttctttctcttagcattttctgatgtatctttgaacttcattttacttttaataataattacctggcggtattttctgttatgtagtttcgttgttaccagcatctcattggattttggatttttgacccattttccacgtttatctttcagttggaaagtttcacatttatgcatggaaatatacaattagacagcaaattgaaaaaaacagcagcatagttaggatcaactcacatagataggaaaattcctaattatgtgtgtacatgtataattatacgtatcaaaaaatttacagtgcttatttttggtgtggtgtgttttaattttgccttttacttatgttgattttttttaatgaatacgtgtctcacaaagaactgcagatttttttaataagtgggagttaattaaaattaatttgtaaccagcttgtagaggcaataaaggcactaaactcttgatgaactattaaacagaaatgtaaacctggaattccctctggcttccttagccagaggaataaaactggcaatcattatagacacacttggttaagacttggtcttttcatgggggaaatacttgcctcacagggatctgtgtggaacatagtatgccatatttgagagaggacatggcctcactcagcct

SEQ ID NO: 36180 - DNA, 1623 bp, Mus musculus
gggtcggcgtggagggatgggggcggccgaggcggcgggaagagcctgggcggtggcgctcaggacagcgccacaggtcctccctcccacctactcacccatccttctgggttgatcgcaggtctgagaagcagaagcttcgcggcgcacctggtggtgagcatctctagaaagaggagaaggcaaggataggcccaggtaggtgcaggggcagggctggggactaagaggaggaaagagaatgtgcgcagagctgggtaggtcagaggcctgcttgccacccctttaccgggttcatctctcccatcctattcttccattttgatgacgcagatgcatcagatatatctgcaggaaacacggtgggctttggggaagaggtgggccagatttcaaccctcttgagagctacggacctttcagatggggaaatgaattttgaatggtgcaaagcagagactcttgtcctcgttagtgatcaatccacgaagaaatcttttccttctcttgcttcttaggagtaatggagtccaaagatcaaggcgtgaaaaatctcaacatggagaatgaccatcagaaaaaggaggagaaggaagaaaagccacaagataccatcagaagggagccagctgtggccctgacctccgaggctggcaaaaactgtgcacctagaggaggtcgcaggcggttccgggttcggcagcccatcgctcactatagatgggacctgatgcagagggttggggagccccagggaaggatgagagaggagaacgtacagaggtttgggggtgatgtgagacagctcatggagaagctgagggaaaggcagctgagccacagcctgcgggcggttagcactgacccgcctcatcatgaccaccatgatgagttttgcctcatgccctgagtcctgagcttttctctgaagatgacatggggacccctgccttgtgatgtacaaattttgaggttactcctttttatgtagatctctccctgttaccagcttctaattgaaacttgtgttttttactcggcctataattcttttgttagcagaatttatcaattgcatgggaagatccgtattacctattgtgaacctaataaagcagatttaaaaggcatcctctgtactcatcttttctttatataagagtatgaacagccacatgagtggagtaagtagtgctcaccacgggaagatctgaaaaacgtttcccttatatttattttcgaagttgaacacattatttaatgaagaatttagttgcgttaagagatgactccccaatggaggagttagagaaggggctgaagaagttgaaggggtttgcagccccataggaagaacaacaatatgaactaaccagtacccccagagctccctggaacttaaccaccaacccaagagtacacatggtgggactcatggctccagctgcatatgtagcagaggatgaccttgtaggtcatcactgggaggggaggcccttgatcctgtggaggtttgatgactcagggtaggggaattcaagggcgtggaggtaggaggggaagcatcctcatagaagcagggggagggaggttgggataggggacttctgagggggtgggaaa

SEQ ID NO: 36181 - DNA, 1252 bp, Mus musculus
cgtaagcaaacggtgaggagacctttgtgcacagcacctgcccatctaccaagtcttccatctaccaccacctcctcctcctcctcctcctcctcctccccctccccctcccctcccccctcgcttcctagaaatcattgcattcccgtattctgcaggaagcagcaaagaagagaagcagacacaagatgaaaccctgccaaaaaatggaaggaaacctagaaaaggaggatgagccaaagcctgaggaagagccaaagccggaggaaaagcccgaggaggggcaggaacccgaggaggaggagaaatccgaagaaacttttcgggagaggctgatccggtctctgcaggattttcaggaggatatacacaacaggcacctgagcagtgatgatctgtttagagatgtggaggagctagatgagatcaggaaagtgagaaacaaacttatagtgacgcgttggaaggctaaccgaagccatccttacccctatttaatgtagcttggcttgctttcccttttatctgatgttaccattgcgatctagctttcttttcattagcattttcctgataagacctttgcccatcttcctactttgaatctgttgctgttagtggctttagctgtatctcttgttgtctgtatcttactgttgattatatttgaaccaatctataagtctctggctttaagctttactgatttgtaaaaaaaaaagaaaaaaaagaataacaaaatgagcttctgatgggatacaaaatgagaaaaggttacaaaataatatgggaatatcatattttgaaagacaggagtacctttgtatgttacatatatgcacatataaacttgtgaaagatgaatgatttttcttctgcttatttgtatttgccatattcctaaaatgaacacgcattattcttgctaaaaataataaaggttttataactaaaaataagaatccaacagcccatcaatttatttttaaaactcctgaggcgcttgttattcattgacaatatgagaactaccgagttaaaagattaaaattcacaactcgtctcatacgcaataataaacataactgtggtggtcacatgcgctgcagagctgttcaacggggctttatccccatttgctcgtgcaggaggctccaaatgctagagctttctttctgctattgggaagcataggaaaaagtaacaagctcaagcaacagttaggtgagtgctccatagttcttcctgcctg

SEQ ID NO: 36182 - DNA, 1251 bp, Mus musculus
aggggctcgaaatggaggctccctagaggttgcctggagactctaaggtgggaaaaaaataataatgaaaatccttgttgttaatctctgacttttgctggtcactgcatcgagcattcagtttgggtttttttttttttttcctccccttgccctgtcttgcttgtgttcaaagaatagcaaccaggaaacaaaatctcatcatggccaatgtccaccaggaaaacgaagagatggagcagcccctgcagaatggacaggaagaccgccctgtgggaggaggtgagggccaccagcctgctgcaaacaacaacaacaacaaccacaaccataaccacaaccaccaccgaagaggccaggctcgccgacttgcccctaacttccgatgggccattcccaacaggcagatgaatgacgggttgggtggagatggagatgatatggaaatgttcatggaggagatgagagagatccggagaaagcttagggagctacagctgagaaattgtctacgcatccttatgggggagctgtctaaccaccacgatcaccatgatgaattctgccttatgccttgacttcggtcattcccccctgagatccatactgtgactcccgctgtagcccttttcctcgcattttcctgacatgcctttaatgacccgtttgtggtgagccttgtgttatttccatgccatgtgccaggtggggcttgtgttgccagcttctaattggagattgccttcccactcagtgtgagtttctgtcaacagtgcagtgttgcccattagcatggaaagcaatgtcaagtcaataaagcaactgaataatcattattgtgtccttaaagcataaataaacagttaagattaaaaaaaagagccacaagaactctgaaattcaacagtattgggggtggggagtgtacacatgtatacttttccttttatttggagcttcataaacctttttttggtaagtttatgaatttagtgcaggtgtatcttaattatttgctcaacagacttaaagagtaaatcctcttggtgaagatagaatttcttaaaattgttcatattgtccttatgtgcgggagtgatgtggtttagctttttaagcctccagccatccctaagtagttggggtgaactgaggaggcgactcagaccttgtccattctcccagttccatgcaggaaaaggaggtgtgttcctccatggcattggtatgcttcaattcccttttgtggtt

SEQ ID NO: 36183 - DNA, 1620 bp, Mus musculus
ccccctcggaagaaaagggcacgggctgaccccactgtggagagcgaggaggcattcaagagtaggatggaggtgaaggtgaagatccctgaagaattaaaaccgtggctggtggaggactgggacttggttacgaggcagaagcagttgttccagctccctgctaaaaagaatgtcgatgccattcttgaggagtatgccaattgtaagaagtcgcagggaaatgttgataataaggagtacgcagttaatgaagttgtaggagggataaaagagtatttcaatgtgatgctgggcactcagctgctgtacaagtttgaaaggcctcagtatgctgagattctgctggctcaccctgatgcgccgatgtcgcagatctatggggcgccacacctcctgagattattcgtgagaattggggcaatgttggcctatacgccccttgatgagaaaagcctggcattattgctgggctatctgcatgatttccttaagtatctggcaaagaattctgcctctctgtttactgccagtgattacaaagtggcttctgctgactatcatcgcaaagccctgtgaaggtctactgaccgctcactattgtctggtatctgtaaacacttctgtttagtcctttcatggtataattgatgttctttaaaactgtcagtgtaaaacagggcttatgtttcagtttgttttcctgttctgttgtagacagaaaataaaaggagtgcccagctcctttcctcatttcaaagttgctaccagtgtatgcagtaattagacaaagaagaaattcagtagaccattttattgcctagttgacaacattgcttgaatgctggtggttctatccctttgacactacacagttttctaatatgtgttaatgctacgtgatgagatgccctggttcctagtgccaaaggttcaacttaatgtatatacctggaaacccatgcatttgtgctttttttttttttatggtgcttgacgtctgtaaacagcccatcctctgcaagtccatctttgttgttccttaggcattcattctatctttgctcaaattgttgaaggatggtgatttgtttcctggtttttgtatttgagtctaatgcacgttctaacatgatagaggcaatgcattattgtgtagccacagttttctgaaaagttgatattttaggaattgtatttcagatcttaaataaaacttgtttctaaatttcaaagcaaaaaaaaaaatgtgtggtgttctttttatgttcctgagactagcaaatacagggtcgaggtatttgggtggcacagaagaaaactggctttcaaaggaaaaattcctttcttggaccggagagactgctcagcctgttctgtttcagaggacccaagtttgtttctggtaactcacaagcacctgtaactccagctctaggggatctggtgccttctggccatctcaggtaattctgtggacatgtatatgccaccacacagacacatagttaaaagtcaaaagcttttttaaaagattcttgctgtagcagttaaggtcaagttattttccctctttggtgtggcttctctgggcagattgcttacacgtgacacttggag

SEQ ID NO: 36184 - DNA, 1174 bp, Mus musculus
actgtgttacattcccatccctcaacagcttcaaaagaaatgcttgttttacaatgtgttggtctcttaagaaaaatggttgtggttttccaaacccttgtgtaaacaggagccccatttgtacatgcttttgtccttagtaaattaaagctagaatagcaattctctcctcgggggagaggggctaccctggatatgtaacaggcgcatgttttatacatttgcacacatttaaagcaaatggaatcacactgttcctaagagctgtgcttagttcttcctgtcctgcctgtccattttaggctccctctctgttctacttacctatttacctaaggacattaaacagttttccgtgtcagtatatataggcctctgtttaattcatttgggtattctgtagtgtgcatgtataatttgtatcatcctccctactgaagcagctataaataagtgtatccagttcctcattgcaagtaccaattcaatgaactatccacattcccatgtggaagtgtttgtggagtactatgctagctgttcagctgtaacatgacattctataacaactaggaagaaatagttcctcgtgtatgaaatgaaagagactgagagtatacatacatatatgtcttcaactccatttggcaaatcaaaagctcttttactaatttccttcatatatctaaggcacatttacaatttttttcttacatgtttttgcaaaagttcatcttcattgcagatacctactttcctttctaggttgtattcccacttcatctttccagaccatcctaggaaatactaggaatccttggaagggaaagaaggaacattgtgtaagtcaaggggattgttgaatgagtcatgccatcatagcaggaagcttgttttttaattccttttcactgaccattatttctcttgaaactcaacctctttatcttctaaagtcacaatcttaactctccgatgaaagtctcaccattttacctgtggtctctttcttgctaactcctcaaatactttcttccctatcttttctggagttctatgtatgcaattctctctctttatttaaacgttcactggtttatagtgtatgcttcaagctacatgataataaatctccatttctctgtttgagtgcactctccagatataaaagtcc

SEQ ID NO: 36185 - DNA, 1116 bp, Mus musculus
tgcagtatagctgtaccgcactgtagtgcactattcacctcggcacccagctacaagacacagctacagaggctaggtactgagaaaacattccgagcgaggaacttagatccaactgtaattgctgtttttataaatcccattatttccccttttatccagtgaatctaaggaaattgtgtggaaatatttctcaggctagaagaaagtaattttatacagaagagaaaatatatctaataaagtaagctattcttggttctttttagttttaatatgtatctttttggcttgcacagcaaagattagtgccctaaaagaggcctaaatttggatattagatacttaagacaaactctgaatgacgagggagtgtcattggcttggggaggaacaacatgccattgaatatccctttgctctttctatggctattgaaaagagttgaatttgtttctacttacctaggagccaagtgctggaaggctagagaaggaagctgggagataatgcccagtgtaaaaggtggactatgaagacggaatagagtaataaatatggaagtgagacactcagggagaaaagattctggacatggggcagaacgctcaatggaagacagagaggtgagcagggttctgaaagtaaggccctgagaggatttgctggtattttgtaaattttctagttcttaagttactgtattgataatagcaaggattcttgtctatgcagtttgacagcctttgcctttgactggtgtgctcagagccaggggctaggctaaccctgcaggggtgctgagagtaaggctttcacctcttcctctaaactccttagaccagctgcgaaggcaaagggcatgtaaaaccatcgccatttcctgcactgccacaggagaagagcaagcaccatgcacgggagacaagtggtggaggaggtggtactaggagcaagatgagtagcactgtagtaactgtagtaatatttgttactgggacagcgacacaagtgttttaggtaggaaaggggctctggagtatttgaaaacctgttctttcctaggagtgcaaagttaaaaaacattaaaaatcaaactatgaatcgaagagtttg

SEQ ID NO: 36186 - DNA, 1104 bp, Mus musculus
acccttgtattttggcctccaaatgtttgcacatgaattggtatttctctccgccccctctctgtatgtctctgtatatgtgtttctgtctatctgaaaaagaacatagaaagtaaggtagtccagatgctgtccctgaaggtggtggtggtagtggtggtggtagtagtactagtcaccataagtagtagcagcagtgatactaatacctgcctaataaggcagtgggagttcttgtttatttaaccttgtccatatgacttgactatcaagcaggcttgactccccagaccttggtgcctttagaacccatttgagctcttgaatgtggtataagtgctaatatcatacaggaaacacaaagtcatgggcaggctttgtcttaataagatgaggccagaagcaaagtctttgtgtctctgtcactgcctgataattgttttacttgtagaactcacacccactcatcaacatctagccctagtgccagtcacagctactctagtatcttggccatttgaatggctataggccctgatcaaggcagcctctgttcataggttgaggttaaggggtggattctgggaggaggggaaaactgcagtgcagattcgagacttagggagatgggaccagtttctcactcaaagaacttgcctgttgtttccttctattgtatagggctcttctatctctccctttgtcagctggattcaagagacaagctgggaattgtgtggggtacaattggtctctttctaccatttctttctatgaaagcccttcctctcttccctttgatgagtttccagattcgcactgaatttccatcatggaactggttcttgaggtgtgcccagggcatgggaatggagggagggctgtagagcacttggctcctgcttaaagagacagcatcaggatcaggagagtcagtgggatgggccttaatctgagactcacaatagtactgttgatctccaactgagaacattgatgagaagagttctattacagattggttacacttggggggtggtaaagagatgaaaataaccagttctgaactgatgtctttgattatattttgaccacaggatttgg

SEQ ID NO: 36187 - DNA, 1147 bp, Mus musculus
acagatttattccatgtggccatattgggaagagacaggtatcctcgagtccatcttttgggtaaccccatgagctttaggtttaaatagtggaggactggggcaaggggcgggagatgtgtaattaaagcaggcctcctctgagtgtggcctagtttatcatatcacctcagtcccagccctgcagggtggtctgatgaagtccttattgctgtatgtaattgcttgagagagtcaatctggttcgctgatgttgattatttccctactagcatacagctgtactgtcatagagacttgccctcatctgaaggaccggctttctagtgagcttctgctgttcctacaatccatggtgactgtaggattaggacactgatttactctatgcctttagccataaaaagggatgaaagaatggacagcggcattccttgagtgatttacatgcatgcctatgtgcagaggtaaacaggtaacaggaaggaaaaggagacgaacacagaatgaaggcagaaatgccaggctttctcctcagacatagttctctttttagtttttatttctattattttgagacagggtttctccatgtcaccccaggatgtcctggaactcactctgtagagcatgttggccttgaactcatagagatccacttgcctcttgcttccagagtgctggaattaaaggtgtataccactgtacccagtttgtacatagttctttatttttaaacatgtcctttcaactttattcaaacaatatatttattatcaatatcccagaagtgtttaacatattccaaaaataaatttcatgtgatcaaaaggtgatgttcactttagtcctgtttgcctccatgccaccatgagccttcattccaggccacatagacaaacagggccagaaccacgtgaacagcaataattgcagcataaaaatagctgtctctattggacattccaacagcatcttcaaatataagatttcattgtaaaatagccagataggaactgtgatccttaaagctttaaagaacagaagtgtcttcaaggttgaagctaaagataaaattttttcatttctaaactctggaggctgcagcacgtttagggctgctttatcaaagagctccagggcatgg

SEQ ID NO: 36188 - DNA, 1139 bp, Mus musculus
aaggaactctggcaattcctgtaactggctgttaagaatgaggaagctgtacagcatagctcaaaatccaagctggctcactacaattaaatttccatttcttaaatactaaaatttgcttgcggctcactgcccaaatattgtttgaattgagcttattgatattttagcttaaaccagacaatggcaaattgcattttaatttgacattcattgccaaactcagaaaaaccagtgtgatcttttctgatgtcaatatgtagtaatttttctctattgtcagctttcttcaattacatcttggtggtgaatggaacttgtggaaatctgtgttcttttttgtggggatggatgggatggaaaggggaagaattgcttaattaatgaatatccgttttgactatgtcaatgtaaatgtggaattaccgtgtgccaatgacaggtacacacttaagttggctgaattgttcagaaggacagccatggcttgttctgtgcagttgcttgttcttaaattgaagctgatctcttgtgttcgtttacgttgagatttcaaggcttttggaaaatggggctgatagtgtctcttcctgtagtaggtgaatttaatttcctgttttcctgtttagattttaaaaaatacataaatctttgtgttggcaatttaatagtactgttaccaaaagaagttactaataatcacaaacacacatgaaacacctcatagatggttaagagttgcaaattgtgggactttctgctccccttcttttcaaaaagtagttctgtagaatcaatataaccaaagcaagtaggaagttgactggtttggaggatctacaagtagtcttagatactgtaaagtatcagattgtcaaccaggacttttttcctgtattcctgcgaaatgtattctgaattactgcacttttgtatatacgacagtcccctgtacattctctatttcctacagtgtatataaaacctggctggtttttctggaagctgtgtgaggggataacaatagttataatacaattggtttctatttttgagttcctttttgcacatgaaaatattttagcaggtatatctaaatgagtttgggtggttgtaacggaagctggctatgtgatgga

SEQ ID NO: 36189 - DNA, 1177 bp, Mus musculus
ggggaaaatgtttaaaacataagtgcatcaaataactatttagtagaaaataggacaggcttttttgccatacaatgggtatgtggtagaaataactctatacttatttgtggagcacccagaaagacacattaccagaaaggacctggtacagttcacctgcatctatggcccagaaaatagtttaaaaatagtaaagggagagaagggaaatgcaggactacctcaagctctatcccaggcttagtttgctatttgtaatttgagttgcatgtagttttattttctattatgacattcatggtccaatatcctaaacaatttttttcccctctgattgaaggtttggtttcagaacagaagggccaagtggagacgacttcggcgggcacaggcattcagaaacatggttccagtcgccatgagtccccctgtgggtgtctatcttgatgatcattatggccccatccctattgtggaggttatttggaagtgctacccaatggtgcctcgtcccatgcatcctcaaatgatgcctcttccacccaggccccctccaggattcagaatgcctccaccatttaggccacctcctctgccaccttttccctggccacctgtaccacctgatgcgcacatacccaatgcagcaagggaatataaccccttccccttccccttcccctttccctttcccttccccaacccattccccaaccccaaccctaaccccaaccccaaccccaaccccaaccccaaccccaaccaaaattttgcaggtcccagatacagatactgaagtctacatcagttttccaaaagtgtttttcaatcagatttatatcgtttgtaaacactatcacgcattacctgtcaagaagctgttaaacgaaatgtacaaagttaatgccttctttgttttgattttcaataaaagtttggattagcagcatattggctttgagagttataccaactttaagggtatagatgagatgtaaggggactgccccacctgggggttcatcctgtctgcagacaccaaaccccaaactttgttgccaagaggtgcttgctgacaggaacctggtgtagctgttccttggaaggttctcccagcaactgaccaatgcaggtgtggatgcttgcatataatcatcagactgagctcaggaac

SEQ ID NO: 36190 - DNA, 1214 bp, Mus musculus
ggtaagagcacccgactgctcttccgaaggtcaggagttcaaatcccagcaaccacatggtggctcacaaccatctgtaacgagatctgacgccctcttctggagtgtctgaggacagctacagtgtacttacatataacaaataaataaataaataaatcttaaaaaaaaatatatttttttaaaaaaactgtcttcccaataaaccagaggaaatcagaacttttccacccatcccgctcactaaatgggcctgagcagcctgttcctgtagcctgaaaaaggagggggttggaccaattagcatagtttcttttagattaattgcagccctgcctccagataccaaacatcaaggcatattttgggccttactcttccactaattacagcccttcaaaaatcggatttttatctattgcaattttgttttgttccaggtgacctggaactcctcctgtctctgcctcccaagtgctggcatttaaagcatgcactgccacacccagctacagtcctgtttcttagcacctgtcagagcggtcactctgtgaagcaaccaggacagatgtttctccccagccaaggtgaaaatacttgcagggtcaagtagaagccattggggcttgtgatagcgagaagtctgatactaatagtcttggctaaatatgcttgcataattgtctcaatgtatccctggaatatccaagagggctgttgagagcctaaaggaagcccagctggctgatttgactgtcagtcctttttgctcagacagccagggcagcaagggaaagtctcacagctcttaattagggatccaaattgctccattcccacaatatctttgtttgtttatggggaaattgatgccaagggtgcttacaaatatcaatgcaaagaactctcatgaatattaataaggagaatctttacagttgctaaagggcaaggacagtgagatgtcccagtgagtaaagagaaaggcattagaatgcaaacctgacaacctgagttccacccctaggactcacatggtggaaggaaagaaacagtacctgtaactcagctttctgaggaagagaagtgtctgtcatattttgcctgcctggcagtagctgttatggttctatgggctgtatagactagcctcaaagggtaactaactgcactgctgtatatgtcatctcaagatgtctaaatcacattcatag

SEQ ID NO: 36191 - DNA, 1135 bp, Mus musculus
ctattttgtttacgtaactaaatcaggtactcacatttcttaaaaattcattatccattcatacttttgaaactttgtcttctaatatctcattgttttatttgtaaattattacttaatctttttaaattcctattttcttctgaaaaataaaacatgataaaaattaaagctagaactttcaaatcaatcatagacctacaaccactgaacattctctatgtacccttattgtgtacatagaaaaatctatattattgctgtattttgcatgaaaatgccctccccctaggctcttatttttgaatatttagtcatcagagagtggcattcttgaattgtcttaggagatttggccttttggagtgggtgtggccttgttggaggaagcacgtcactagaggtgggctttgagatttcaaaagcccaaggccatgtcctgtgtctgtctttatttcctgatgcctgcagatctggatgtaagactttcaagctagtacttttccacagtgtcttcctgtgtgccaccttgctccctgatacctgatgataatggactaaacctctgaaagtataagcaagcccaattaaatgctttcctttatatgagtttctgtgatcatgacattttcacagcactggataagacacttggtcgcagatacagagtttttgagcttaatgagattcttcttttaatgtcattttattcctgacatgagattatttactatcttttattctttcattttcttgtttgtacatttggcctttacttcattcattgcataaattgcaaattaattttgttaggcatattttgaagtgtagacatatgaatgcctgctatcctattatatgtcatattttactaagttattatctacatgaatatgcagaggtataaataaagaacatataactcaaggtatttttgtacacagctggatgagaagggaaatatacccatggaatgacaggactgttccattctttaaaattcattcattatttgttcacgttacataccaattatcagatgcccctctcctcccagtaacctctcttgcaaatcctcccccattccttcctcctcacagctcccccacccccccatcacatcaagtctctgcaa

SEQ ID NO: 36192 - DNA, 1561 bp, Mus musculus
aagtttggagatcgcttataacatattgctatgtttctcatgttaaaagcctgtgtacggtttgttacaagttgtccctaagaaactatgcaaaacacgccgatctctgtaccaaataatcggctatgctgtaacactgtacactgtaagacagttccgttaccacaggagaatgaaaagaacccgggactcccaaagacgctagatgtgtgaagatcctgatcactcattgggtgtctgagttctgcgatattcatccctcagccaatgagcttactgttctcgtggggggtttgtgagccttgggtaggaagttttgcaagttccgcctacagctctagcttgtgaatttgtaccctttcacgtaaaaaagtagtccagagtttactacaccctccctcccccctcccacctcgtgctgtgctgagtttagaagtcttccttatagaagtcttccgtatagaactcttccggaggaaggagggaggaccccccccctttgctctcccagcatgcattgtgtcaacgccattgcactgagctggtcgaagaagtaagccgctagcttgcgactctactcttatcttaacttagctcggcttcctgctggtaccctttgtgccatgtctgataacaagaagccagacaaagcccacagtggctcaggtggtgacggtgatgggaataggtgcaatttattgcaccggtactccctggaagaaattctgccttatctagggtggctggtcttcgctgttgtcacaacaagttttctggcgctccagatgttcatagacgccctttatgaggagcagtatgaaagggatgtggcctggatagccaggcaaagcaagcgcatgtcctctgtcgatgaggatgaagacgatgaggatgatgaggatgactactacgacgacgaggacgacgacgacgatgccttctatgatgatgaggatgatgaggaagaagaattggagaacctgatggatgatgaatcagaagatgaggccgaagaagagatgagcgtggaaatgggtgccggagctgaggaaatgggtgctggcgctaactgtgcctgtgagtaacccgtggtctttactctagattcaggtggggtgcattctttactcttgcccacatctgtagtaaagaccacattttggttgggggtcattgctggagccattcctggctctcctgtccacgcctatccccgctcctcccatcccccagtccttgctccgctctcttcccttttcccaccttgcctctggagcttcagtccatcctgctctgctccctttcccctttgctctccttgctcccctccccctcggctcaacttttcgtgccttctgctctctgatccccaccctcttcaggcttccccatttgctcctctcccgaaaccctccccttcctgttccccttttcgcgccttttctttcctgctcccctccccctccctatttacctttcaccagctttgctctccctgctcccctcccccttttgcaccttttcttttcctgctcccctccccctcccctccctgtttacc

SEQ ID NO: 36193 - DNA, 1239 bp, Mus musculus
tgaaaatctcttaaaatttccttcatctttaattttccttaactttagtttttttcacttagaattcaattcaaattcttaattcaatcttaatttttagatttcttaaaatgtttttaaaaaaaaaatgcaaatctcatttttaagagatgaaagcagagtaactggggggcttagggaatctgtagggttgcggtatagcaatagggagttctggtctctgagaagcagtcagagagaatggaaaaccaggcccttgccagtaggttagtgaggttgatatgatcagattatggacactctccaaatcataaatactctaacagctaaggatctctgagggaaacacaacagggaaatattttagtttctccttgagaaacaatgacaagacataaaattggcaagaaagtcaggagtgtattctaataagtgttgcttatctcttattttcttctacagttgcaaagcccagaagaaagaaatggacagcggaagaagtggttgtttttttttccccttcattaattttctagtttttagtaatccagaaaatttgattttgttctaaagttcattatgcaaagatgtcaccaacagacttctgactgcatggtgaactttcatatgatacataggattacacttgtacctgttaaaaataaaagtttgacttgcatacactacagttgtttcacgttaacgtcaatccccatttttaaaaatctttttggtttcgcctcatctagaaaaagaaaagcacctagcttaccaggacactaaacaaaatgctgttgggtaagtgtgaaccagcaacagcagcagcagctggaaatttgctagaagtgtatattctcagactctactccagaccttttgagtccgagattcttaaggtggaccttcagtagagatttctaagtgctctgaatacttaaaccttggagcaccattggtttgcagcaacaggggggaaaggctatgtagagacagccttcattaacttggtaggtggtatgtttatggtttgaatatcagccaagggcaaagatgctgaggtttgttgcacagtgaggaggtgatggcggtggggtattttgggaaagatgttagtgcattgaggctgagtccttgaaggagttatcaaaaccctacctacttcttactcttttgcttcctgctgccataagccaagacagttcaatccatcacatcttccttccctggttgaagggcttg

SEQ ID NO: 36194 - DNA, 1167 bp, Mus musculus
ttttgtctacatgttatttatgtgcaccatgtacacacaataacctcagaggccagaagaggggattagatcccctggaactggggtgataggtggtgtaagctgcccaatgcaggtgctgagatcaagagccaccgtaagagcagtcagtagtcttaaccactgagccttgtctccagccccaataagagacaacaattaaggtcttattaagttctcaaatatagattgacttaaaagtcaagttgtatgaacatacaaggtgtgcttattgaaacacagcaaataaagtaggaagataaaattacagtagttcctaaattattaaattacagtccggctctctttccgttcccagcgcagccatggctcgtggtcccaagaaacacctgaagcgcgtagctgctccaaaacattggatgctggataagttgactggcgtgtttgctcctagtccatccactggtcctcacaagctgagggaatgcctgcctcccatcattttcctaaggaacagacttaagtatgccctgactggagatgaagtaaaaaagatttgcatgcagcgattcattaagattgatgggaaaatcaggactggtttcatctaccctgctgggtttatggatgtcatcagcattgacaagaccggagagaacttccgtctcatctatgacaccaagggtcgctttgctgttcatcgtattacaccggaggaggccaagtacaaattgtgcaaagtgagaaagatctttgtgggcacaaaaggaatcccgcatctagtgacccatgatgctcgtactactcggtaccctgatcccctcatcaaggtgaacgtcaccattcagattgatttggagacaggcaaagtaactgacttcatcaagttcgacacagggaacctgtgtatggtgactggaggtgctaacttgggaagaattggtgtaatcaccaacagagaaagacatcccggctcttttgatgtagttcatgtgaaagatgccaatggcaagagctttgccactcggctgtccaacatttttgttattggcaagggtaacaaatcatggatctctcttccacgaggaaaaggaatccgcctcaccattgctgaagagagacaagaggcttgcggccaaacagagcagtgggtgaaatgtctctagg

SEQ ID NO: 36195 - DNA, 1579 bp, Mus musculus
tatttcttagaaagtggcagccaggttcccagtgtttgatggcgtggtgctttcagacttctttctacatagtggagacagaattgttaagaaatgtaggcccattttgaagggacttcattttattctgttggctaatgacttcatgtcatctcttctcctcctgccccttcactccatcatacagggctttggccaggctcactcggctacgtgtccacgtcagctatctccttacttctgtcctccctcacttggagcttcgtgagatcgggtatgactcagaacaagtggatgggatcctgtacacagtgctggaagcaaatcacatactggactgagcaccaggctatatatcctctcgtagctttcttttctcccttgtgcctgtgtactgaatgtcctcccttgtcttgtttctcctttctccccttctcccttcctccccttctccccagaccccagcctctttctttctcttcacctttatgccttatatggagaatctttgaatgagtcctggctcttaatcggtgtgcttcacatttatggtgggtgtgaagaaagaggcccattcaacagcttttttttttttttaagagttcaggaacagaaaagcaatagtcaccaagttaggtgacctgaaagctttaattttgatgatctagtagatacttggcccgtttcatattcctgataatggtttgtattaatttaggtgaaaccagtcagcaaatgttgggtccaatgtgcttggtgggataagtaatgatttcagccctgccaaggttctagcaatctagttggaagcacaaggcacaccaagttaactaactatacagagaagggtatggtgtgtatgagtggtatccacatgacatggaagatagagtagagtggtttaaaggaaggcagtacaccataagtgggacctaaatgaagctttcaagagtgaacatgacggcactcttaatgatggttggtgcttaggtggtaggattatggttgatgattttttccttcctatcttcttgccctctttacactgcaatttttctctaacattcttgttgccctccttacattgccaaataaattgttttgaaagctaacaagtaggcttgaatttgggtgtcaaatgagacatttatgaaagtatgatgtaattttacatttataattaatgttgagtttaatattacctctggagagacagcataaacaaatgtgcccctccccccaatccagaatgtgaaaaatgtgtttggtaacaacaatagactagagtaaaggaaagctgccagccaccgcacaagtgttccatggtgtttttattgtcataaaagatatgtgaaaataaatatataaggatctaaatcttaaatttcaggtagcaggggaaatattttaggatagaaagatttagttgccatccctcgcaatattcctacatactttctaggctatacagagtgagagatagacctcagagtacagaagtcgtacatcttatgcacatgtaaagatgttttgtgaatccattgctttattatatttatatagtatattgtctcaaaga

SEQ ID NO: 36196 - DNA, 1196 bp, Mus musculus
tggtttaaaaagtgcatatatatgtagtaataaatggtaggcaagaaaagctagagtgttcataaattacatcagtggttgtataacaatgaacataccaagtgggtgaatgttgtggtatgtgaattaaatctcagtgaaactcaaaaacataggaacttggacattatccaaatgtccacctgtcaacatgagtgacttttaactgatggcacatccatttagttgggtattatgaagccattaaaacagtagactagatctatgaatatattgtgacctctactcatatccaagattttatattaagttataagctaagatacatgtatgtatgtatttatgtatgtttgtatgtatgtatgtaacacatttttaagcaaatagttcatgtgtatagtttgtagagataatttcaaaacaaatataggaataaaataggaaatgtatataacgggctgtaaaccttctgcaagtgactccgtacaagctaaaaacaaaacacctccaccttggaaacatttttaggtggtatgatttggagcgatttttacctttttcactactttttaattaaagtaatttttaaatattcttacaaacacttggcttccaaaatattagtcagacctactctgagggtttctgactttactcaggacaaacttgtattcatttgctatattgctcacgcgattaacacttcaatttctcctagagtttaaggggtgggacgtgaaggagccaccctggttacagcctcttgcacatgttaccctgggctacacttctcagccaggtttcccggaagggactgcttcctctcaggtgggcagccttacctcctccttgctagacctgcagaccacttaaaaatggagacaatctaatcgagggtacctttcaactggtgcagagatagagaaattggtgtatcccgacagcaagattctactcagcaataacaaactaaggaaccatatatgcaacaacttggatacatctgaaatgtattttgctaagtagaagaagccagactcaaacggctgcttactgttatatttcatttgtgttgttttctggaaaggatgaagcaataaggcagaaaaagcagtagacaccaagtatcggcacaagggatttctttttaataataggaactttctctgtgttatttatagttacaatgtgtatgt

SEQ ID NO: 36197 - DNA, 2159 bp, Mus musculus
ttaaatactgtatagtattgaaaaagattgtataaaattgacaatatcctgggtgttaaagataataatgaaacactatatatggcagaaaataccctgaggggtaagaccatgtgaaaacctttaattctcaggatacattacataggactgttcctaaagatcccaaaaatcctttaataattttgtagtcttcagtgtttagtcctagagataagactttttctaggagtgtttcctgtatacgaagttttaaaactaacccagtgttaaaatatttctttactgaactcaaactgtgttttgtcagaaccttcaacagtttcagtaggtagattcataagtttattaacttaatgattgcttccacactaagttttcagagtcctcaaaagcatatttattattatgacatcttttaaaccaaaatattggtagtctatgatactattgcattcaaaacaatatccattaaacatggagtatctgtctaatgtatgaactttcaagacaaatgaactagcatctatattaaagggacaggaaagaaagttctttagaggaaaggcagcctgcctcaaattccctagtgattcgtttatagttgttgaagaagaagaagaacctaaatggtttagacggtagaaccagctttggagtcagacctgtgaccctcaaagtcacccatgtttaccatcctgagcttagaaagtcactcactctgagcctcatttatctcatctataaaaagtaacattgcttctgacctccctgagtaagggttaaatgagattataatatccaaggtattatattatattatattatattataacaaggggaaaaatgaactttagggtactccactaagtacatcaaacaacatataataagaatttcattcaaaagcgagaaagaagcataaaatactacaaaaggtcgagtgaaatggctcagtgagtaaaggcatttgccaccaaacaggaagacctgagttcaaaccctcagacctgccaataataggacaaaaaggctgggaaataatgctatagtttctttaaaaatcctgtaaatccataggaacaaataaaacaaaagggaaataaggtggctaaattttactaggctgtaaacctaattctgcttcctagaagtaacagaattatattggtagttgtactgttctgttagccctacagtgtgttgaaagagttcgcatggctgaggaaagggaaacaaaaatgctagagataaagatccactttgtgtttaaaaggttggtgttttaagatgtgagaattttaatcacatattttcataactacagagccctcaaataacctgaaacaaggtagcaaacaaagtaaagaatgaaaggagaaacaggcacatctccaaactggtgggtactcagtgtctccttcctaatacaagtactgctgcacagttgataaacaaggaagtagccagtttcagcactggatgctggatagatctgaaagacagctctagaatatagctctactagaatatatatattttatcccatgtatatgaaacatctttaggctagatcatgaactgaaccacaaaacaggccttaataaatacaaatggactaaagtcttgtcaaacatgttctcttccacatggaagaaggttacacatcagtaccaataaatcgggaaactcacagataagtgaaaattagtgataacttaaagaccaagtcggtcaataaagaagcgggagagatggctcagtgcataagagtacttactgctcttgcagaggacctgagtttgatcctcagcatccacactgatggttcccagctacctttgtctatatatgggatatgcttagagataagcctattcaatgagaagaaagaccgtgtaacagtaattcacttcatatcttaagccataggaaaataatagcaaactacacctagaacaaacaaaaaggggaaaacatgcaaaatgcctgagaatagagtacaagagagaaaatgcaaggaatccaagcgagaaactggcaagccttttgctacatacagcaggaagaggtagaatgtaatcattagtttgagaaataaaggagggaatgttgctactgacctttgaaaaatagaaggtgtgtgagggagtactgtt

SEQ ID NO: 36198 - DNA, 1393 bp, Mus musculus
tcagttactacttaatttttgattggaataatttgtgcatgcatttatttttcatttaaatactgtgaagaaaagtatacttgtttttttgtttcagaacggaataaaatctggacacaccggtaataatgcttacccagagtcaagtaaccccattgcccaggcagttgctcactggtgttcattttgtgtgtataatctctgtcttacttagattctacatatgatcaccagtatgcaccaacttcttactgcagcttaattgtgggcagttgtttgccaaaatgaacgttacccagtctttactgggtttttgtggccattcacagaaattgctgggtcctataaagtctccagtggaatttactatctactctgagagaaaattttacctgttaagggcaatatgggcaatgaaaaccaagtgtaccataaatgacagcaagtgtctttcaggaattcacagaatgtaatacgttttttacagattagagatttaattggggcttttatttttcttatggtactagagatcaaaccatgtgccacactcttggataatatatccagcactgaattatgggtaaggtccagtgattcatttacttttgacaatatacagatacctcagtgcatttgtttttaaatcaagatctctctgtagcctatgctggcttggaacttacaacccgcctgcctcagtttttcaaatgccaccatccctacatgttctgttgattgctatcacttgttttgttttagcctatgatttagacctgtttggtgtagttttctgtctttaaagaaaaaagcccttttagctcttcatttcttgtatttcatccaagttgctgatatgatatcctaaaaatgaaaataaactgattaaaagattttaagtggctgaactgggtttttgttctccaggtcactcataaactcactgaagggttcatgttacagaaaaataaataaattttaaatgactattagtggtagtaagttttatgaatagaataaatactagaactgaatagattcactttgggtacaaatgtttccatgaaatagatagctacttcagtaagtttctgtcaatactcaaaattacacaatgtgaactggacctggtagcacaggcctataatctctgccacctggaaggctgacgtagaggggtcgcagattcaaagctggcctgaattcaactaaattaagaccttgtcacaaagaagaaaaaaaaatgtcagcctgcagttttgtgatagagtgctgtgctagcatgcacaagtttcaatctttcatactgaattggggagggtaatgagagagaataatgcagactattaaatcttgtagactcttaaaggtaaacatgacttttgagtagatt

SEQ ID NO: 36199 - DNA, 1164 bp, Mus musculus
cagcttctcggaaaatacagaattaaagtaggtttttttgactgacctcagaagtgtcttttttttttttcttaatacttccgttacctcagctttcattgaaagatgcagtaatggtttacttgagtatacacaggtataatggtacataattatattcttttctttactatttatttgtttagttggttgttttgagacagggtcataaactggcccagactgccctggagctcactgtctatcctaaactgccctcagcctactctgtcttaattataagtgcacaccatcaaaattgaatttagaagcatgcatggtggtgcttttggaggaagtggcaggagaatcagaagtctgagttcattctcgcttctatagtaaattgcaggccatcgtgaattactacatgagtcctttattgtccccacaaaaagaaaataagaataaatttgagttttgagaatagagtatctctggcagatcacttgcctagcatgtacaaaataatgaatgttattcccagtgacaggaaaatgaattttgagttgtagacttatgggcagttggaaaaaacgagaaaaaatatgtcttgctcagtgttttataactttctaattatattttttctcgaaattgtggtttccctgtaaagctatggtataatgtaacaataagtatatttacactgataaaagcctagagaggctgggtagcagtggcacactcctttgagcacagtgccagggaggcagaggcaggcagatcttggagtttgacaccagcctggtctacaaaacaagtctaggacagccagggcctctgttacaaagagaaaccctgtctgaagtaggaaaagaaaagagaaattgaagaaaacaaacaaaagtcaagatatataaagctccactattgacttattaattagcaaaagggtcttttctatttgctttgagatgatttgttttgttttgttttgttgtttttttttttttttttttttttttttttggtttttccagacagggtttctctgtagccctggctgtcctggaactcactttgtagaccaggctggcctcgaacgaactcagagatccgccgcctacctctgcctcccgagtgctgggatttgaggtgattacctctactttcttcctgctc

SEQ ID NO: 36200 - DNA, 1862 bp, Mus musculus
ggtatcagattccctggagctagagttaaaggtggttgtgagccacctgaccttgaactctagtcatctggaagagcagtcagtgagcgctcttaactgctgaaccatcctcttcacctgctctaggcatgaacttggcctgtacagaatcactcttttaatgatcaggtcagggtttgcatcttaactccttcctaagtgattatagtacaagggaggagttgagtgctagatccttcattaagtttgctttccaggctgctcatataggctacagctaagcccataaactctgctcttccatactaacctggtgcattttttttgcctttctaggtgattgacatctctatgatccttgcagaagccatcaggagaacccacaatggagaatctgtctcctacttgttcagccatgttcctttataacataacttctgaagcattttgaaaataaaccaaccccaccccttgtttttcttggtattggtgagttgagcagaagacccagcttgcttcagtatagctttttccatctcacattagctatattaccatttgtcctaaatgggagaaagacagattgctattagctgctaggatgttcaacctgcattgttgtatcctggctttcttgtttattttgtgaaccttgcagctttaagttgagctcagctcttgaaaggtgtatagactgttaagagagtattccacaaggtccttaggacgtgattggcaaagctcatactccattgcatgtgaacgctttggggttttcgtcattcagaataactagcaacaaagccagcccatgtgtaatacattttcagaggtctgcagcaagaaccctgagcatccttaaacatagttgagcatcctgtaaggcaggggcaggtagctcaatgcagtaattaggttttgggaggaagaagcctgatccattgctatttaactcttctctatctcgcttggattctctacacctattcctttccagttggctttacctttagctattgtgaccctttcctggccaaatatcttggactcagtgatcattgtaacaatatcttcggtaatacagacttgcttcttgctatgtaactgctaacattcacattaggtaacttgctgtagcacgaccttccttagcctactacctctgaggtggtgggtttaggtggtgtcgcagtgccttttgattaatttaagtatttaatttttatcttccttggatccgtttggcctctcaattgaacttactgtattgtgtagaagaaacttaataaaatgtctgtcatgtgtgcagttttgggtgtactgtcatatctgatttcccttctggcttgtgttaggtgtttcactggccagcacatctctctttcctaactattttagccaccttgttaagagaaagcaagacataaaagtatctgaggtttagtgagaattagaactaattaattctgtgtactatacatgaattatatcaaaaataattaattccttctgggtttctgccacttattcctggaaatccaaattcctatttcttttcagctgattttgtctaatgtggtaatttccctcctttaccagtgcttaatttctgaataaaatttgggattgtaagcacgtagaatttaagcataagatataatgcattgcaaaattttaagtgagtttctttgtatatgactgtataaggatatacagttttctttgagactcatagaatatagacctcggtggagagcgctcctttgttcttttaaaccttgatctacctttctgtggggagggttggttttctttggctttttgggggcgtttgatttttgacagggtttcctctgttctag

SEQ ID NO: 36201 - DNA, 1199 bp, Mus musculus
tgtgttttcttactatacttataattttggatctatagtagagtcgtctcttgaattatctgagatgcttttatcttctttacaaaaatataccagttgcttcattttcttgcctcaaccaaacatcaagaagtgtgatgtcagatttctcttctttgttcttgattttactggaaagagccttcgcgtgttgccatttagtatgatattcgttatttgtttttagcatcttcaagcaacttttgttgtttttttaatttagagttttcatttggtttggctgctgaattttgtttaaaaatttttagaatatgttattataattccatatgttggtaaatttttaaatgttgagtcattcttttattactggaatgatttttattcctctgttgttctgttagaattcattttgaaatgtatttagaattgaatttataatttagaaatgtattcagaagtgaaacaatcctatagtcttattattcttcattatctttttaggctttgggtattgtatagtataatttgatatcatactagatttgccagatgcatttgaggtttttttaatctttatctgtgatcttaaatgaattaaataatatgggactaatctgttctttcaagaaactatagaactcatcactacaactatatggacctggaaaagatctttaagtacccttccaatcttgagtaaagttattagtctcttcattttttaaaaaattatttttggcaaaattaggtaatacttaaatgatttttcaacggtgtgtcataagtttatatgtagtattctctagtaaatatgttagtatttatccagtagtgtgttgcaattggcttgccaattcaatgcgatttcttcccattttgggcttagtggctggctacacactggtgcttaaaattcaccatggtgggaattttataccataaaacaagtgctacaaattatgaccaactcttgcatgtttaccatcccactatgtatagttcttagtatatctcctttccattgttagtattgcctgcctgcctgcctgcctgcctgcctgcctccctccctccttccttctcttccttcttttcttcatttttgagacaagatctcagatgtagtaatggctagcctgtaattttctgtgtaaagtaggctggtcttcaacacaaagatatctatctgcctctgg

SEQ ID NO: 36202 - DNA, 2100 bp, Mus musculus
caaaaccaactgatccagccagctaaggactctgaaactccatcaccaaaataaatccttccttttactatttttctcagttatttggcacatcaataaaagtctaagcccctgccgccccagccgcatcaggtaaacctgttctgcgaggcggccgcgccggggcggctggcggcattggggcccgtggagcgcgtggcggccctgggcaacaccaccatgtactcaggagccagccccgttcttgcttctcctgctccgacaacatcacccatcccaggatacgccttcaaacctccaccttgactggacttcggcaccaccgggagaacaatcaaactacaggccaatttctttgaaatggacatcccccaaattgacatctatcactatgaattggacatcaaacctgagaaatgccctcggagagtgaacagggaaatagtggagtacatggtccagcactttaaacccccagatcttcagggaccggaagccagtgtttgatggaaggaagaatctgtacacagcaatgccccttccgatcggcagggacaaggtggtgctggaggtcacgctgccgggagaaggcaaagattgcatctttaaggtatccatcaagtgggtgtcgtgtgtgagcctgcatgcataacatgatgcactttcagggcagctgcccagcgtccagagacgctgcccaagacgatccaggccctggacgttgtcatgaggcacttgccatccatgaggtacatccctgttggccgttccttcttcactgcatctgaaggctgttccaaccctctgggtggggtcagagaagtatggtttggcttccatcagtctgtctgaccttctctttggaaaatgatgctgaatattgatgtatcggcaacagcgttttacaaggcacagccagtgatcgagtttgtgaagttttggattttaaaagtattgaagaacaacaaaaacctctgacagattcccaaagggtaaagtttaccaaagaaatcaaaggtctaaagatggagataacgcactgtggtcagatgaagaggaagtactgtatctgcaatgtgacctggcggcctgccagtcaccaaacgttcccactgcagcaggggagtgggcagacagtggagtgtacagtggcccagtacttcaaggacagacacaagctggttctgcgctacccccacctcccgtgtgtccaagtcacacaggagcagaaacacacctaccttcctttggagctctgtaacatagttgctggacagagatgtataaaaaaaaattaacaatcagacctcaaccatgatcagagcaactgccaggtcagcacctgatcgccaagaggagatcagcaaactgatgcgaagtgcaagtttcaatacagacccatatgttggtgaatttggaatcatggtgaaagatgagatgacagatgtgactgggtgggttctgcagccgccctccatcctctatgggggcaggaacaaagcaattgctacccctgtccagggtgtgtgggacataagaaacaagcagttccacgcgggcatcgagatcaaggtgtgggccatcgcctgcttcgcaccccagcgccagtgtacagaagtccatctcaagtccttcacagagcaactgaggaagatctcaagagatgctgggatgctgatccatggtcagccctccttctgtaaatacgcacatggtgcagacagtgtggagcccatgttccgacacctgaagaacacacacgctggcctccagcaggtggtggtcatcctgcctggcaaaactcccgtgtatgtgaaagtcaagcgtgtgggagacacagtgctggggatggccacacagtgcgtccagatgaagaatgtgcagaggaccacaccacagaccctatccaatctctgcttaaagatcagtgtcaaactgggaggcttcaacaacatcctactgccacagggcagtgttccagcaacctgttatctttctgggagccaatgtcacctacccaccagttggggatgggaagaaaccttcaattgctgccgtcatgggcagcatggacgcacaccccaaccgctactgtgtcac

SEQ ID NO: 36203 - DNA, 1445 bp, Mus musculus
tgttgaagcctcccagtttgacactgatctttaagcagagattggatagggtctgtggtgtggtcctctgcacattcttcatctggacgcactgtgtggccatccccagcactgtgtctcccacacgcttgactttcacatacacgggagttttgccaggcaggatgaccaccacctgctggaggccagcgtgtgtgttcttcaggtgtcggaacatgggctccacactgtctgcaccatgtgcgtatttacagaaggagggctgaccatggatcagcatcccagcatctcttgagatcttcctcagttgctctgtgaaggacttgagatggacttctgtacactggcgctggggtgcgaagcaggcgatggcccacaccttgatctcgatgcccgcgtggaactgcttgtttcttatgtcccacacaccctggacaggggtagcaattgctttgttcctgcccccatagaggatggagggcggctgcagaacccacccagtcacatctgtcatctcatctttcaccatgattccaaattcaccaacatatgggtctgtattgaaacttgcacttcgcatcagtttgctgatctcctcttggcgatcaggtgctgacctggcagttgctctgatcatggttgaggtctgattgttaatttttttttatacatctctgtccagcaactatgttacagagctccaaaggaaggtaggtgtgtttctgctcctgtgtgacttggacacacgggaggtgggggtagcgcagaaccagcttgtgtctgtccttgaagtactgggccactgtacactccactgtctgcccactcccctgctgcagtgggaacgtttggtgactggcaggccgccaggtcacattgcagatacagtacttcctcttcatctgaccacagtgcgttatctccatctttagacctttgatttctttggtaaactttaccctttgggaatctgtcagaggtttttgttgttcttcaatacttttaaaatccaaaacttcacaaactcgatcactggctgtgccttgtaaaacgctgttgccgatacatcaatattcagcatcattttccaaagagaaggtcagacagactgatggaagccaaaccatacttctctgaccccacccagagggttggaacagccttcagatgcagtgaagaaggaacggccaacagggatgtacctcatggatggcaagtgcctcatgacaacgtccagggcctggatcgtcttgggcagcgtctctggacgctgggcagctgccctgaaagtgcatcatgttatgcatgcaggctcacacacgacacccacttgatggataccttaaagatgcaatctttgccttctcccggcagcgtgacctccagcaccaccttgtccctgccgatcggaaggggcattgctgtgtacagattcttccttccat

SEQ ID NO: 36204 - DNA, 1150 bp, Mus musculus
aagcgagatcaatcttttcaattatttttctgcaagtcgcatgaattgttatagaggcaggacataaattgaaacattgctaaattctaaccctgagttattattacctgatgtatttggagtaaattaccattaatctctgttgaaagaggtagttgtgccttaggctagcatgtaagagccaatcatctattttaatcggaccaggattatgatttatgatctggtattgcatagctattctagttaactttaatttacaatctttctcatgccaattgagttcccttccatgattaaataactttccagtattagccctgtccagtgataagcattttggaatggaaactcgattctgtagaagtggtagtgactaattaatctttgctatcctcaattttagacacttagcctgtgatgaagagagagtggaagaggcaaaatttctggtgactcaaggagcaagtatttacattgagaataaagaagaaaagacacccctgcaagtggccaaagggggcctgggtttaatactcaagagactagcagaaagtgaagaggcttctatgtagtctgtgtgcggtctgtggtcctcagtgtccggaaagtgttggacacatgaagatgtttcctcaccttcgtaacttgataatgtgtggtgttgctcctactgaagtaccgggtctatgctttctacccactttccagggttgaaaaactggtcagcttgttctactgatgccattcattaaatcttgattactttggagtaagtggttgtggctgtcctgtcttgagcgtcttccatgcacctgctgacccaccgtggaccggaacaagttcagaaatagattccacttgggccaggttgttctagggagctttcctctgtgcagtcaaaccaaatcctgacctgttttttaagttcactcaagagacctatgccaaacagttcttttttttcaactacaaggttaatttatttttgttacaggaggaagttgtatattttagaggagcaggttttaagttgaattgtatgttcttaaaataatgaagaacaagagtttgtgtccatgtatctttttaactaactgttctcctctaaaataagacatatcatttttaaaaaaagaaataaaaagtg

SEQ ID NO: 36205 - DNA, 1107 bp, Mus musculus
gcgtggttggggtcccagagaggggcttctcaatctgcttgtctctggatcaggctgtaaacaaccctcggaaaatagctgttaatggtggtgataaattcctgcaaatcccagagccgcggtgacccctctgccaggagccctttctctttttccctacagctcacattttcccttccgatcgcagtttgctctagttccacccgcctctcactttgagctgtgcttcttagcagaaaatgtcagttatctctggaaacgcggcaaggacctgggtcctcagacctgctacacaccaggctgcacaccaggctgcacacgcctcctcgccctctccacccctgacaaaagccagggactccaaagactcgggaattacggcgatgccttcaaaattaacgctatctgtacacagagtgtatttctagtccacgaaaacacaggtttgctagatgtgatgtttctatttgattgatgacgactataaaagtacaaatttgggggcctgcgaagtatacagccatgttggaaaaagccggacttgattcttttctgaaaaccaatattgagctgtcaagatattccccccacatcccagggcagtactttgaactgtacccttaaggaattaacaaatagtaactttctttgtccttgaaggagaccgagaaactttatgaaaaagaaaagctcttatctagaacaaaggactgtatgaatatatacccttgaatatattttgcatcctttacttcaggaaggtctttgcttcatttcagtttacaaatgatatcacaaaaataatgaatctactgcctcccttcttggagaaagtgccggagtgtaaggtgtaagtgcaaccttctaaaaactgtcctcttctcttctctcctctcctctcctctcctctcctctcctctcctctcctctcctctcagtctctgccttgtctctggctctctcatctcagatagcgacaggttgagatgttattaaagtatcaaagaagcgactgcatttgaaaagagggatagaggaacgcatagcatttctctttcagagagagagaggaatgtcaatttacctttcctatcgtagatactgcaa

SEQ ID NO: 36206 - DNA, 3143 bp, Mus musculus
ttaggaaatcaaattaaattattaattcctcaaccaatgaaacaaagctagctgtaatccttagatttttttcttttgtttcccaagcactctgttgaggcatttgccattttcagtcctttgccaattctctcacaaccctaggctttctttcttgatacatacatacatacatacatacatacatgtaacatatataataattattattattactatccaagaccaataaatctcattcctgcctctttcatgttttctatatttacagttgtttagagaatgagcatatatatatacttgtttgttttgacttactgttttttccctcagagaaagaaaaaaacatgaagttggatagagagggatgtgggaaggatcttggagcagttgtgggaaaggaaagcatgtgatcaaaatataatgtatgaaaaaagccatctcttgagtcacccccatgcagcctaggcttgctgtgagagttggacgtggtctgggcccaccaccctgctctgtactactacttggttttcccgtcaagatgcctgaggaagtgcaccatggaaagaggtggagatctttgcctttcaggcagaaattgcccagctcatgtccctcatcatcaatactttctattgaaacaaggagattttcctccgagagttgatctctaatgcttcagatgccctggacaagatatagtataagagcctgatggactcttccaagttggacagcaggaaagagctgaaaattcacatcatccccaacccttaggagcacacgctgactttggtggacaccagcattggcatgacctcattaataacttgggaaccattgctaagtctggcacgaaggcattcatggaagctctccaggctggtgcagacatctccatgattggacagtttggtgtaggattctactcggcctatctagtggcagagaaagtggttgtgatcacacagaacaacgatgatgaacagtatgcctgggagtcgtctgctggtggacccttcaccgtccatgcagaccatcgtgagcccattggctcaaagtgatccttcacctcaaagaagatcagacagtacttagaggagaggagggtcaaggaagtggtgaagaaacattcgcagttcataggctatccaatcaccctctatttggagaaggagagggagaaggagatcagtgatgataaggcagaggaagagaaaggtgaaaaagaggaggaagataagcaggatgaggagaagcctaagattgaatatgtgggatctgatgaggaagatgacagtggcaaagacaagaaaaagaaaacaaagaagatcaaggagaagtacattgaccaggaggagctgaacaagagagcctatttggaccagaaatccagatgacatcactcaagaggagtatggtgaattctataagagcctcaacaatgattggaaggaccagttggcactcaaacacttctctgtagaaggtcaattggaattcagggcattgctcttcattccccagctagcgccctttgacatttttgagaagaagaacaacaacaacatcacattgtatgtccgctgtgtgttcatcatagacagctgtaatgagctgatatctgagtccctcaactttatctgtggtgtggttgtctctgaggacctgtgtctgaacatctccagagaattgctccagcagaacaagatcctgaaagtcacccacaaaaatactatgaagaagtgccttgagctcttctctgaattggctgaagacaaagagaactacaagaagttctatgaggctttctccaagaatttaaagcttggaattcatgaagattccactaactgtcactgcctctctgagctccttctctatcacacctctcagtctggagatgatatgactttcctgtcagagtatgtgtcttgcatgaaggagaccaagaagtccatctactatatcactggagagagcaaagagcaagtggccaacactgcctttgtggagcgtgtgaggaagtagggctttgaggtggtgtaaatgactaagcctagtgatgaggactgtgtgcagcagctcaaggagtttgatgggaagagtctggtctcggtgactaaggagggccgggagctaccagagcatgaggaagagaagaagaaaatagaggagagcaaggtaaagtttgagaatctctgcaagctcctgaaagagctcttggagaagaaggttgaaaaagtgacaatctccaataggcttgtatcttcaccctgctgcattgtgacaagcacctatagctggacagtcaacatggagcagatcatgaaggccctggcactgtgaaacaactctacgatgggctacatgatggccaaaaaacacctggtgttaaaccctgactaccccatcgtggaaaccctgcagcagaaggctgaggcagacaaaaacgacaaagctgccaagaacctggtggtgctgctgtttgaaactgctctgctctcttctggtttctcacttgaggatccccaaacccactccaactgcatctaccacatgattaaactaggcctgggcatcgatgaagatgaggtcactgcagaggagcccagtgctgctgttcctgatgagatccccccactggaaggtgatgagaatgcctcgagcatggaagaagtggattagagactcctggaggccctgccctctgtatagtacccctgtggctcccccagcagccctgactggcctaacccacctggctctctgctcatgtctacaagaaccttttatcctgtcctgtgccttaaggcaagaagatctcctcccacagaatagcagggttggatgttgtgtattgtgttttttgtttgctttattttgttctgaaattaaaagtatgcaaaataaattaaaaaaaagaaaaacaagccatttaataaaactacagctaataccaccgctaatggtaaaggtaatcatttttccctaacacaaggaaaaataaatgaaaatttgatatcatcattagaaaacatagacaagaaagtctgatcagtgcaatggaataagaataaaattataaaagctatccagaccaacataattttcttttggttcacagattccatgacatcaga

SEQ ID NO: 36207 - DNA, 1149 bp, Mus musculus
atggaattgaaataaactggaataaaattagtttaaattttggacttgagtttctgagaaacccgagaaacatgcagaccattctcattttcactattagtcaaattcagtatgtataattcatctccataaaaaagctagaactgaagatacagacttgtgattcattagcatataaagaacagtggggcatcttgtgggagcagccgcgccggaagttataagaattataagaatacaggaagtaagccgggcttggtggcacatgcctttaatcccagcactcgggaggcagaggcaggcggatttctgacttctaggccagcctggtctacagagtgggttccaggtcagccagggctatacagagaaaccctgtcccgaaaaaaaaaaaaaaaagaatacaggaagtgagcatcatcgccgacaaaaaaaaaaaaaaaaaaaaaaaaaaaaaagtgaagtaactaaggcgcacgcgcagtgacgttcagttgctcagctttggagaagtgagcggtaaccgttagtgggatagtgagagctgacggaggataaagatatgaaaaaatttcgaagtaactggtccaatggggaccaacattttggaaactcgggcagttcctgggtggagccacaaatcaactacaaatagtaagtttatagaaatattttgattcaaaaattagaagtccggcggtagccgctttgaaatcattggtttttttaaaaaatggcagtgatatttaaaaatgggaatgggtgggtagggaagtgggggacttttgggatagcattggaaatgtaattgaggaaaatacgtaataaaaaaaaaatggcagtgggaaccgggcggtcgtgggagccgggcagtcgtggcgcacgcctttaatcccagcactcaggaggcagaggcaggcagatttctgacttcgaggccagcctggtctacagagtgagttccaggacagccagggctatacagagaaacactgtctcgaaaaaaaacaaaaacaaaaaacaaaacaaaacaaaacaaaaaccaaaaaacaaaaacaaacaaaaaatggcagtggagtagtgaaacattacttgtacttaaatcctaggtagtcgctggttaatcacttttttaaatagactgataag

SEQ ID NO: 36208 - DNA, 1287 bp, Mus musculus
gactgcgcagagcactcctaacagcactgtgtggaagattgcaagtgattgcttccgttttcaagattgggctagtatttaaaggagcaaaaacccactctattggtccattagttccagcaagagaagttagaggagaattaatatatttcgtgcaaaagtactacaaacttaagtgtatgtgctaaaactaaatgtatgtaacattttttttttagcagcgcctttgctagatcagctgccagtttggattattgcccttaagagctttaaagatagttttttttacatgccttatgcatacattccactactgacactctcaaggtaatattaaacatgatctaggtactaagatattcactgtgaacccgatctattgcacaaatggagtccttttgtattactctctatgggatagcacaagatagctctgtaggatagtctcagttactagggtaatttctcaatgaagcacatgcctgtttacgattaacactaaagttttaatatataagtatttgaagtctgttcaacttagttttacgctagtgttctgacatattttaattgcatataactgtataatagtccgtgttgttttcttgcattgacatgtttccttttgaaatgaggtaatcaattaggtggggaaaaaaatgttctcgactgatacttgtatatcgggtgcatttaatggcagtcacaactctgaaaccttttgttcgtgccggcttcaggtcaatgtgtttatgtgataaatgggagtgataacagaagctttaatgggagagtaagaaatgagaaacatagaaatctaaggctgaagccaacaccaaaagagggagcacacctgttccctacctcctggaagtggagccaagtttcaggatttgcatcccaagagtctctaagaattcttgccatggtcctaaaaactggattttaagattattttacttccccttcatgcctgtctccagtatccaccccagcttctttctgaatgtaagggattaagatatcagctgtaaacttaactttgtctccgaatctgagaattcgaaagaaagctatgctcagtctctgtacatgctgaactccaaattcttccatatcaacttcaagccccaagcctccaatgtattacctaccatgcgcatgaataattttcttccatggcttttacactgtcaacggctttacctactttttaaaattaagtctttgattttatgatttatttctgtatggcactggataaaaatattattaaaacatttctgc

SEQ ID NO: 36209 - DNA, 1126 bp, Mus musculus
gaaatgatcttcatgataaacttcaaaggaacaaactttatgttttagcttctaaagacaaaaatatagtgtttttagcttttagttaaactttataattctttgcaatttttaagtattttaaactaaatatgcaaggtttgttctatattatgatcactattaatcttttatcactcaattttaaaactagtaatttactttggctcagaaatgtactatatttataattattgtattatttaaattaaatagaaggtgatagaactgatatttaaaaccatggctcatttaagttcttatcaaaacatatacattctagtctattcagagtgagcttgctcttattttgaattttttccattaactatatctttagcaaaaataattaaaatgcccagtcactgccctttctattggtggagaacaatcgcaaaatctgtgtataattagcaataacagaactaaaccattgtttagttgctaatcatatgttgctttatccatatgctgtatgactccataacatgtatgactttaaatggctggaactgctcatatgtggactaaactatttttgacatgttcatatttttataacttaagaaataaaataaaagctgcattttcacaagttttctcaagtctttcttaaggtttttttggttttgtatttaaggccccagagtgggaaccacttaattattagaattattttttaaatattttattggttaatttatttatttacattttaaaggttatcccctttcccagtttcctctccataaaccccttatcccatcccccttcacctgattctatgagggagctccctacccacccacccacccacccacttccatctcaccaccctagcattcctctacactggggcatccagccttcaaaggaccaagagtccctcctcccattgatgtccaacaaggtcatcctctgctacatatgcagctggggccatgggtccctccatgtgtactctttggttggtggtttagtccctgggaactctgggggtactgtttggttcatattgttgttcctcctatggggctgcaaaccccttcagctccttcagtccttcccctaacacctccattggggt

SEQ ID NO: 36210 - DNA, 2846 bp, Mus musculus
ttttttaaaagtagccttatatacccttgtttttatgaagagaagatactccatgctaaagtaaagaaattggacttggaatagatagaattgaagaaatttacagcttccagcgtctatgtcttcctagttcagaagtttctataataatgatgacaaaattatgtattaacactactcaaagcagaagcgccaccaggctttgaaatcctcttccaaccatttatcttgaagggaaaaaagatcagtcataatgtatggtatcagtatcttagaaggtattatcttaagatcataattgtcatataggtcagacatagagtcattgcaatattgtgaataattacagtgcctgaagttaagactaaaacaacacacacctaccaaaaatatctcataatgtaatgaagggaagctgagaactaaagccagcatctgtaattatttaaatgtcttaaaaggaatgttcactttttaaaagtgacctttctgtgtgtaatgtggttaaagactgagtgagaccaatgggaatgtgttagaaagtcaatcagaattcaacaagattcattgcctttctgttagaacgctggtggaatcctacgtattcaaaattaggatccttgtgtagcactgaacctgggaaagagatttagacttggaatttaaatttgataacagggcttggttttcaaatgtgcttgtattaaattacatttgtaatttatggtctgcttgctgttgctgattgattgttgatcagtagtgtgcatttcagagagcctttcattttgctttaatttcagcaaagcgggttatgatacatgacttcctcaaaatcttgttcaaacctacgggtgattaaatgtcttggatgagcctggggaagttaaagggaagaaaacactgttaccacttttcctgtttgtgaagagttttagaaactggaaatgctagatttgggagaagggcagagttacttgattaaggactgtctgtgaagtaacttggagtgtgagtttctttttgaatctttagctaaagtctggaattatatattcttgatagatattcgcacttggaccatagttactgtaaaaagcaaaaattcttaatactgttattctttgcactttttcataatcattttatacacacacacacacatacacatgtgtatgtgtgtatataatatatatatatatatgttgcttccattgcgttgtacagatgtgggccaccactacaacaaaatgagttctttgtgctctaaaatatttataaagaaattatttaaatgttatgtatatggtggtaataacgaaaaaaaatcatctggtgttataagcaacagcgaaggtttttgtaaaagtttcttttcagtgttctgcaaaataaaatttgaggcaagttttccctgaagttatatgtgagtattctcatgctaccatcttgcctttgaagcgtgaaaagacattaattatcaagtagactactattcagcttctacttcctcctagtgcactgtttatccttcaagggtgtttttttttttttttttttaaggcttttccaatatatgtatcccatttggaatggtgatcttaaaatgtgagtgcatgcatactatcttatttaagatacttgcaccccacccactcccatctcccgaagctggaacactgccaactaggtccttaagaatcacgcaattaacacaaggttgggtgctgctaattcttcatgaaaatccaaacacgttaagggaccagggagatgccactgcccccctgaattttcatcaaaaatagacacgtttatgtaaacagaactattttccatattcatagtgactttttaagtatttgagcctaaagattttgatctccatttttataactatttaaattgttcacaattattacatgttagccatcaaataaagctgtgcttactattgattataagtgtgtgcatttctaagttgaacactcatgatttttgctttaattacacgaaagggttttatttctttgatatttgtactcatttttttttaagtagactgaaggtatgattgtctgattttttagaaatgaaatacagatgaaagattcatagagtccaaagcgagggagaatcctgtttctttattcatagagactgactatatctttggctatattttcctggtagcatatgacaaatgtttctacagtgagaagctgagaacaggttaaaagattgtgtggcgtttgggaactggagagatacattttaattttgaatgtagttatacattttatattcatatttgtattttctgttaaaatgcacgattgtaggattgttccttagatttttgtgttgactcttgaaaagctttctttgttcttatttttaagtttgcacttgaatcttataaaaataaatccacccatgttatcaagccagtttgttttttcttatatgtcaatataaaaaaaagtctataaatttgaatgttacctaggctttttaagtagtgcggcttggatatctggaattaagtggttaacttatctttcataaattgtattcattacattggtttatttgaattcagaactattattttaatacagtgagttgaatatcttgtaacatggaaactgtgggacaaggcatagttagggtgtaattattggtaaattctaataattttaggctaatatttacacacatatatacatatatatacatatgtgtgtgttttcatctccatacacatacatatatgtatacatgtaaggtgtatggagatgaaaacacacacacacgcacacgcacacgcacacgcacgcgcacgc

SEQ ID NO: 36211 - DNA, 1165 bp, Mus musculus
catttcaatcaagcattgagcagaagtcctggctcgctgcgagcatgccaccagaaggtagttttttttttttttttttactggcagaaattgtagtactatgtatttcaaggcagatatgggctgaggtgctatggtcttgaattcaaatccttttagctatgtaaccctgggcagcttagtttgtgtttccacgtttgtgaaatgaaacgaccctgtatcaatatagcagggttgtggaaagattgagaaaccattggtaagtcactgactgtataggaagtgacacgttcatagtgttcattcagtgtggtttagctgtgatagtgatgaggagggtgacaacagccagtgactgccaccactgtcaccccaactaccatgaaggcaactgaaatgagagatgccttcctgattatcattgtgactgctgctgtctcaggcttggctgcctgatgggagggatttgatgctggatttagaattttaactaacaaagcttccccagaatctttgtgtcgggcatgcagtgggcagaaaccctggcttgcaggaagctagctcctggcgataatggttgtgggcattctgaaagtttccgtaggttaactagtcttttggaagaatgggggtcaggaggtggctctgatggttttccagagacctcttggcttacttattctttctttctgtcagtgggctgactccatggtgcaagctatcttgagattggtagtctaggaaaccagggaggagatgagcaggcgagagtggttttcggtgggtggggtagataaagacaggtgaatggatttcactttgacttttttcttaatatcttttgattgaggggcaggtgcttgttcacagagaatgaaccactcacagggcttagagaaaggcaagtttatttcttcctttttattttgttaccaagcttggggatagaacccgaggctttgtgcgtactgggtaagtttttaccactgatctacatccatacccaggcccagaaaagcagggttaaagcagaccagtatcttagctaatgggggaagcacagtgtagcagaaggcttgctgctcaggagatcagactcctgatgcttttgctaacataccagcagatagcacaaaaggatcctcagcagcagcagcagcagcag

SEQ ID NO: 36212 - DNA, 2665 bp, Mus musculus
aatgaacacttaggagtgacaatggactccaggcccaactggaaagcaagactgagcacagctaaatagctttcatccaggacagcgacccgtcacccactcagaaagcctagggcaaagaagcccctttatgaacaggcggggattggtcaatccctccttgtctagtcacccctagggagagatggctgaactggcagtagccagaggcagcctcgggatggcgaacgctcactctacctcccttgtccctgcaggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactaaaggtgcttggggttttgtttttgttttagttctgtttgtttttttgttttgtttttgtttttgtttttgttttgttttgtttcttcctgaggaagcaaatccagacttgactcagaatactcagctcttgatgaaatcactggagagggcagatagagtgcttggtttatttcctttcccctcctctctggccctttcctccactactcttccttccccagctcctcccctcggatgactcttggtacccagggaaggtgctgggggctggagcttactccttttccttccctgggttctgggtcccttgtgtggcccaccccgtctgcgtggccttacccagggaaatggtagtcagcggccccttccatacggcttgtcggtgcttttgacaacagccagttgaggaaggggaggacaacgagcagtagttcttccagcatcccagcaatgaagtagtgttgggttcatttctccactgccagggacctccaggctcatgctgggatcccctttcatctccagcatagccccccaccagaaggggaccaaggccttgcttctataccagccgcaagcccagagccaagggacttcccagttcacagccaaaatagattctttcagtgactggtgtcccatgactgaaagcagggagtcacccagccactccttctaagggagctgcctggggcggatgatgatagcagtgtgcagccaacggacaagattctgtacaggggtgttagggatctgttgccacagtgaatctcaagggaagatgataaaggcgtacatagtaccaggctggacgaccccccaccacagaaaaccaaccaaccttccctatgaaagctgagattagatccacatctaaaatgagcatagaaattaagaactcaactaagtcaagtggcaacttgagaaagccacaatatgaatcacactctgcatcacatggataataggcagtgttctagtctcagctgacccggaaccatcctcattgtctgtgtatgtgcctgtctgtttttctgtctgaggcagcttcatggaagaacgagctgggcttggggcttgggtgctgtttggctgtttgtcttttggctgtttgaaatgggggaaccgtcacatttctcaaaggtactctcgagccattcctggcacttaggaggtgtgtctatggttcctggagggcgttttctgagggttagatttctcttgtgtagctcgactctgctgaagtcgacatcactggttttgaggcttgatagtgtccaaaacccatatgtaggttgaaagggaactctcagtggacctgaggcccataggttcaagtgttctgaagggaggcgctttggttggaaggtacttggttatatgtggaccacaaaggggaccagtgtctgtctatctgctgactccttgtcaacatctagtaggaagagatttgcttgggaatagaaatgtttgtaccatgagcaccccaacgtctcgtgccagatgcagtattcaatgtgagtttgtgggtattaggcctcagctgaacttcagcagctcagtggccatgtttctagacaatggactttcagggaaagtatctgcaggaaagcacacgggaactcagaggagccattgtgggacgggctgcctggccatgaggtgatcaagtctgaggtactgaaagcagggaagaactctaggcttgctgcccttgagctcctgtcctggcatcttcgccttctgctgtctgtgagggctatgctgagcttccctctctgactcttcaggtactgactcgccctgcccactcatagaagttggtggatgaatagcatgcagggaagcctccttggcctggggcttctctgtaaggaggcatcataggaggggagtccatgaggcccgaaacatggagctgctacctgcagcggtggagggcctcagcagaggggaccaactccagaatgtcatcgaggtgggagtgccacacatactcctttcccatctgaggcttcatggtccaggtcgccggtaatcttgggtttccctgcattggcctgcctttgctttggtgccagctcggtaggtattttctggtgctcagaggaagagtggaaatccaaagccaggatacctggcatggccaagccagagtcaaacatacgtgtcaggaaagaggaagtgaaggggacacgcag

SEQ ID NO: 36213 - DNA, 2015 bp, Mus musculus
gaagctgaatgaaacagattgtggctccttcaacagactccatagggaggctcagcctgggtgtgagatgttggggagcaggggacctgtgagatgttggggagcaggggacctcttcactgtctatatatcgtggtccaaacctacatggcaagaggtaacctgcctaggctcttagcactttgctgtgggagttgtccctaggtctgtccagagcctaccctctactgcctgtggtacagggatggagaagacagtatgccttgacttggcagctcctcctcgggcctgtcgttccctaccagcatgtgtgagctctgggcctgggcaagagtgctcagagaggtgcctatcaggaaggaacaaagtctcttcaagccctaattgtccgtggtcagggggctgcgccaataagtacagttggctaagccagtgtctctgcttagaggtccttcctgcccccagtatttggttttgtgtatataagacttggcccagcatcttctcagaagccttgcagcatggtcttctgtcatcctgtgacatgctgtgggattggagagccacctcctcctcctctttaagtctgtcttctgtctttctgtggacttctttgtacctgtgggggtggtctatggggtctatgtgcactttaatctatggtgcctctggtaggggtttgctatatgtgatcatatgggtgattcagtgtttcatgatgtaattacaagtttctcatggatagctcagtgtcaacagtggaactggggctgggtaatgtcctgagctgggtgtttaggagatggcaccgggccccttttaactctctgccaaatagacttccctgggaattctggcacctgtcctctttgggacaagggtttcttaatggtttctactgtaagggaggccagaagcagggggcgggggaggacaagacatcgcttctggttttttgtgagccaggaacaggtttctctggcaacttgggaagtccccagactaggaaggagcatcctgtctcctcctggtccagctgtccctgaggtaaaagtccattagaggagtcagtcttcctctggtatatgcagtgtgctcactgtgtgcaggaagaccaagtggcttgctgttgccctcgtctgtgacacttttgtacactgatttgccactcatggcactgagcagacatccatccctactcagtgaaaaaccagtcaaaagcaaaagtcctttgaagcagaagttgatgctttggaaaactcttgacttattttggtgtcaacattatgttagatttgaaagcattcttcgtgtatttgatgtaattgtagcgaagagagcaggattgaatggtgttcagttatttcttctgggacatggaaagcctgtcccccatccttcttctgaagccgagtctgctgtgtactgttaccctcgagggagcgcagggctcttctgagagccggtctctgaactgctgcttctgggacatgcttccccacctcctccagtctacctcccctcttggggtgtttttgtaatgtgctttctctgttttgtaaaatccctttgattgtaatgaagtgggttctgcagccaccttttggaaataaatggtccttaaattgtgtacttagcattttgaatcttagcctcaggtgtttctgctgttgaagattcctgaatgaaaagaaaccctccccatgggacttattgttacaatgttttcttcatttactgttattaaaagatttatgagaattcaggagtcctggccttgcttctcagaactctctcaagaaggctttgcagagtagacaaagagatcatttgttggctttgtgtatcataaagtagtcaactcccacccaagacagggcagctgggctctcaacacagcttggtcctgatggacagaacggtggcttggccttgacttcctgcacactgcctacttccaccaaggatcctggggaccatcaggccatttgctcgaatggggagcttttctgtca

SEQ ID NO: 36214 - DNA, 1902 bp, Mus musculus
tatatataggtatatagagatatatatatttgggaaatatataattttttcaaacaggaagtcattagaacaagtggtgagtgaaatgctgcagaatgtatattctacaactatgacataccgctaattattgaaatagtcaagcttatacatttaattgctgtgacaagtgacagactggtagttcagaaaatccttgtctagtttgtaattggctgaattcattgtccttgccatcagggcaaagtacacagcttcagtttttgagagttctttgaagtttggtatttcttcatccacagaatccattgttgacgtatccattttcagttatgatgccttaactaagaagctacttgctagcctgaaagacagtctcagtagccagttccattgaatacagagaaaacataagctgctgagctttagcatgggcttctaagtcccgttgtttctccttggacacactttgtgggtggattagtctttcagtatagaagcaagctgctacctgacattttcttgcccttatagggaaagtgagcacaagctgaatgatattgtctgctaggaaaagagagagcgagcgagagagagagacagagagagagagagacagaaagacagagacagagagagagaagaaaggaaaggggagaaagaaaagaaaaggaaagagaaacggaaaaaagagaagtaaagataacatagaaactgaagagagacagactagaccaatcttgttgtgaaatccatctactccatcatctcatcatttcagagctcctcagcccgggggagcgtacggctagttttttgttgttgttgttgtttttaaagaaaagatctatcacatacatatatgcgtgtatgtctccatatacttacacatgcatacatgcatatgtgtgtgtttatgtatttaacggtgctaatcaatcttgagcaggtcacgtgactggtcatgcggactctaaaatcatatcagattttttaaaaaatccttgatatatgcagatattatacagattttcttaccggtgtaataatgttctactgaagaataaccatcctgcaggcttcaaaggacgaggtcagcaatatttcccaccatggcttggggggaaaggatagttttgtctccttttgtattcaagttgatgcatagtgcatttttgtgtctaagtagctgttgactaaaagactttgtagtgtaaagggtgttatacaaactataatggtgtgcttcaaacaaaccaatgctaggccctttcactcttgttgtatatgacaaagttgttaaatatgtggtttgaaataactttgaacatgtggaaatatgtagcatgtgtctttaactcagacaaagattctaattgcacaagttgtgttctagccagttgtggtttatttgttcagaaacacaaatgtgaattgtactctttatcaccagaatattgtatgagttccgtgatctttaaacagctcagaagtaatacttgaacttcatttgaatagcacaaagtttacagagccccttttaaatgttaattagttccagttaagttttcctttaattttttcttttttttttttttttcttttttcaaatgcaactgggtattttcttggaaaacaatgtgtagtttatttttggtatgtagcaaaaggcttccaattctggaaggttttattgttcttaaacaaggtcagccaggtaccagattctaaaaagaacaattgccccccccctcaagtggccttctgattgcacgaatgtgctactcccctctccaatcccccctcccttgaggaggtcagtgaaagtgatggaggaagtgcaaggcttgctctcccctcccctcccctcccctcccccccacacctcacctaggatgtcca

SEQ ID NO: 36215 - DNA, 1186 bp, Mus musculus
atgcctctgattattacccttatttttcttatactgctgtgaatatagttagagattcttggatattcagctataccttatttttctgcctttctccctccccctctctctttctctctcccccccacagccttatctaaatgtgtgtgatgtttgcttttttgtgatgtttcttttatttagttttctcccgcttgctatttataacagattatgggacatgtaatattagaggacagacacaactataatttttatccctccctccttttcatagtacttagtattgaatgcagagcatccttacccctgtactataatttctgtttgcacagttgcataacatagctgtatgaagactcatccttctatcttatacaccttttgtctcccgtgacccttaacaacctaatttgtacataatattcccacagtttcagccatatacatgcttctgatttttctgtattttacatatatgagactctgcctactgtggcaaggagttacctgtttctggtttttaaaaattattcattttaaacttgtatatatgtacatgtctttctgtctctgtctgtctgtctgtctctctctctctttatgtgtatatatgtatgagtatcccagtgctgttagtagacttttcttggttctccaccttattcattgaggcaaaaactctccactgaacctgtagttccctaattatggctagtttagctggccagcttgctccaaggatcctctacctctgccttccaaagagctggaaattacaggtggcccaccacagacatctacatggtttgggggagggtgtccaagcaccagtccctatacttgctgggctgtccatctggactagtttttgttttcttttggacccagagtcttactctagcctaagctgacctggagttcactctgtaggcaggctcagcttcagattgatggtggtcctcctaccttaggctctcaagataaaatgatggacatgaactgccatgcttggctactttaattttttattgtagtaaaatcctaacaagatctttcctcttagcaaatattaaagagtacttattttctaattatacaggatagtggctccacctaaagcaactcatctttttcataggaattttggtaatactttaaaaattaaacttaccaacatatagca

SEQ ID NO: 36216 - DNA, 1231 bp, Mus musculus
ctagggtcctcacacttgtgagcaagtactttacacactgagccatcttcccagaattctctttttaaaatcttgagaagcttacagaaatagaaaggaaagtcgtttaacatttctttagtcaactcagtgcggtttgcacctgatcatgaattatacagaaacataagtgttgatctaccatacccctaggagtttcccgagaataccagacgtttcaaaaaactacatcagcaagaaagcaattcttctcttgccaggtgtccttatcagagtgacatcatctttaaaccctgtgtggcaatccctgatgcaatgccgtgatgcccagggaagacaggacaacctggaagtccagctacttccttaagatcattcaatttttggatgtttacccaaaatgcttccttgtgggagtggacaatgtgggctccaggcagatgcagcaaatccccatgtccctccgagggaaggctgtggtgctgatgggcaagagcaccatgatgcgcaaggccatcaggggccacctggagaacaacccggctctggagaaactgctgcctcacatccgggggaacgtgggcatcgtgttcaccaaggaggacctcactgagattcgggacatgctgctggccaacaaggtgtgagctgctgcttgagctggtgccattgccccatgtgaggtcatcgtgccagctcagaacactggactggggcctgagaagtcctctttctactaagctttaggcaccaccactaaaatctccagaggcactattgaagctgattaaacactggagacaaggtgggattataacctggaagtgctggacatgacagagcagaccctgcactctcgcttcctagggtgtccgcaatgtatgcagcatctgtctgcacattgggtacccgactgctgccccagtgctacactccatcatcgacggatacaagcaggtcctggctttgtctgtagagactaagtacacatccccacttgccgaaaaggtcaaggccttcctggctgatccatctgcgtttgcgactgccgccaccactactgctcctgctgcctctgcagacccagccaaggctgaagctaaggaagagtctgcggaatcagagaggatgtgtcactttgactaatccccgctaagtagccgagtcagccagcttcgtttgagaaaggtgaaaataaagggttacgtctctttaaaaaaagaatgcaatt

SEQ ID NO: 36217 - DNA, 1184 bp, Mus musculus
gccaaggatgaggaccagctgggggcagctgagccggccaagaaagtagaagacctgatgaagaagctatggggagactggtactttgactgggccaatggcaaattcagcaagtcagccaacagcctagacaggaagaaacttccctgtatgtaccctctgccagcttatcctagactccgtcttcaaggtgttcgaagccatcatgaacttcaggaaggagggagacagccaagctgatcaaaaagctggacagcgaggacaaggacaaggaggctgtggtgcaccactgactgcccgaggggatgccctgccgcagatgatcaccatccacttgctgtcccctgtcactgcacagaaataccattgtgagctgctgtacgaggggccacctgacgatgaggccaccatgggtattaggagctgtgaccccaaaggcccccttatgatgtacatttgcaagatggtgccaacctctgaaaaggtcactttttttggtagagtgttctctggggtggtgtccacgggcctgaaggtccagatcatgggctccaactacacacctgggaagaaagaggacctataacccgaaacctatccagagaaccattctgatgatgggccgctaggtggagccgaatgaggatgtgccctgtggaaacattgtggggctggtcggagtggaccagttccttgtgaagacagggactatcattaccttttaaaaaaaagatttatttatttattatatgtaagtacactgtagctgtcttcagacactccataagagggcatcacatttagttacagatggttgtgagccaccatgtggttgctgggatttgaactctggaccttcggaagagcagttggcgctcttaaccactgagccatctcgccagcccctatcattacctttgagcatgctcacaataaacacgtgatgaagttcagcatctgccctgttgtgcagtgcatcactgagtagtctggagagcacatcattgctggagccagtaagctgcatcttagagatctgcctcaaggacctggaggaggactgtgcctgcatcttcataaagaaatctgacccttcatgtcctactgggagactatcagtgaggagtccaactttctgtgtctgtcaaagtcccccaacaagcacaaccgtctgtacctgaaga

SEQ ID NO: 36218 - DNA, 1232 bp, Mus musculus
aatttcaaaaaagcaaaaactgggcagtggtggtgaatgcctttaattctaacctttgggagccagaagcaggtgtatcttgagttcagggccatccttttctacccagagaaactctgtctttaaaatccaaaacaaaactccaaaacaagaaattgtaaaaaaatgttaagactcaagtattagatgtttttgaataataaatgctaacaatgtaacattttggtgagaaaaatcagcatttttaggatcataatctcaagagacagcatttttgtattaagcagaaaaaaatgggtttactttgtagaagctaatttgaaaaagatcaaagtaattgatagagtaaccatgcttatcctgaagaataaaatagatatgttcatcttttgaacttgtgatccttcaagtcctgggattacaggcacatgccaccattcctggtaatatttgttcctgtaaaatagacaagggctggggaaattgtttagtgagtaaagtacttgtataagtgtgagagcctgagtttgcatcttcagcataaactttaggcatggcagtgtgtatttaaatccttgtgcctatgatgatattggaagatgtagatagaattccctggaagacattggactaagcagcctagtattcacaacagtgaatggtaaaaatacctgttaccaagcaaggtaaaaagtaaggatatagctcactataggatccatggctatattcacatgagtacatggagatatataggtagaatgtgataatcttaacaatgtcttaaatgatagcgaataaatctaaaaatataatagtgtgacttggctgttacttttttatatttttaattttttgtatgtgtggacatgtgatatggaagtcagaagacaactgggaccatttctctccttcagccatgttcctgggatcaaatgtgggtctctaggcttggtaccaggatgtttgctgttgatccatttcactgcccccttttttctggatagaggtagtagggcttgaacctaggaccttgcacatgctaagtatgcactctaccactgagctatatcctctgttcacttagttttcagagttgccatctgggcccccctatcctaggtctctgggactttgtagaggtaattcccacccccagcagctgcatatttccattcattctggccctctgggcctctactgtttcctcccatacctgctcctaccaccct

SEQ ID NO: 36219 - DNA, 2125 bp, Mus musculus
gaaagactccagaggtgacagtttgcttatgaaaacagccttttgccttgaatcctgcatttttttaactatacaataattgtaagcttttggattttttttaaagttacagcttttagttgcttttagttactttttaaaagtacttttaaaaattatttaatgtatatgagttctctgttctcatgcataccagaagagggcattggatcctgttacaggtggttgtgacccaccatgtggttgctgggaattatgggtcctctggaagagcagtcagtgctcttaactgctgaaccatctctccatcccttaaaattgctttctattacatagaaatgtaatctaagatttggtccatagattttatttatttattgattgatttatttattatatgtgtgtacgctgtagctgtcttcagacacttcagaagagggcatcagatttttgttatggatggttgtgagccaccatgtggttgctgggatttgaactcaggacctttggaagagcagacagtgctcttaactgctgagccttctcaccagcctctggaccatagatcttaaaaaaaaaatcccattttactacgttaactgtaacatatactttacatatacatttctgatatatctcttgtgcatatatcctaatatgcaattttataacaattttgcaaacatcaaaagttagttttagttatagttatattattttatgtattttgtgtgttttatagtatactcaagttcttttgaacttgaatatcatttataggcctaaatggtgaaacttagaattaatatatatatattttttttttgttttgttttgttttgttttgttttgttttttttcgagacagggtttctcagtgtagccctggctgtcctggaactcactctgtagaccaggctggcttcaaactcagaaatccgcctgcctctgcctcccaagtgctgggattaaaggcgtgcaccaccactccgacagaattaatatttttgattacaagtatttatacattttagagtatgtcatattgacctgcatgcaatgtgcaatgatttaaatcaagctaatttatcctttcttttacctattatttttatggtgaaatatgtgaaatgtatggtgataattaagtgtatgttatcaactgctcatcctgatgtttactatatctcaaacatgccttttaacaaagataacattttgtgccatttaattgacttcctattctccattaactattctgggtgcaaactctggtaattattgtctctacgatttcaacttttttagactccaaatatgtcatacatttgtgcctactctatttcacttatactaatactcaagattcgaaaacatttgttcaagttgccagaaatgatagggtttctgcgtttaaaagattgaatagtgttgtattgtattacactatattttcttatttattcaaataccgatggtcatttagatttgtgtgtgtctttgtgggtgtgggtgtgatgctggagattgaacccagggcctttgcttgtatctccagccctagattttgtttggcaggagccatttattgtttactattatttgcatttatattatattatttcctatatgtccctttaattttgtttgatagatattttattacgtacatgttatttacattacattttattttctcaaggtttcttttctctttttgatttactcagtagacttttggtgtctagaaatttatttttggttatccatttttggcatggtaatttttcacctgactttctatctttatttgttttttctgacagggtctcaggtaccctaggctggcctttaacttgatttgccactgaagatgaccttaaactacttattcttttgcctttactgcataaaaggcatgtggcactatgtccagtttatgtggtactagagtctgaacccagggcttcatttcatttatgctattcacacagtaccaattgacagctatccccagctctcattgttttattaatttctgttttttctgtgaagaaatttatgactaaagttgtgtctttgggaggatatatacctcctgttttaacataaaagttttaagaga

SEQ ID NO: 36220 - DNA, 1174 bp, Mus musculus
aaaaaaaagaaaaaaaagaaaaaatttatttattttgtgtatgtgagtacactgtagttatacagatggttgtgagcctttatgtggttgttgggaatttaattttagaacctctgcttgctcggtcggccctgtatgctccggtcaactctgctcacccaatccctgttcactctggtccaaagatttatttatttatatatatatatatttttattgactgtctgggtgaactgttatacccagatgattaattgtggtcaataatacaaaaaaaatgaaattctgggctggtgaaatggctcaactgttaagagtactgactgcccttctgaaggtcctgagttcaaatcccagcaaccacatggtggctcacaaccacctgtaacaagatctgatgccctcttctggtgtgtctgacgacagctacagtgtactttcatataataataaataaatatttttaaaatttcaaaaaactggcccaagaggtttaggacagtgatagaacatatgtctagtatgatcaaggtccttgttttgatgttgagtcggaggtgaactacaaaaaaaccaacccccaaaaccttaaaaccaaatccaaatggctgaaaaacatattaaaaggttcttagtgttatgccccccacccccaactgcaaatcaaaacagtggaatagcacattcgaattactagaattgcttaaatcaaaaggtagaatataatttgattctccctctaatgataatagcataaccgccgggcatggtggcacacgcctttaatcccagcactcgggaggcagaggcaggcagatttctgagttctaggccagcctggtgtacagagtgagttccaggacagccagggctatacagagaaaccctgtcttgaaaaaacaaaataataaagaaaaaaaagcataatttggcagcatttgggacacagaggcaagtagatggatctctgagttcgaggccagcctggttcacaaaaggagtttcaggacagtcagacttacatagagaacccctgtcaaaaaacaagagtataatttagtaatatttagtgaaaccattaggagattttcagatttttatcattctaaaaagattgtgttagattgttgccaatgactgcaccacagccccctgtaactactaatctgctttc

SEQ ID NO: 36221 - DNA, 1099 bp, Mus musculus
tggcattgaaatgcaaagctatgttccccagcagcctaactctagtattttgtgcttagagataacagtggagcttttgttaaactatgaattctgatgctgtacctttgtgctgaggcttcagatttctgcattttaaacaaacttgtaaattaagggtgtagcttccctgaccatattttgactaacaaaagatgtgtaaaacaccctgttaaaagcctgctcttccatcccctcaggtaaagtttatgctttgtttataccagcctgtcttttttttttttggaaaactagtagggcccaaggacacctatgggtgtgttagataaattcattatcttcaatgtcacttactacagtaaggtagtttcagggtcaaaatttgccctattttaagttactcccattaatgcatgatagttcataagttatctcagctgacaaaatgagccagttcaagtcaaattattggtggcagctctagagctagttctcagacctcacaggagggggttagtgaagtggagattgaaagtgggtagagagggagagtttgagcaagccagtgccagagggggaggggaggggaagggaagagaaaaggattgcactgtgtagacagagatggggggtggtgcagaaagaggaaaagagacttgctcagagagttgtggagaaatgggaagtgagacaaaagttctagattatatagtgaagagcaactgggtgagagggaaactcagccactgggttgttaagttcagcatggagggcagggtatgccagccatcctctgtaacaggttaaggtctgagggatgcagggagaacctgcaggccaggttctctttggtatgttaaaaacatttgtcttgggtctgaaatccaagagaagtatattatcatctcaaatgaaaggaaaaatctcttgtgagatggtgataagtgtagaatataattggattgccataatgctatgatttggctaagtcaagtttgttttgtttttgaagtatgtggagggatcttttgagaaatatctggaacggttgggagatcccaaggtaagttcaaatatcatcttcatagttgtttgaaat

SEQ ID NO: 36222 - DNA, 1171 bp, Mus musculus
taggagggagttgaccacatatcaacttaaattatagattttaaatatttttgaagaagcaggaagacatctcaaaagcaactagaggtcttcactataatttttcagagaaaaaaaaaacgttgtcagtaattagagggttgaaatactgagtattgaaatacccatcaacatagaaatgaacttttcttttgcccttccaactggaagctcaaggatatccttgaaaactagataaatttctacctcatactcacatactttgatctgttcctaaggaaagtgacagttttaaggcatgttgagggcaaaggtacaggaccctttacatgggttatgaagcttatttactatgtattttctgaaagttatgacagatatgaacatgaagcaacgaaagaagatgttcaagaaatttcgagggaaagagatttatatgaccatggcttatagcaggggagatccccttgttccatccaggattcagcacagcatgcattatggtcatgaccctctactatactactcacagacagctggccatattctgtctagtcaacatttttaccctcaacattcatctcaaagacaaggtcggggatatgggatgcccaggtaagagtgaactgattttcattataatgtatgtcttgtctttgtgtctttgttttttgtttttgttttctgagacagggtttctctgtatagccctggccgtcctggaactcactctgtagaccaggctgggcttgaactcggaaatccacctgcctctgcctcccaagtgttgggattaaaggcgtgcgccaccactgcccggcttttctttaggtttttagaaacaattcctgaactgagttatagtagaattgataactacaacttttatagtagagaacgtagtgctgatgcactcttaccctttctgtccactggcatatttggattttcattgtctagagacatgtgaagaatggaagagatgctcaaagatagaatgccatctgaaatgaatattaatataaaatatctttgtatccattaatactgtataggcccaatactagtcaaagtctttcttgttgaatgttttcaaaaaactttgttaattctacttaactattaagattggcaagaattgaataattgttttttttttctttcttttggt

SEQ ID NO: 36223 - DNA, 1173 bp, Mus musculus
aactcaaagatctgatgcttttctggcctttgagggcactaggtatgcctgtagtgcacagacacaaatgtaggcagatatttctggttttgggtacttgatcttattttcttggtactttccattaaactagggtcttgtgcatgctagtccagcacttagtactaagctacccctagctgtcttttcacatttattcttcagtggagtctcactatattgcctaggctggccctgagcttactctgtagcccaggcaggctttgaatttgagatctttctgccttgcctatttaggtagctgatattaccatattgttctgccagatccaaaaacctagtatgatttgttttgtgtattaacttaaataagggaagcaacttcgttggaaaagctatgtttacagaaacatccaacattagtagatactctgataatcaaaatatttttctaaaactataaaagtagacatttctaaatatatagcacaactccaagggagttatgtaagtttttaaaattggttatgtagtttaatatgacctttaataagtttcacttttctttttttttttttttttggttccttttttgttgttgttttgagacagggtttctctgtgtagccctggctgtcctggaactcattttgtagaccaggctggcctcaaactcagaaatccgcctgcctctgcctcccgagtgctgggattaaaggtgtgcaccaccactgcctggctttttgtttgtttgttttttcgagacagggtttctctgtgtagctctggctgtcctggaactcactctgtagaccaggctgacctcgaactcagaaattcgcctgcctctgcccaggattaaaggcgtgcgccaccatgccaggcaagtttcactttctgttgtccagttctgtgaacttttcgcagtgtgtgttatctaagcaacactacaatcaaaataggattgtttcttcatctgtcccatcccccaaaaggaaaacctgtttatgaatttgtttttgctttggtgtcatctgtagatatatctcctatgactattagcatgtaattgtatataaggtatatatgaatgtattattagcattgctagtgaatgaaggcaaagtacattcattcttgataaatttccagagcaacaaactcagcctgtgg

SEQ ID NO: 36224 - DNA, 1110 bp, Mus musculus
tgtgttactataaaagagttaaaaagaaaggggactgggttctaaacagcacaacttcatatatattaggttagacttcatatttatataaacagcctttcagtattacatactcagaatgaatggatttattgtttacttaattgcttagagaaatttctgtattttaaatgaaattaatcagacctagttcaaggatatttaaataactttttaaagcaccaactttggattcttgccaaattgttctctgagtttgagagatgtttgaggtattagtatacatcttctgataccatttgagagatgtaggtattagcatacatcttctgatactgttgataggtgttttgctttatggaactgagatcattcttcccttcaatatataatatagcctttaaccagatagcatatttcctgaaaaggaatgatgcagatgaatattttccaagagactactggtctcttgggaatggcttaagtagttggtagtaccttgcaataatttccctgaaccttagacctgagcagaaaactttcttctccatataagacacatttaaattaagagtagtgaggtagatatttattctttgatattatatctctttaagtgtgttctaagagtatttacttgtcctttcagttattattctcggttggaaacttagttatataatccacgagtataaaatccacaagaacaccaactgctagtattcacaggaatagtaggagattaatagatggcttaatgcttttttactttgttatataaaaactaatagtgtgcattatagtatatttatatagtataaaatatggatcatattatgaaatttataaccatttatctcaacatgagtagcttttttgtctttattttttttaatttatgtatatgagtactctgtacatctgcatgccagtaaaggacattggatcctgttatagatggttgtgactttaaatatttgataaaaagcttgtagtattttgccatggagacataacaatgttcacagctctatatttttgaatacataagtttctagtagtttttactttaaaaatgatgctatttgtaaaaattaatattacaattga

SEQ ID NO: 36225 - DNA, 1558 bp, Mus musculus
accattgagcagccttgctggcatgccctgatgtcttttttataattagtgatacatttactttttcttgtaagaatattcattgacatttagtgaaattttataatagagtatatatactatatctgttcttcatttcagatacttttcccattgctgatgctgtacctctccctcatggagcagtctactatccagtaatgacagatccctatgggtctcctttgttgggatttgattcctatgttcctgttgcatcagattattccagtattgctatgtggcatccagttaatgcagcatgtggtgcttctgcgcagatccatggtgctatgaatcccgggccaattggctatatgcttctacctaactcacctcattatacacctcagaattaagatttagcaatatgaaatacttttttgctgccatctttgctgttatggttcctaaatgttttacattagttcttaagtggtttagttgggaagaatgttaactgtctttaaaattattttacttttgaagtaaaatatttctttaaaacaaagacatattactttttgttatgaataagaaaattgcaatgaatgtacaactcgtccctctaatgggcaagttcattggagccagcttcctggtagccagcatgttaaaactgtattaactgatggtgccaactgagaaaagaaaggaacaaatacaagctattttcctatactatacatcttaattatttaaaaagttagtatgatttccatttttcaagacatttaaagagacaaaaaaatccaaacaggagcctgtgctcctgggtatttgtttatattacatgagagttcttcagatttcttttaagagtcgtcagaactgaattgtagcctgatattaaccagttttgaaggcacatggtgttctgctttgcatttgctaccatatggtattgtttaatactggatttacataactgtcctaccgcacagtattatagtatcttttgcacaatttgcagtaaataaaagctagcatgtaaaattgccaaaatgagtggagttttctttttgcaacaaagcaaataccagatgtttgattgcttcaacatgttttccctgacagtggttacaaaagaatgaatttctaccttgaattggtgatgagtagttgtaaggccacttgacatgctatttgatttcaccccattgcggttcgtacctagtacgtcttgttcttttctcctgagaatattcctattcacgttgtgttttagtgtttttaatttttttttaattaaaaaagttacttcggttagcctggttaagtattgagtttctttatggcactttcaaacactttcaaattaacattttgttagtcctcataatttgcttctttgttttctgtcctctcctacctctggccccgtgtacactcccacctcaagagtgtgtctttcctcatggcacatacattcttttgtctttcttcccttcctaacactgctgctatttttaaagcacagccaaggtttattgaaggtattttaaaacagattttaaac

SEQ ID NO: 36226 - DNA, 1160 bp, Mus musculus
aaagcaaagcaaaggggttaaagcacccgaccgcacctctgctcattaggggcaggaccccttcagttgcttttgagatggatttagtatttatagatataaaaaggcaaatgataatgacagtgaaacaaaacatgaagaatgtggctagaaaagactgaaagtaataggagtttcactccttggtgtgtgtgtgtgtgtgtgtgtgtgtgtgtgtgtgtgtgtgtgtgtgtgttggggacagggagggaaccaaatttggggtcacctctgagaacagggaaattacaaatattctcttgaattccagaatagatgacggggatttgacttagagccgagttgtaacttgttcttcctgtccatcaccccatttgtgcatgagcaagtcacaagcctctccccaagtttcaaatacgtcctctgacgagtccaaaagtttcgaatttgaggagcagatgccggatgcacagtgaagggagctggaacaggctagggggcactcactgctccgagcagcagccccccggatttcacctagctctacctcgccaaggttcatctgactttgagaacaggcctctgccttccctttctccatctgagaatagcggatgtcctgccacatacaatgctgctgtgcgatgccatcagagattgtgtacattggctccgaagtaggttcagatgtttgaccattgaacttggagaagaagagacccaatttcttgaaagacggacccatgaaggaccgtttgctcgacgactcggattttggctttccttgggcgccactagctcttggcacggttctgatgagcggtgcaccgtgacaggcctttttcttgcagcctacattgaaagagacactcttagacttggcccgagccccaccactgccgtcattggtatcatccctttgagagaaatcagcactgctggtggagaggcttcttcttggatgtttcctgtttcccaagaggtcaagcacttcatatcgaaagctggaaatgtcctgctttaattcctagagagagagagagagagagacagagagagagaaggggggaggagacatgttttatcagaaaaaaagttgtctttagtttaaagaagacactcaagagttttgcatcggctaagtcgtacctagtaataaa

SEQ ID NO: 36227 - DNA, 1187 bp, Mus musculus
accttagttgatgaatttttaaccttgacagttgacagcattacaagtttaaaaacttttaacaaccaaaacaatcattcacacttctctcctggttattgtgctctacaattgcttctattacttaatcttgtattattttccaagtagttttgtgctttgttattattgaaatagttgtgtttttttttagacaattcttttactacatctcacttgtcagttaaatattaccttaaagagaaaacataccagaactttggtgttccttctttatagcaaatacaaattgttttcacgatgggtccccttgaggtccttgacacagcagttcaactattattgtgccaaaaggcagtaacaacatcacttctaaggcagtttttcagcacagtccacaatgacaaacatataccaaaaccctaacatatttctcttagtagtttttaagtgtaaattttatgcaatattgtttttatgacatatatttacttcatcaattattgttttaggaatcattatcattatttgggtggttttgtgatttgaggaggattgaataaacaatattttattgggcccaaaatatcattagatagctacttctgttaaactttatgaccatatggcacaagaaagaagtgatgttggatatgattgaactgaaatgagtaaaaatgcgtaaccatttgtttaataattatctttatagaatgctagattaatgacttttctaactgaattttttggagaattcagaaatgtttgtattagtcacagatttatcataattgattttctgatgcatttaaaaataaatggaacactaaatgtatattaccgatgcaaactgtggataaaattgaatgaaaaaaatctaagcctggaactcattttttttttctattatgtttctcactatcgctattaccccctgatagtttgagtccatggttcccactgtgaaagaatagttaaatcttgagtgctggcaatgttgctcagtgagtaaaggtgtttgctgtggagcctggcaaccattcccaagacccacatggtggcagaagagaaccgattcttgcaaaaggtcctttgatttatggatactcgtagttcagctccacaagtgtgctgtggcacactattgccacacacaaaatacatgagctataaaaaaagagaaaaca

SEQ ID NO: 36228 - DNA, 1269 bp, Mus musculus
agtggtccaagcaatttttggaggaaaattggattaatttcataagagtttttgataaattaaaattctccttttattttgtgactcagtaaccttgaagaattttcaaaatgcaaattgatacaaaattgaagatatactttcaatttagcaatcacattaagttgaatattttttacatcactgtatactagtgaacatctaggtaaagtaatcatattttaggaaaacaatgctatatttgagttatttcatatacttctagcttataaacaatctcttcaatattttgtctttgtttcttagcaaaaaaatgagtagaaaaatcaaaaccctggcattattcaattctttagtattatcagttggtgccaaaatatttttcagttatactgtaggttgtttacatgtgaagtgcctgtgtaattgatgaatcttaaatagtcttaagcatttttgcaatttctttttatgtattaatagaatcaatggaatttttaaatattttggtaggttttgtatggtcagtagtaatgtgaggttttaaatgtccctcacattggtggtttcttagttaatccattgcagtttcccttgaattggttatttcatgttgtcaaaaaatgttaatatgcttaatttatgctatttaattttgcaaaaccgtaatcgtcgtttaaatcactttatctgaagagtattttatttctgtgttgagaacattacacaaagcagtaataaggctttggaaagctagggaagtactaattgtcaaggacatttggatgcaactgctacgtttgggttcttatctaaacttatttgaactttcagtacatcagtgctgccttccacattcagaaagcggccactaaaaaaacaggttttgattcaaaatctggccctttctggagcatgtataaaatatgatcctcaagtaacttgatgttgaatttaacacagtctggctcatggaatagtatgtttaattaagtccttccttgtttggagatggataaacttacggtgatactaatgcaggaatttttccaaaacattactgtgacgactaactcaatttcctataaaagagcctacatattcacttttgtatagccaagcaagtatcatttcttaactgtgtaattatttgcacttattacctcttaatatggatgcaacttagtaaaaacgttggtctaggatatttcaaagggcatttatgaagtgtaaaatgtcatgtgccaaatactatggtaaggattggtt

SEQ ID NO: 36229 - DNA, 1177 bp, Mus musculus
cggggcagcagatccaggatttacaatgagaagaaagatggagcatttacgggaagagcgtgaacagataaggcagcttcgcaatgtaagtcacattgacctcgtgcatctcctttacaggaacgggtttaattcagcaaattcataaagtatattgaatttttattcttaatgctttttcaatttttgatcacatgatcaataatgtgaatgcacaccgtgttcacataagatacctgcaatttatccttatttctttatagaatcttgaatccagattaaaagtcattttacctgatgacataggagccgcactgatggatggagttgttctttgccatttggccaatcacataaggccacgctctgtagctagcattcatgtaccgtcaccagcagtggtaagtagtgtcaatagattactgctattcctttaaaactctttaaataatgcccacaatacattttccaatatcaactaagttcttttagaagagtacttatcatgtgtgtctctcttctcctacctcacagcccaagctgagcatggcaaaatgtcgaagaaatgtagaaaattttcttgacgcttgcaaaaagttgggtgtttcacaggtaattatctgacaaacttgccatttaactattaatctgttacaaggaaagtaaaatcatcttcatagtggggggtggataacattttgtgaacacaaatttgagtatcttctttttgtctctttcatgcacatatatgtaattacagtgttttaaaatcttttaaagatggcctttattaagcatctacctatatgtaaaatggttgctaatcgtagctacaactgagtaaacagaatttagttgtgacaactgaagcttaattgtgacaccattgctgttgttatttaattggtgttgctggtgttctgctgagggacatttagaccccttgttgctctttagtgttatgctgcggaacccaatgcctcatacctgcaaagcacacattctactactgaattatactcaagttcttatttgtaacttcatgaataaattttaaattccatctaatatagttatatattagtataactatattaaaaacaatgaaactgtcaaattatgaattttggtacagggcaagagagatagctcagtgctcaagagcactggttgctct

SEQ ID NO: 36230 - DNA, 1127 bp, Mus musculus
acagttgtttagtgttggaattttggagagttatgtgtttctgcactaactactcctccttgcaactagaagcttcactaatcagtgtggagagcagtgcagacctctgcatgtaaacataaaaatttacaaggcagtttaacagcacaataacttagcaaaatgacactaaatactccccctgccccagcaccatgcaggaactatgggctcgctagcagtagtgattgaccatgtttatagtgccagatatatacttactcatgtggcacaattctctagatccagtcaggagagcagttggttagccataggagcagaattgccagtgttacaccgtggactcatcatgtccgccagggcagtattatacgatacagggtccatccatgggtaagtcatgacattttactatgaatattagctagctgggagagtcatggtgagctcaagactgatttccctatgtccactaacaaaactgtagagagtctcagctataggatccagaccattgacaatagccaatatccttatggccgcatatggggctgcctcgaccattgggagctaaattgtttctgggactgacacttttgtttattgacttgtggcttcaggaataactttgtccacacatgtatagtatacctctttatatgtctttttgaaatagcatgaatgacctcatttctcaatgagtacatatttataaagcttcacgcatccttagttttatttaacatggccacattcaacctcctttacccattcctgcctcaggttttttgtttgtttggttttgagtttttccagacagggtttttctgtgtggcattgactttcctggaactctctctgtagatcaggctgcctctgcctcccaagaaaggcaggtgccaccaccacccaaccccacttaaactttgaaaccccacaattcccctcacatgctttctctgcacctgtgttcccttgcctcctcatactacattctttccttggaatggaaggtcatggggtgtcacgtagcttctttctacacctcatttttgttaacccttaccacttggctaccttccccctaatgccacaaactgattaaacctttaggacaccagaatttc

SEQ ID NO: 36231 - DNA, 1139 bp, Mus musculus
cagagatctgcctacctctgcctcctgagtgatgggattaaatgcatatgccaccccagtctaccatctatattttcttaaaattcaaatttcccaagtctatcatatcttgtcctataacatgattaacagttcttttattgtttctgacaaagaaaaaataatgctatgacaaacattgttaggacatcagtgtcctcattttaaacagtgtgccttctgtggctttctgccaattggacagataactccaaaactcctttgacgtaaaaccttgcaccattgtgtactgagattactgttaaccttcaaaatgttactgtgttgagatttgaatttgttgtctttgttttaaaaaatattttttaagttatttatgacttagtaccttttcatacatttaagccctgtacattgttatctactttgtgaaaatgaatttttaagactttatgtgtgatattaattttaaaaggaatatattacggctgtaagtggctttgttcttgcacagtacaattaaatctgtgggctgagcatccagttatgccaaaaaggggcaggggacaaacaacaaacaatgaataaatgaacagtaaaacaacccaaacatttctctaggacccttctgtcagccatgcacttcagatatttccatgtgcaaatttataatctgaaaaagatcaaagttgcatacttgactccctgccctatgtaaactgccaccatggttcagttcggttattggcctatctcagggttctccttggtgtctctcagttgaagaaacaggttaatatgaatccccctctccccatatttcacgtcacacttccttgagatggatatttctgaacaatcttaccacactaagactttagggaatagaacacatagtctccttcttgggactcgctggtcatgttataacacaggtcccactcctgaccatgtgttctggtgttttattacatcaggaagcttgtgagctttgattcttagaagcatatatactcagtctttgccacataagaccaccagctctggaagtacaccgttagggagggcaaaattttccttacatcttcaaaatggcagacagagaattctgctacaacattctataatctatgatgcca

SEQ ID NO: 36232 - DNA, 1190 bp, Mus musculus
gaataagtccccctgttaaagaagaggaagcaaaaagagacaatacaaaaaaaaaaaatcaagtaactcaacagaagcagtagttattgcaactgcaaattaatctagtaatggtgaaacaatgtagatgagtcaagattactatgacatggaattcctgatccatcaagattactatgacatggaattcctgatccatgcagacacaagatcatttattatgaagaagccaaagctgtctgagaaaatagtagtgacaccaaaccaggatttggggatgaagactgcatatgccctttgggtcttttcaagacaccttatgcagacaagagacctcgtacaaccagataaacctgcaagtcccaagtttagagtgatactgtatggtgtccccagctccccccaggatacgcgtgagatcaagagaaggggatgggctttgaaggaatgaaacccataaaccaaacttcaaactcaaacaaggagctccgaggtctcctccacccacagcagctgcatttgctgagcaggcagcttgaggacccagatggcagcttttcaaatgctgagatgactgactggagtgtggcacagaaaccagaaagacttctggagcgctgcaagtactggcctgcttgtaaaaatgtagatgagtgtgtagctcatcatccaatctcaacttgcaaagcctttcccaactaaatctgctgagaaatgtttgtttgtgcatccaaattataaatatgacacagtgtactaaagcagattgtcccttctgtcacataagtagaagagccccggtactgactccaaaaccactggtggcatcgccagcatcgttttcttttctaatggccagctctgtcaaaacttccctgcttgtaagaaaacggaatgtcccttctaggacctgtgatggtttgtatatgcttagcccagagaatggcactattagaaggttgtcactgtggttgtgggccttaataacctcatcctagctgcctagaagtcagttttccattagcagcctttagatgaagatgtagaactctcagctccttctgcacgatgcctgcctggatgctgccatgctcccaccttgatgataatggactgaatctctgaacctgtaagccagcccaattaaatgttgtccttataagagttaccttggtcatgtgtctgttcac

SEQ ID NO: 36233 - DNA, 1190 bp, Mus musculus
aagtgaggcgacgatagtggcaaggcagtatgtcccctgagcaaacaccttgcttatatgtaaaaaactggagaggacagatgcataaatgaaaggcaggaaaacgcccacagccgcaatgcggaactatgtgtcattagtgtaccagccaatccaaagacgatctagctgagtctcaacttgtgtcccggacttcctgctgctattgctatggctccgagggcgggactaaggaaggccgcgtagccgaaagcaggctcccttggcgcccttaggtcctgtaaccctctgttctgaaggttccctgggctttcttagcacctataagtgcattctatagtccctctctttttatccggtctggctccccgattccttgctgtcggcggtgctgacgcgcagacgtgcacgtcatatctagctttctctgaccagtagatggcaatagtgttctttgctgctgctatgttctggttctcccccgccctttgtgcttgaaaaaaatagaaagacttttacttttttcccctccttttgtaatgcattccgttcctctgtctttgcttgggtaagggctgcttgcctaagacaattgggttttgtccttctgaactcttttcctgcctcaaaaccaccacctgaacttttcaactttattattattttttaccctctaaactgagtggcctaggcacctcacctcctctgcttttggctcctctaaaaggctttatttcttcaacttgtcctttaatctagggacagttatttgatctaggacaagttatttcaatataggcttcatttaaccttttgacatttctggaagtttattacaattcttacacacagtcccattattccatggtcaacattaattgtattttcgttataattgtctcactttttttatttataccagtacatttaaaatacataaacatcagtatttgcaccattgctgtatcatatttatgcaatcattacactgaatcccatttacatgtataactgctatgtgtaacattacattttcccttttatattttatatttccttgtcttagtaatcactttgaaagagtgaacctttttcttctaatgtggcaaaaatttttaataactgataatttttcaaaaaatacaaataaatcttaactccctattttagtggtaggtaccataaagtat

SEQ ID NO: 36234 - DNA, 1116 bp, Mus musculus
gccaagttaaaaaaaaaatagaaagtctttattagccagcaggcaactacactgggtatttgggatcccagtgtagccctgagcctttctcagggtgaacttagaagcacaaaagtcataggttaatatatttcagttaacaaaaacagttagctggaggtggaactatagaagccaaaggtaaagtaagtacatttagagactttcccagaactatggactttgatggattaggcctttgttttcattttgtcagtgctgtatttgtgctaagtttacagtctgaatagtacttccatcatagtcagttgtgctaaggtcttcaggcctactcaagtctggggccctgttacattccccactggtcttactgattaagttaaattgtggactcatcctgctttaaatatatgtagttgttcctaagaaccagtaattttattgaatatattataattaagattcaaggccaaatgttaatctattcaaaatgagaattaaaggcccagtcagtgctgccagcagactagttagccagggggaccaagagaacagcaaggtaccaattatctcatgtataattttttctctctttcttttgtaggttcttccatctacagcaagatttctactaattactcctgattgattaggatagaaacaacgtgtttcttgcaaaggcccctttctgagaagtaagtctaagcctctccaatttgtagggacatttctgaaagggaatctaactgttgttttaattcctgtaggtcctgatcaacctgtcttcttagtgtcagaagaggcaaatttaggcaaaccatggtccaccaaatggttgcctcaagactaggtaatattgctgctattcagatgagttaactcataaggcagaatagctgacatcagaataaggggaagtatttaggtaaaagattttggatattagacaagttttagtcccttataaactgtaatttaggctgtttccagtcgtgctgagttttgtcagtcaatgggctgacagtctggttagttcctatccctatgtagtacaggggctgaatgttcaggcataaccagtaatcctagctggtttctagctgggaatagttaact

SEQ ID NO: 36235 - DNA, 1239 bp, Mus musculus
aaatcatgattttatatttacctaaaattatgaattatgtagtgtgtgtgtgtgtgtgtgtgtgtgtgtgtgtgtgtgtatgtatgtgtattaaacgaagttaagccacttcgactgacatgttttccactagaaccataggctaacaaaacttcagtaccaggcacaagaaacctcctttcaagtggttggccagggtagttctagtgacttcccaaaacaatacagattatagatatatcctttggttgcctctcaccagttaggaaggtgggctcctgttgctgaagatacaatactacacactcagaacacatggtttggataacgtgagctggatgtgagcttaaagattctttcctgtggtctagctttcactgtttcagaaaatactattcaggctgccaagagagggcaactattaaacacccctaccaatctgcaactcctatgaaccacgacagttaccagcatggaaggatagtagaaagatgcaataaataagtggctctcatatcattgatggcaaccaatagctgtctaattggtcttaaggcccactcaacagtagagaaatcatatctggtataggaaaccgaggcagcttctccaggataatgagggcccggactttagaaaagaatctactaccaccagtttgctagataagcataattccttttacattctaaatctgatccttctacccacagataactgtagctacccctcatcaaagaagcctccctttccaaccaatgggagccgtcaaagaaaaccacaactggctataatgtagcgatcaacaaatcatggggaacccagccccaacagatataccctcagcacagctgctgcttttatatagctcagggaacattgcagaagaggggctgtaaagattctaagagccacaatagtaggaagcctgctgtcagcaaccagtcctagaaatggctgtgtaacaggagcaatggcattattggtggcatatgttaacacggaaggaggaaattttgcagggtctcacccctaggcagagaactataggcagatatgttgggagaaggagaattagcctctcagggatgtgccctcttactagttgccctagtgctgcatggtcagccttgaaaccatatacacataaacaacaactgactcagaagggtgtgtgtgtgtgtgtgtgtgtgtgtgtgtgtgtgtgtgtaacaaatataatcgaactgagagtgggga

SEQ ID NO: 36236 - DNA, 1171 bp, Mus musculus
tgtgggagctgtcttaaatgtatcctgtgtgccagcaaaacagtgcccagctctgtgtacccgcttcctccccgagtttgcaggtacccagctcaagattcttcgcttcctagttcctcttgagcaagaacctgtgcgggaacagcaagtcctgcagcccagccatcaaatccaggcacagagacagccaagaaaagccttcatgcattcaaccaggcttcggaaaagtcaaggtggccccaaaagaaaacagaaaaacctgatgagttacttccagccttcctccagcctttcccaaacttctggtgtggagctgcctaccctgcctctggtgggccctcttacaaccccaaagactgcagaagaggtggcaacagccacaatgctagaagagaagaacaaggttccagagtccaaagatgagaagggagaaaggactgccttctggaagtctatgctgagtgggccctcacccatgcccctctgtggaggccacagggagccatgtgtgatgcgtactgtgaaaaaaacaggacccaactttggtcgccagttctacatgtgtgctagaccccgaggtcctcccagtgacccctcttcccgctgtaacttcttcctctggagcaggcccagctgaacagactgaggcatagggatgtcttcgtgttcaccccgtgcacggggtcagatgccaggtccctgcctatgaaggcttctttttgttctctgctttccctccactccttcccttctccccctagtgcctctcccctttcacatctctgtttcttcctctttgcacatggaggagcagggaactaatttaatccccttcaacccttgttagggcataaataacattttgttcataaataaaggtcacgtctttgtttcagtagaccatgttgagtggatattttagatgcactctaaaaagttgagtgtgaggctctctcatttcgaggcttgcttggcctcatgtaacccagtgagatactatcaaggcgacatggtggagggaggagttgtgctccccaggaaaggtgagctctggggatcatttgctactctgaggttggatcagtgaagaaggtgggtgtagtgtgagggtgtgtattcttaaaagagttttctaagtagtgtgttctacagctgttacacatgaatcacc

SEQ ID NO: 36237 - DNA, 1201 bp, Mus musculus
aagtatatgggactcctctttcttaatgtccagttgacagtcccacattgtgtttttcagtcacgtgataatcctgggggacctgaatacagcccaccgacccattgaccactgcgatgcaagtagtctggtaaggttccctctaaaccataggccccagttttgttccgttcacccagccagccaaaactgggagtttggcaccagaggtagtctcttttatggaaaaaaataatgattactttgagtatatattttttttttcattctgaaattacatgtgataattgtacatatttatgaagtaccacataaaattctgacatgatagtcaaatggggtaaattgctgtattcatattcatttcctcaaacatttgtctttcggtatgggcattcaaatttttttctacaacctggtttgaagtatatagtaaattatcaccagttattactatactgtggagtacaaggcctttttttctcctatcaaactattcacactagccagccactgtatccctttccttctgtctctcctggactcttgtgacaactatactctgttccatgtgattaccttttgagactgcaatacaggaatgaggtcacatggcatcgatctttatgggcttgccttgatttttttttttttttttttttttttttttttttttggttttccgagactggctgtcctggaagtcactctagaccaggctggcctcaaactcagaaatccacctgcctctgcctcccaagtgctgggattaaaggtgtgcgccaccactgcccagctcttgccttgtttttaagtcttccagttccattcattgtgctgcagatgacaagaaaaatctgttctttctggctaaatggtattgtactctgtatgcatgttatattttccttatttattcattaatgaatatatagtttgcttgtgtatctgggctgttgtaaatgatactgcagtgaatgggagttcaattgtttctttgacaaactaatttcattttctttgcataagacccagggtcctgggttgtttgaaaagtcctttgagactttaacatgcacacaagcttgagaaatactgcccccagaatagatacaaaattcttcaacttgaccattctcatagaaaggagtgctttgctagaaaaacaagctgcctgctttttctctgctcccatgtgagc

SEQ ID NO: 36238 - DNA, 1148 bp, Mus musculus
caaatgccattgaggcatctagcagacagattggggcatctggcagacagactgaggcatctaacagacagattgaggcatctagcagacagactgaggcatctaacagacagactgaggcatctagcagacagactgaagcatctagcagacagactgaaacatctaacagacagattggggcatctaacagacagatcatggcatctaacagacagattggggcatctaacagacagattgaggcatctaacagacagattggggcatctaacagacagacagaggtatctagcagacagattgaggcatctaacagacagattggggcatctaacagacaaactgaggcatctaacagacagattggggcatctaacagacagactgaggcatctaacagacagattggggcatctaacagacagactgatgcatctaacagacagactgatgcatctaacagacagactgaggcatctagcagacagacagaggcatctagcagacagacagaggcatctagcagacagactgaggcatctagcagacaaattgaggcatcagctgcagctgtgaggcccaaaaagcccagggggaagaagggtaacaataaaggctcaaattctgcttctgagccctctgaggctccacctgccattcaaacggttacaaaccatgccctatctgtcactgtacggatcaggagagggtctagggctcgaaaggctgccaataagaatcgggcaactgaaagccaagctcagatcgctgaacaaggagctcaggcctctgaggccagcataagtgccctggagactcaggttgctgctgctgtccaggccttggcagatgactatctggctcagttgagtttagaacccacgaccagaacccggggcaagaggaaccgaaaggtgagatctatgagtttatccttaactttgtgctactttcccattcctatcctaggttcatatcctgtgttcatagaagctataggatatgttgaaaagaatgtgatccatttttgtgtcctccagtagtttgtagattggtggggaaatatatttgtgtatttaatcaagacctatttgggactcacttgtatttacatagtatttaaccatgtgccagactttcggtca

SEQ ID NO: 36239 - DNA, 1331 bp, Mus musculus
ggatatattatagccctgtagtaatgaaaatatggcactggcaccaaacagacatgtttgccaataggacaaaacagaagacccaaacatgggtacttataactgcagccatctgctatttcatagaggcaaaaaacacaccctggagaaaagacagagcatctttaacaagtggtggatacagttgaaaactgtatggccacatgaaaaggaatggattagattcatacctgtcaccctgcacaaaaattagatccaaagtgtaccagtgacttcaaatttgaaacctgcaacatcaaagctgctagaagcaaaggtatgcagttccctataagtgatagatgacggaaaggactttctcaacaggatcacgtttgttcaggaattaaggtcaccaattgacaacagggacctcataaaactgaaaagcttctgtgcagctaaggaaataatcaagtgaggaggaagcccacagaatgggagagagtctttgccagctacacatctgtcagcggactaatatctacaatatatgacgaactcaaagaacaaagagtcaaggaaacaaacaacccaattaaatagtgggctgggcatgtagacagtttcaacagaaaatagaaagggctaagaaatacctcagaaaaaacattcaacttccttagcagttagggtaatgtaaattaaaccaatgctgacaattcttaacaagaccactggcaacaattgctgctgtagatatgtcactgggaatgcaaactgctgcagccactctggatgtcagtttggagactcctctgaaagctagaaataaatctatcaaataacccagccctacccctttggcatatgcccaaggggcatcctactccatagatactttctctgccgtgttcactattgctttatagctaggaaatggaaacaaattaaatgtttgacaactgacaaatgaataatgaagatatgattccagaagatctaagaattcagtagctgttcagtacagaaggtggatatgtcagctggtcttcagtatatgtcagagtcctgaaaaaagcaggctctaatgccagtgaagggatggacttgctaacaaggtgagagcaagcaggcaaagagagaacaagctgccttcttctatgtccttcatatagactgccaccacagaaggtgtggcccagattaaaggtggatctttccagcctcaaaagatctgaattaaaggtgattttttttctcatttcaaattatttaattaagaaaaaattccctcacggggatagccacttgagtttaattaaccccagaagtagtcaaattgacagtca

SEQ ID NO: 36240 - DNA, 3548 bp, Mus musculus
gaagacacaaaaatacttggaatccttcgagtctgaaatcatgagaaagaaactatgctggggtgatcacttataggtgaatggatctccttgtgaggttgacaggtgtaatggcctgttttgttgaatgattagacgtgtaactgagccgatttggaggttggtatgggccaagttagtgattttatttacgtgtggcaggcctgttggctaaggcagctacccagagattgcctgtatttctccctctacagataaaatcgccactaagttgtctgactccatgatgtccatgcttgacctctctggcaactccgatgactgtgcaggtgactgagcagctgaccttccccctcatactgcaagtactgcttcccgtgcgatgggagagtccagatgcctttccattctccctgatgtacttaataggagaacacctccatgtcatgtatcttctgctgccgtgccctccattcttatcaaaggtctggagctgccaaaccctactaccctctacttaatccttcctgtctttgaaaatgaccttgtgtttgttttgtggtgccagggattgaacataataggttctcacaaatgttagacaaccattctattaccaagctgtagtattaccatcattaccatccatcattatcattggggagtctgcttactcaacctcccaagtactgggattacaggcttttgccaccattcccagctcccactgtgttttctaaggtaaataaaatcagcagactcttggcatggtggcaacatatctataaccctgacacttgggagactggagctaggaggactgtaagttatgggccagcctgaactatctggcaagaccctttctcaacaaaacagcccaaaacaaataagcagagtccagctgggcatacacctttaatcctagcactctggaggcagaggcagatgaatctcgtgagtttcaggccagcctggtctaccgagcaagttccaggatagccagggctgcatagagaaactccgtctcgaaaagtgaacaataaaacaacaaaaagaatttgtaattatttaaaaagcaaataagcagagtccaagtgctgacaatgtaccttggactctaaattcctgtgtcgtaccctgtgagttaggctgataagggttaaccttttggacaggtaaatgtcctaaaggctagactgctgagaaacctggtagcagtggcgggggaggtggcggttgtccctggatgggtgatccttttcatttttatcaccctacaagatctcagtgccaaggctcttgcctgtgtattttccaaatcaatagctagctcctcatctgggtagtgtaggagtagagaaggatagtgtgagtctcctgtctctggaagtgtctggggatagtgtagaggatgacgattctagaaagggtatacctatcatagtaagttggaaagccattggctgcaggatgttcaggaaatgtagaccgtacctgttttctggacggttaggggctgagcacaaactactaaacaatgagaaacagttaccacctttaactttcactatatccgtatcaggaaggggtaaggctcagaaagccgacagaatgtgctcatgtcaacagtaagtggtggtgtgctagatgtcaaacttgagtctaatttaaaccttatgctagccttttggtttgcattattttgccttttcaacaagggcacaccactctggtattttctgttgtcatatatttaaaatatattttctctactctgttttttatttttatttatttatttattttttgggtttttcgagacagggtttctctgtatagtcttggctgtcctggaactcactttgtagaccaggctggcctcgaactcagaaatccgcctacctctgcctcccaagtgctgggattaaaggcgtgcgccaccaccgcccggctctgttttttaaaaaatggtagtatttattgaaaaactatgctttctaagtctctttaaatgatgtccaacttaattcactgatctcatcttaagttttgctagacaataatatattagaaataaaagtatctagattcttgggaacataatcatgtcaaaataaaatagaactaaaaccaggtgggtggctcacaccagtgctccaagcactaagaatgctgaagcaggaagatgtctgaagctgagtccagcctgggctgcagagtaagaggcagtctcagggcgaaacaaaataatgtgggactttagatattctaactctaatgtatctcaaggttgggggtagcatgcgcacgcacgcacagagagagagtttcccccatataacccagtgtggtcctgaactttttaggccccccccccattagctttccaagtgctgggattgcaggtgtttgctttcatgcctggatatttctttgttcttaaaacaatttcttgggtctttactctccccttaaaaatcatttttatacaataaatctcatccttcatggttctatggttctgtaagtttagacaccttttttttttttttttttttccgagacagggtttctctgtgtaatcctggctgtcctggaactcaccaggctggcctcgaactcagaaatccgcctgcctctgcctcccaagtgctgggattaaaggcgtgcgccaccacgcccggttatttagacaccttttaacaggggtggcctgccatcataatcaagataagagaattttgtggcatttccccaaacttattgtgtcctcttgtagtatagtcctgcccccatcctcaaatcctagcaggcacagacctctttcctgttccttaatataagtgtcgtaagtcacacgggggcttattttatggcattaagcttttagctttttccttttagatcttacattgaagttagatgcagttgtataagctcggataaatggataaagccgagtaatcattaatacaggacagaagagttctattagcctctcctttaccattcctggtaatttatagtcaaaccttgttctctccctgacagtcacggacttgtgctttcactttatggcttgtcttttgaaaagagttgtaagtggaatttaatagtatgtaacttttgagattaatgtgttataaattatagacttgagatccatatcactggatgtatcaatagtttgatttctgtttcatatgctattgtgtggatgtcttattgcttattcaaccctaagttggattacattctttacagttgaggaggaagttataaataaagctgctaaaaatccttgtgtgagactgttttcatttctttggcattactacctagagttggattgctgcaatatatggtaagcatatgactaacaatctaagcaactgctgaacttctttgttctcttgatgcacattagaatattattttgcctgcatgtgtgtctgtgtatcatgtacatggcttcctgtccacagaggccagaaaaggtgtcagatcccatggagtgaaattatagatggttggttgtgagccacaca

SEQ ID NO: 36241 - DNA, 1071 bp, Mus musculus
tagtgaaaaaagattatgtttactgggggtggtggaacataccttttaatcccactacctgagaggcagaagcaggtgttctctatgagttccaagcttgacagagcttcatagtgagaccctgtgtcaaaagagtcatctgaagggctctgatggtagctctcctgttctgttgttttaaattcctcagcagagtagtgaggtggttataagtgtggactacaggaatttaaataaatttaagttttcttcctcatttgttgtatgatattgagcaagtctgttcacttcactctctctgtgataccatttgtaaaacaagaacagtagcacccattccagaagggtattgtgtagatttacctaatttgtaaacgagggcaaggggtatagcccagggatacagctcgtgcttagtattcacaaggccctggttcgaccctcagcactaaaaaacagtaaagcatatagaactatagagcctggcatatagtacatcagtgctctgtagatgctatctgggggatatggaggagtgactttccaaaactggtgaacaggtttctgctcttagacactactatttgtagtcctggtctgtgcctgtagttcctacttcattctctactctgtccaggactctctggccacacattagggaatagttgagaaagcattgtttgacctgcagtcctattttctgctaaaggccagtcatttccttctgtgggtgctctgaagtcctggattacaaatgaggacaagaagacttgcctgccttctagtttattccatgtgtggcttgagtcaagtcagcctgcttgctgaattttaatttctgattctgtcaagtagacagttgagagggacttaaaattatgttttaatggtgatgcttgagcctggatttttaagggcaagaagagtgtcatcactgtagggagaagtcaagggtggggaagaggttataggtaaaaagtatttgaaggagttggtcctagtgtggcatcttgaagagtgagcaggagttaaggcattcagtaaagtaggtaggataaggttggtagaggt

SEQ ID NO: 36242 - DNA, 1152 bp, Mus musculus
catggatgtagggaaaggtgagcatttattcactgctggtaggcacgtgtaaactgtacagccaatttagaagttagtataaaggttcctcagaaaccgaagaatagatctgccacattttatggcacacactttgcgtaatgttagttctcatataaccgtgttttttacagaatgtattttcattcatatttttaataaagttactagaagatattttgaacttaaagaaaaaataaaagagccaaccagataggcttcacctgcctcctgcaaaacaccaatagctgcactctggaagcacacatctgttttgaagtcctgagcagttttttgcaccagacactgaaaacagaagttcagtggacttctgttagtatctgatttcatagagtgctacagtatcagactgtaacaatgaagtttcttcatctcccgtagagggcacctcttgtgaggggtttttgtagctagttgtttcctgggtgctttaccaatggcagatagatggacagtcttctttgaaggagccatgatatggacaccaccttacttaccctcccctttggctggagctctgtgactgagaggccatgctggcattatagtgcctggcctgctttctttcttttttttttttctgagtgtgtggtcaatgaggccaaactgtgaccccaggtggacttttagagggaatcccctgtttaccatcttatttctacgcctaatcagccatcccttatgattaaaatcaggtatgttatgaaaagggatatgagcagatgaataatgagtacataacttaatctgtcaatcaaagtagacaaccacacacattttgtgtcctgcaaataaactcttcttttttttcataattttttttccattttttattaggtatttagctcatttacatttccaatgctataccaaaagtcccccatacccacccacccccactcccctacccacccactccccctttttggccctggcgttcccctgtactggggcatacaaagtttacgtgtccaatgggcctctctttccagtgatggccgattaggccatcttttgttacatatgcagctagagtcaagagctccggggtactggttagttctggcctgctttcttatagaaccctggacc

SEQ ID NO: 36243 - DNA, 1200 bp, Mus musculus
cagtttgaaatagctttgtgtgtgtgtgtgtgtatgtgtttgagagagagagagagagagagagagagagattttttgcgtagccttggctgtcctggaactcactctgtagaccagactggcctcaaactcagagatgtgcctgcctctgccacccgagtgctggcattaaagccttgtgctaccactgctgacaatttgatgtatctttcatccatttattgccttgcatccttagcagtagtatgagggtgaggagactcaccatctacactaagcctctgtacacgcatctcaaatcttcttcctagttcaacgaccgcctcctttactgcgtgcccaggctgcggctccttggtcagaagtttagcgtgcgggcacgcattgatgtagatggcatggaggtaagcaccctgagaattggagatgtggagtggggcattggtattgggaggaaattgcctactctgtccccagtctatgtatacatatgtgtaggaccctatagagtgtataggcctcaccatgatccttcccttctccttttagctaaaggagagctccaacctcaacatgcctcggaccttcctggtgtcaggaaagcagcgctctctcgaactgcaggccaggtacctgtccttgcctatgcgttccctccaattcactctttttgtttgtttgtttgtttgtttgttttttgagacagggtttctctgtatagctctggctatcctggaactcactctgtagaccagactagcctcaaactcagaaattcacctgcctctgcctcccaagcgctgggattaaaggtgtgcaccaccaccgcccagcccaactcattctttacttcagatatgctgaggcattccaggccagagaaagagtgaacacctttccccaaaagatatggccttgctcctcagctatgtgtgtgtgtgggtgattctgatgatgacacatgtatatacatggtatgggaaaaggtggtatgtcagtcacaaaagcattttggagaatgaacaaactccagaatgcagggaagagtgggttacttaccactatcatgaataacatcaccaatgcctaccaccacacatggctaccatcagtccattttaaagctgaagaaattgaggcacctttcctagatccagccagcaggattagagctgaaattggagcttaggcttcgtcagc

SEQ ID NO: 36244 - DNA, 1102 bp, Mus musculus
aagatggtatcaggtactctggaactagagttggatatggttgtgaagtgggtgcaaagaattgaatcaggatcttctagaagaatagcaagtgttcttaactgctgagtgagctctagcctcttaaaaatcttttaatgaaaaatttctggtgtgttgggtttctgcctgtaatcccaccatttgagaggcccaggcagggagattgccagaaaattcaaggcaagcctgagatagaacatgagaccttgtctgaacaaggttaattttaaatatacaagaaacaaaacaaaaccaaacccaaacagtataagcatccataatcttaaatatagcttagctggttcttatcttggcaatttatggaatcagctgagaactttaaaaaaatcccgatgcctgggcttcatccccaaagattccgatttaattggcctgcaagtattgccaaccaagctcctcaggtgattggatatacaccaggactttgagccagtgattaagagccaatactacagatagaagcagagaactcgcctaccatccagaagacttgggtcccatctccagaacttctctttttccacacacaagacacctattgacattttttggtttggtttgtgacattttcccccaagccatccttggaactcctgagttcaaatggtcctcctgacttactctcatgagtaagtgggactaacaaatatgaatttcatccttatataccttttgaatggccacaaattccaccataattcttaaaagtccagagtaacacttgttcacagccaagaaatgaaaagttgaaaaatataaataattttttatgactatattcagaacaaacctcatctcgttgctgggcttatagatatttgccacaatttctagcttccgtgtgggtcttagggtctgagctcaggtcttcatgcttacatagcaagtgttttaatcactgtgccatttcctagtacctgctgccacattttttatgaaccttttccaaagtacagaaaactagaaagaattacagtgagcactaatgaaccaccatctagaatatacaagggttaacgtgctgctgtgtttagcttat

SEQ ID NO: 36245 - DNA, 1205 bp, Mus musculus
tcccctttgctaggctcaccctgcccccaaaggacaaggagaggagcagcccagctttgtcagatggctggaaaaacctgaaggagtgggatgcacacctgaggggctccatagatgtacagcaccaagggttcattctcaggaaccacaaaccatgccttgtgccatcctttcccacccttctccatgtagtgcaggaagctgcagatgacgctgttctcagcagcgaccgaggcctgtttctgtgatcagagacacaggacagggaacatcaatgttgatggaaggctttgctcttggctttaacagccccatagtgtatggactatgtctcagacaacggtagccaagctgtgcaaatcatagctgaaatgatttagccttcatcatggagataaaacaaagcaaggcttggctgctgctgactcttaacaacaagtataaggggtgtgcagatctcagtggggacagtgaaatgctggccactcttaaggctaagggactttcacagctaacccttttcatctttcataatatactcattgcctgctctgagaaagtccttctaacattatgattaatgggatgagtaggtggctaacaccatctgtctcgatcctaacaatagatgaaaatgcaggacttgtgagaagagcacagagggtgtttatgagattgaaattagcataagcaaggcatttaaaatagttctggtacagagtaagctcccttacatttgggataccttggttttgttgaaaaaacaatcaccccaaatatgtgtatattcatggtcctaaaaagataggatcagtattaacagtggcaacttctgggtaaaggaatatgtcttatgtttccttatcctatttcataattttaaaaatgcacttggttcattaaaaagaaaaacctataggctagcttaggctatgcagtgagactttgtctcagataaaatgatccctagaagtgtttttctggttgtataacttagtcaaatatcctctctgggttttagtttcttcctatgtaaactaagggtaagagttgagcagttactgtaagagttaagtgtgtaaagttctgtaataaaaagtatccttttaacccgtacactcattttccttgtttcaagtctggattacctgattaatgagtgcttaccctgggtcagtaactatggcatactttgaggcttgtgg

SEQ ID NO: 36246 - DNA, 1206 bp, Mus musculus
tcccaaatgtaagggagcttactctgtaccagaactattttaaatgccttgcttatgctaatttcaatctcataaacaccctctgtgctcttctcacaagtcctgcattttcatctattgttaggatcgagacagatggtgttagccacctactcatcccattaatcataatgttagaaggactttctcagagcaggcaatgagtatattatgaaagatgaaaagggttagctgtgaaagtcccttagccttaagagtggccagcatttcactgtccccactgagatctgcacaccccttatacttgttgttaagagtcagcagcagccaagccttgctttgttttatctccatgatgaaggctaaatcatttcagctatgatttgcacagcttggctaccgttgtctgagacatagtccatacactatggggctgttaaagccaagagcaaagccttccatcaacattgatgttccctgtcctgtgtctctgatcacagaaacaggcctcggtcgctgctgagaacagcgtcatctgcagcttcctgcactacatggagaagggtgggaaaggatggcacaaggcatggtttgtggttcctgagaatgaacccttggtgctgtacatctatggagcccctcaggtgtgcatcccactccttcaggtttttccagccatctgacaaagctgggctgctcctctccttgtcctttgggggcagggtgagcctagcaaaggggaaaattaaaacccctatccttatgtgacagaataggtaggtagaagagtttggaggccaaggtatggggacaatgagggtgaggtgggaagtctggctttctggagaaaacagtagaatagacaggcacctctaggtctgacacttaagtagaacagaataggcagatagaggaactagccaaaggactgaatctataatagttgatttgggcatgggaggagatagccatgtaaaccagcctgccttctagtcccagttcagatatcttcctgttcattacagtgaaatcagtgttcttcagcagagggaaacagcagaacagagcagtttgactgggcagaggatactgcctagcccctagatgacactagttctctgttccttctctccaggatgtgaaagcccagcgcagcctgcccctcattggctttgaggtggggcctcctgaggcaggagagcggcc

SEQ ID NO: 36247 - DNA, 1261 bp, Mus musculus
agaactccagcggcgctggatggctgttctcggcagggcgggccgtggggacacattctgcccagggcccacactgtctgaggacaaggagatggaggagacaccagtggcagcctcaggagccactgctgaacctcctgaagcctcccagacccgagacaagacctagagggtttggggggaactgggagtttctgccccacactccagctgcccatgttcaattgggggctccagcccactcccaatgcagtcaatacttgaattcccatcaagggcactttcaatcccgaatgctgggtcatgggttttttaattcatcttttcacaaaaggtgggctttttaaaaaaaaaaaaaaaactattcctacattgatgttaattttttaaatccctgtccccagggagggcgggagctaattgctagactcacttgaattagtttcctcccagtaccccacttccacccagctccccacaaaagtaccagaggcaggagacctggattcaagtgccagctctgctactgaccctgggaccccaacccaccctttcctcctcagccagtgtcttcacatgtatgaccttacatggggtggtgactagacccttcttgcctttcccatggcttatagcttctacctagccccaaagcaatccagtattttatcgtccagatccatggcagggccactgggcaggacgggaatgggggagggggggggaggacaatggatactgttttttaaagaaaaatacagtttatttcaggcatacagtaactttcagagcactgctatggtccgtccgtttgtccaaagtcccaggctactaagggagatgggagggtacagaaactactctcttgccaaattttgaagctcagcttgcagaaagctgattccaaggttaaatcatggattaaacaagaaaatgttatatgttattaaggtcttaagcctcatccctggacttaaaacagcccaactttctcaagttcaccacttttagtcaagtccttcaaactctcaagggtattcaaacagggagcattcccaggaggatgcaaattctgggcaggatgagggttgttctgagggaggctagggtggggacattggggaatgtagagatgtctacatcttttctctcttccaactgtatgcttatcctggctggattaccaatccagccagcctaccactgtggaattctggtcctttccacaaatgtacctgccagttttccacaagtctggtct

SEQ ID NO: 36248 - DNA, 1149 bp, Mus musculus
ggaagtgatggcggttgtaggtggtagtggtattttcaaggatagctcacatagtcatggaaaacttagtagcagagcctgggtaatgtacttaagagacttctcttgtatcttccttccaggtgacagctactaatgatggggccacaactgacgaggtctgcccacagcctcaaccctctgatccagacacccagactattaaggaagaggatatagttgaagacggttggaccattgtccggagaaagaaatgagcagggcagtacatgttttgggccctcgtttgttaaatgttatgagacttataggagctgtttgggggctatacacctctgttctggaaaccataacccttctttgttcccctgtccttcccttcaggagaaggaaagccctagttgtggggttgatgggacctattccagccccttgaatcttaaggtaccatatgagagctaagagcaggtttcccagcatagtacctcctaggtgcagtgactatgaagacggctgacaagtgtgggtgtggttgtagaccagacttgtggaaaactggcaggtacatttgtggaaaggaccagaattccacagtggtaggctggctggattggtaatccagccaggataagcatacagttggaagagagaaaagatgtagacatctctacattccccaatgtccccaccctagcctccctcagaacaaccctcatcctgcccagaatttgcatcctcctgggaatgctccctgtttgaatacccttgagagtttgaaggacttgactaaaagtggtgaacttgagaaagttgggctgttttaagtccagggatgaggcttaagaccttaataacatataacattttcttgtttaatccatgatttaaccttggaatcagctttctgcaagctgagcttcaaaatttggcaagagagtagtttctgtaccctcccatctcccttagtagcctgggactttggacaaacggacggaccatagcagtgctctgaaagttactgtatgcctgaaataaactgtatttttctttaaaaaacagtatccattgtcctccccccccctcccccattcccgtcctgcccagtggccctgccatggatctggacgataaaatactggattgctttgg

SEQ ID NO: 36249 - DNA, 1229 bp, Mus musculus
gggggtttgcagaagggaaaccaggaaaggggataacatttgaaatgtaaataaagaaaatatccaataaaaaagagctgtatgcaaagtggtttactagtcagtgtagctatattaaaaatgataacgcatacttagtccctgctatcttagttgctaagttgtacagcaacaagaataaactttttattaagaaagtttaaatcccgtgacttgttttttccttaatgatttctgttgtatgattttaaaactatctcttttccattcttcaggttgctatgggaatatatgaccatataaaaggaagtacattctgaaaattctcatacctgagatgtaagtagactgaagagtgaaacaagaacaaatttagtgccaaccttagttacaatggccactgattctggggagccagctagcacagaagattctgagaagcctgatggagtttcctttgaaaacagggctgcccgggctgttgcccctctgactgtagaagcgagaataaaggaaaaatacagtaccttttctgcttccggggaaaacatcgaaagaaagaggtttttccgaaagagtgttgagatgacagaagatgacaaagttgccgaatcttcccgcagagatgaaagaaaagctgcaacaaatatttcaagagtagataaagttcctacaaatgtgctaagaggtgggcaagaagttaaatatgagcaatgttcaaaggcaacctcagaatcctcaaaagattgcttcaaggagaaaactgaaaaggaaatggaagaagaagcagaaatgaaggctgttgcaacttcccctagtggcaggttcctgaaattcgatatagagctgggaagaggagcatttaaaacggtatataaaggattggacactgagacatgggttgaagttgcttggtgtgagctacaggtgcgtatataattttcttggctttatgaatttcaaatttagctaccgggactgcgagaatgatccggatgaagacgtaaagagcccttctaccatcactgagaaattatgctcttgttaggaatatatgccaagctttttaaaaattatcttcccctcactgttctatttttcttcctcttcctcctcctcttcttttgtggcaacactgaggatggaatcaggagccttttcaagctagacagtctaccattgagatatatttccatgccagttttgcctttaacttaattttgcagtgc

SEQ ID NO: 36250 - DNA, 1151 bp, Mus musculus
gcctcataagagctggtgtcaaagacttacatcatagtgtctggccttttcttttcttgagacaggatttcaatgtagaccaggctgaccttgagcatactatatagttgagaataatcttaaaattctgaccttcctccttaagtactaggattacaagtatgagctaccatgcctgtctaaagttggatttttaacattttcacctaacactgaatgttttaaattgtatttcattagtacagattgttaaattttctggttttttttttgagaaagggtcattctacattgcttagactgtcctgtaacttactctgtaagccaggctggcctcgaactcaaaagagatccacctagctctgcttcccaagtgctggagtaaaggtgtgcatcactacacccagcctgatttacagatttcctttgagggggcagaaattgacagatagtttttatgggaaagaaagacttgatgaatatatatttttccttttaataaaaatgtggttgtggtattattttacaggcactcctgaatttatggctccggagatgtatgaagaacactatgatgaatctgtagatgtttatgcttttggaatgtgtatgttggaaatggctacttcggagtatccatattctgagtgccagaatgcagcacaaatataccggaaagtaaccagtgtaggtataattttattcattttacttaacagattgccatattttatattgagattgacaaaattaacttagtcaaatttaattatggaacaaagtgtgtggcttagtggtagaatgcttgaccaatataaacaagactctagtgaaaaaaaatagccacacccattatggtttagttttatataacaatgttagtttaacaattgcatttagtaaagctttagatttataaaggtttctatttatgtacttgaactctattgggtcatataaaatgttctacattattttgtagaaaacatacaggtttatttatagtaaaattttagatattatatcagtcttaattttgttttgttctttttttctgagacagggtctcactatgtcactatgtacctttgactgtctgagaacttactacatagaccaggctggactcaaactcagagatctgcctgcct

SEQ ID NO: 36251 - DNA, 2351 bp, Mus musculus
tattagcaggaaatcctggactcgaaaattaaaaagctgggcatacaggctacggcagtcaaccagctttttcaagagatcaaaagtccgtcaaggtagtgtgcttacagtcagggccatagactaggtaacatcatttttcatctacttttttttttttgtcgttcatactcaaatcttgccatgttttccatgtagcacatgtatgttaaatatcccattaatgttgttgccattttattttttccttttgtaactaatttggtttttcagttattcatttcatatagattgggataaatcttgcaatgtctgatttagagttagggatttaaacaatgttgcttatacattaacaccttttaattattagcaagggttaaactttctgcttttcttcatttttggtaatataaacaaatttgtcttaaaaatgattttctcttttctgcttataatttgacaaatcttacagtggaaacagaagataaaagatcagcaattgcttctgatcccattcctctgacacgggagttctcatctgatactagggctttgagtagatgtaaagcgatgagtggatcatttcagcggggtcggttccaggtttgtgtctttggttgattttatctttgggtgcctaatgagaggaaactggactggtgatagagcttcatggtagagtttgcccaccatctgtcatcctgggttctatccccaacactataaaaaagtgacagcatttgaaattgatctgtggatgatctttaactgtaaatatttatatagctaatttctttacatatttatataagatgtaacatatttatattatacagaaagataaaaatttcttcaacttttcaccttatatcattgaaggtgaattgaaagagtataagaattttttagtagttgtaaaagaacacagaaataatcattttaggggtcatcatttttaatctcccttttttagatttattgtttttatttgtgtgtgtgtgtatgtgtgtgtgtgtgtgtgtgtgtgtgtgtgtgtgtttgctcacagaagccagaagagggtatccgatccctgtgagctggagttacagatagttgtgagccacctttttggtgacagaaaagcagagaatactcttatctgctgctccatctctcctgcctctttaatttaatttcatgtcatttagaatcttagcaaattttatagtgggattttatttgaataagtaaaatgaagctaatctgtccaagggccccaatggaaagactgactatagacagtataagttagtattatatatgtcagatcagctcttccactcgtctatgctgtccttagatggtgaatctcctcatgaggtttaccctacaattaggtagaaccagacaagtttacctttttatgtttcaggtgattactgttcctcagcagcagccagtaaaaatgatgtcttttgggaaagatcacagaccgccattcaacaaaacaacagtccagtctagtgagcaagcactaacctttgctgaagctgcagtgtcgcagttgatcgaagtggagcctgccatgcccactcataaagcttcagtttcttcacgcaagttgcgaactctttatgaaacctttaaagaagataaaggagatcctgaacaaggtgacatcgtatcttacagcacagcttgtgagaccagtgtctcttcagtcgctacagaaaagaatgtaacttcaaccacagaagttagtgtgcagtctgggtctgaaccgttagataaagaaaaaaatgagtcaactcctgggaaacagacatgtacaaatgaattttcagccactcttgctggtaatagaaagtccgtgacaaaaactcgtccagagggtgatcagtatttaccactccgtgaagagcaagcctatgctcaaacacagaattcactcttctattctccatcttccccaatgagcagtgacaatgaatcagaaattgaggacgaggacttgaaagtggagcttcaaagattacgagaaaagtaaggatgctctctcttctgtaacaaatataattgtttaggggtttatagaactcagtttttgctttgtagctaattgaggattggtggcatttaatgattaaaacttttctatggtaaaactataatgaattctattataaaatatgtatgcatactaaaaatctttgtgtataaaataacttttactttttaaaactgttttgtgtgtttgggtgttttacctgcatgcatgtgtgtgcagtgcccatgaaggtcagaagaggttgttggatacccccctagaactggagttacagctgttagctgccatgtgggtgctg

SEQ ID NO: 36252 - DNA, 1961 bp, Mus musculus
ttaggtgcacaagtaaatgttgcctgtgaaacttgcttttttgccttgattctttgtgttagtgtagattctcagtctggcttgccttttctgtcctagcactcaccatgcatgtgggatgagaggaaccatcactctgccaccaaatctctgcttaagtgatgacagccatgcacctgtgtgtaataaagttaggggctgggggatggaaagcaaagagagaaattaaattggtggcaatacaggacttggtggtgggagctagttttcaaatgtactgaggtgagacagccccagtgcccccaacttcatatgtactggtgatattttcttactcagtgcctaaagggctatgggttgtaattgctttaactaccacagtgaaatacttgacctcttagggcagtgacccatcttcaaaatgttatcagactgcctggtatttacagtgacagtttgttatcttaaaatggcagaatgcatttcatttggatcttagttggtagtaagcttttagataattgcttatctaatctctgtagtttaatggacttgactctctttgctgtattttctaagcattgaaaattctcttcccccctttaaaaaactcagcaaatgtttgtaactggatattccttgtttcacatgtttactgtgtaacactacatttttaatattagtaaatactatatttcagtcgtcatttataagtacattcctgaggtatatttgccatcaatttgtgattcagttacctcatgttttctttgattaagaaaaacctgagccttctgaggtggtatgcaagccattttctagaatagattggttttttttttaatctgtagttaatcagggacttattttccctccctttatttagaagatataatagaaaggtatgtatatatagaaaagacttttgatttggtaaataaaattctagggttaaaatttaaaactctaacccaaattatgaaatgaaaacactcgaacatagtaccagttctttttacataaaattagtgtgcaattggtatagagacatactttcagaccaccctggaaagagtctcttttatatgtgtatgaaggatgaattcaaacattgatcagggaccttgacaactatcatgtgaatgggcccacagtagtaatcaggttaaagtgattttccactgagatggttgaaagaatgtacagatcaacagctccgattctgggaggttctccgtgaagtaaaacaacccagactgttaaaaagctaaaggtcaggtgagaaggcaaggggaagactacactctgaagggacgatgcatgaaaatgcacacttggcacccttctagcttttttacattgtgtttcttcccactataatttaagatttaaggttgagatttgtagtctagacccctcagcaggtagagtggatacagtgactggtcagaaagtgcagttgcaggtctgtcatgctcaatcacttaacgctataatgtgtttcctgcgaatatcaagcatgtagaccaagtgcagcatgggagccactcaggaagtttatgaaattaaactttcatgcataatttaccatgaaatatgtagatttcagccaattctcaatacttaacatttagttatatatgtgaactctcctttcttaattcgggaatgtagcattatatagaatgctgttaaacttaattttaaccctttttaacttttttttttttttggtaagccaagtgatctacctttcagcagttgtctggttttgattcgtcgaaactgtgatttttattttaattactatccaactgttgttaaatattttgtttcctggaattttgttttgaaataaaaataaaggctgtgttaaatgagtatgtcaccttattaaaattctgtcatatttactgcaatcaactggcttaaattttttttcaatcaagtatatataattg

SEQ ID NO: 36253 - DNA, 1099 bp, Mus musculus
aaaagttctggctttggttttctgagtatttaatgtgatagctctgagtatttaatgtgataaacttgtatgaaaaatatgggattgaaagataagctgcctatgggttcctggtttttgcctttaaggtaatgaaaccttggtacctaatcagtatcctccttactctctcccctaactcacctaccccaggattttgtataccacctctagctctggcctgacaatcagataggtagatgttttcagggaagtagatagtgttggtttgggttattttattttgtttttttattttatacacttaaaaaaaactacaatggcctttgtactgggagattcaagtgagtccgaaaagtactgggcagatttttcctgcctcccaaccagtgcattgtttataaaatagaagctatggtgcagttcactctctgctgcccacactctaaaagggtgggaattaatgttatgaaactgagtacaaaagggactcaaagactttatgtgtgtgtacatgtgtataggtgtgtgtgtgggtgtatatatgaacatgtgtatctatatgcatacacataccctttatataagagacagatctatttatctatacatattttatatatataaatgtgtgtatacagatatatatacacatacatacatacatggtaaagttccagaagatttactgaatttcccagaaatgcttccactgctatggaatggtgggtttcaaaagaccatactttaaatctgaaatccttactaagtcacagcctatcacaattatgagaagatgggctactctaaatcagacacagagtactttccagagattgcctgttcagaacaacaaatacttcactttgaacagagccctcacatcccatatggtgaaaacaggaggttgagatgggattgggaaaagttgcacattttttatgaaggtctggagatagaaaagggatcggaggtaatttccatttgaaaaggctttcagccaatttggaagaaatgtcttttggaactccaggatcaaattcgcttctggcaagaactaactgacacgaatccaaggagggaaaactcacattggaat

SEQ ID NO: 36254 - DNA, 1572 bp, Mus musculus
actttgatattcttgcccaagaaatataatttcttcaagaatataactgactagactcctagcagggtcctctatttttggggaaaaaaatccatgcatcttaacttacaatagatccttggtgatttttttccagacaaccagaaggctatgtttgctgtctgcccattcgtctcaagaaactaaatgtcttgggctgtttaacccaagtctaacccagtttaagaaaactcacaattttcaggggataggagccctggtatgctttgccccttgcccagacatttcttaaataagcctaataaagatggcaagagtatgttccatgccatatatgagaagaataagaagaaaaaagtatacaacacttcctctttgaaagagctcccctgatttggttccctttctgatcttggacctactcatcctttcacaataccttgaaggttaggccttttatatccagtaagggaacaaattcatagagaatatagatggcttagaatcaccatctaagccacagaaggatgaatcctttggagctctaaaagtaaccagaatcactgagtgagtgaatggttagctacatggacagatactgactaggaagtacttggagttaaatgttagagtatcttcagttgctgtttctgtgcattgtaagtctatctgacacagtcagatgacagtattgttaactcttatgtccttctcacaacaggaagatttcttttgtaactattcactgtgagaggtaaagttgctgctttgacagaaatgattccagtttgccaaaagacaagcttttctccctttcacaagcctctgcttctccctagcctggcccaggaggaaacaactttgaattttgttttgattgagcatttggggtttgggaagttacaagaacgaactatagaggattatgttcctatgtacccaccaaaacacacaatttaaaagccaggtttgttactgatagatgaatgaactttttctaattggaagacaagttgggggcctttgctgtacctgcttgaggttctacttctgattctcactggctgctcttggacaaagtcatcttggaatccccagaaatgactgctttaccgtgtatggacacagcaaaaacaaaaacagaaccctaaaccggttttgtgcagccactgattgctaaggtcttgcagttcttctgtctgtgtgtctttgggtcagcctgtaactcctgcctttttaagtgactgatcctgacagacttctattatttaaatcattttcactgtacataggtaggacttcaggcatattgaagccccctaaaatggcactttctttggctagggacatttgctttttgtctccatctgaattttctgacattgttggccaaattaccctaatacttacattactgagagagagagagaaaaaaaacagacaagtattggggggaggagatacaaaaaatgcttatgtaggatagaaagaataagagtagccctttgggtatgatgattcagtcctttgaaaccttagaaggcccctatgggtatacaatgccaccctttg

SEQ ID NO: 36255 - DNA, 1301 bp, Mus musculus
gacaaatctttcttttaagttttttatattgaatattttgccatagcaatgaaagtctaatacaaatgtgatacagggatataactatttttgtctgaaagaatagctagttgttttagcatcaggatttccttctccaaataactgtttcagttaatatgtttttttctatagtatttaagaaaagattgaagggggctggagagatggctcagcagttaggagcactggctgctcttccagaggtcttgagttcaatttccagtaaccacatggtgactcacaaccatctgtaataggatctgatgccctcttctggcatgcaggtgtacatgcagatagagcgctcatacgttaaataaataaatctcaaaaagaaaggaaaggaagaaagaaggaaggaaggaaggaaggaaggaaggaaggaaggaatgaagaatcaaagaaacaaagaaggaaagaaagagctcttgtcctttcctctgccatagtgtacactaagcctgattcggcttctcgccatgtcttctcacaagactttcagaatcaagcgattcctggccaagaaacaaaagcaaaatcaccctattcttcagtggatccggatgaaaactggtaacaaaatcaggtacaactctaagagaagacactggaggagaacgaagctgggtccgtaaggattcacacaatggcaagactgaggatttatactgaattgtcatcaatcagtcctaccagatggatttcaacatttttaacctggagacttgctcgtatcttaaattatgatgtttgtccagtaataaaatatagaacctttcaaaaaaagaaaaagaaaaaagaaagaaaagaaaagaaaaaggaaggaagaaaagattgagtagaagatgatatgctactagtttgatgtcaacttggcacaagccagagtcattttggaagaggatacctcaatttagaaaaggcacctactagattggcttgcgggcaagactggggtgcattttcttcattgatgactgatgtgggagggcccagcccactataggtggtgctatcccaggggtagtggtcctcagtggctctaagaaagctagctgagcaggtcatggagagcaagtgagtaagcagcactcctccatggcctcttcatcagctcctgctgtagggttcctgccctgacttccatacttgatggactacaagctataagatgaaaaaaaaaacacatttttttcttttttcttttgtttttttttttttgttttgttttgttttttgagacagggtttctctgtgta

SEQ ID NO: 36256 - DNA, 2683 bp, Mus musculus
ctgaccaaaggcacggactatctccaactccctttcccacttcccctatgagtatcctaccttctttttccatatccataaatagcaggtaaatgggagacatttccaactgacaagaaccttttcctgctccacccacatatttcacttacaccttgtctttattcttttccactgctcctctatatggaaggaatgaggaggagcaacataaagggagtctgggcctgtcagtttcctcagccatggagtgagaagcccagtgctcaacattttctgcacctccagccctgtctctaagcctgcccacctccacccattcctaccccttcctcacaaccgatggatataccctaccttcattcttgttcctgatagaaggttgtggtctttatcttcttttacctctttttcatgacaaaatgaagagggtctttatgaccctattatgggacaactccagagctggcctagaaaagctgactttatctgtctttgggggagggggaggagattccttttacttttcgaggtgggaaaaaggacagatacccaagcctttgaccatgattgttgcttagcccaccagaggaaactacttttgtctgactgcaaatgaaacccctatgatgatcttcaggaatttgcctgtatttttgaggccctgtagaacattatccccatagctataactgggttcaagcaggtacaaactcacctcctagaaatctgaagtacctggcacattgagaactatggcccctgccaccccacaaagcacagcctggaccttctgaagagggtgtggtgagataaccctgaagggtcattatcaggaacttccatgtttctttccccatctaagcttagtctaaagaagatttcagtactaagatcttcacccctgggactttccacttccagaccacaggccaactattcaagcatagtacagataggctattgaagtctgaagttagaaacaatgcccatatgtgaagtagcagatattctgatccgcttttctctgctttcctttgtgattgtcactattttccagacaatgtccccacctccctcttgtcttgccttactggcaatctgggcttgatggagactgccccttctgaacaacccattttggcactgcccaagtgggagtgtcctctaccttccactcgtcctcatcccagcttgcctagtgcttctggggaatttaacagctatgatgcagaccacagggaatttgtgaggcctctgtgttatcttttatgtttgtggcttatctttcttttttctatagatgtatcacctccatccttgttgggatggggggatactttagcatatttgctttttctaccttggggacccccaggggccaagcagtcctcctttagtcacaccaaaggcaaaaggcctggctacctcccctttagcacgtgaggtccctattcccctcctttctactcagctttgcttatcttggagatttcaaggcagcagtagggaagtaaggggaaagcaggagaagctcctaaccctgtatgggcaacttcctgactaaagactgactgttgtcaccaaaaacaggtccctagccctttcacccactaaaactccctcttgatctttcaatggcagctaattgctagcaccctcaccccacccattccaggcctcttttccctctgtttctttgttagaaggttctgtggagctgaaacccagcctctaatggggtttgtttagtttagttgggttctcagagtctcctgttattttgtgttgtttccaatgaaaagcaagtttaccctcaaagttatgcttttccaaagaagctagtgtgttagtggtgttgttgctgttgttgctgttgttgttgttgttttgtttgttttgtttttatgtttcaggttctaagtgaagtgaggtggagaggagttgggaataaccaaggtttagaacatggtgagatagttaacctctgatctgcaatccccagcagagagttggggtaggataagagggcagagaggatttctattcacctttaatatatttttacaaaaaagcaaacaatttaaaaacaaacccaccgcttctgtacatgtctaaatatatttttagaagtgggtaggattgtgatttctgatgcagggcctttttataaataggttagagtagcctcatccagatttctctgttgtttgttccccttgttttttcttatgttgtgttactaatgtaatttatatattttttagatctccctttcctgtagagataaaagtgatttatcttggcaattttgttgcttgacattattattcataggggggtagggggtggtcatgtggtgggggtggttgtggtggtggtggtggtggtggtggtggtggtggtggtgctgataaggtgcagtgttcagaaagttactttccttttgactatcattcatcaatttataagtggtcatttccctggttatttaccagcattatatctgaaatatgcatttggtaagctcctgttcttaaggacacaattttatacacataaaatacttaattaaaagtaaaatagggagaaaatgaaaggtacaacaattcagtgttccttagaagttcaatgagatagttttcaatcattttcatgagctacttcttatgagcatatactg

SEQ ID NO: 36257 - DNA, 1166 bp, Mus musculus
aaacacacacataaagtaatttgatttaaataacaactttaaacatcttaattggggcttttggtactttctgatttttcacttttgtacctactcatgcaatatagattaataatgttaaatgtttgtgtacatctttaaaattttgcctaaattcccagaccccccccccccataactagaggcttatagtgagttttccaccccaagttatcgaaaaaccttgcatacttaactgtgtcaataaagagtttgaaatctttataataggagaagaaaaaaagcttttttgttttggcttagtttggtttggggtttattgtaacggggaatgttggttagttttatctaaagatactctgccattttctgtctaataaccatatcatcgaattaacataactccagtgttacactaggtatcttgcatactcttcatctaatatttgtatttctaagactgtagagctgtagaatatctgtaactttattttctcattactttggggtttttgttttttggttttttttttttgcagatcttaaatcagaaaactgaaaacatgaaagtagacaggactaaactgaaaaagacacctactgaagctgtgagtatccaaatttgctttgtgcattttctttatttcaggaaaaaaatcattgtgaccagttcagcagttctgatcttccaaataagtatgtccagttaatacaaagtgttaactatagtaacttgtgaaactaggaggaatatctctgtttgtctagcatgcatgaggccttgggttgcatcctgaacactaccagaaaaaataatactaccttgccattttaacttactttgattaaaaattagtagccaagtgaccagtggaaaaaggaatagtgaataatactttaggtatttgttccctgaaagggactctcaggctacaatataagcattgaaagacagtatgacaatggaaaagagatgtagaattaaaattgactatagctaatagaacttaagagttttttgttttgttttgaagacaaaaatggtaagttcattgacttttttattagccttttattttgtattttgacattggaatatcagtgtttttactaaatgccatatattgagcatattaatattgtttctgtaagttttcatttgattc

SEQ ID NO: 36258 - DNA, 1239 bp, Mus musculus
attacatagtgattttagttttatccagttatgtgctgcaacatattggtgaatgttctctgtttggaaaaaaaagaggttactcccaagcttgtcgtactttaatagttttgagtaattgcacacagctgttgttgatagttttagtttctatgtgtcctttatatatttgttataaaggaaataatagcatacacttagattcatttcacaatgcttagaaatataaatttttagtcctacatatgtattatagcatgtttctatcttgaaattcttccttatgagatacagatataatatcgagctgcaattttcagtgtttacagttattgaactttctagtcagctgttccttggatgcaggattatatattgtaagagattgacttatttttgtgtattgtggctcaataacttgatagcttttaatgttgacacacattattacattaaaagaatttcttttgaagtttttagtgccaagtacttgatccactaaactttgtcccttttttgtttctatagcatttgacaactttattggcttcctctgatatgcaagtggtgctggcagtccttaaccttctatatgtatttagcaaaagatcaaactatatcacacgtcttggatctgacaagaggactccgctactgacacggctgcagcatttggcagaggtgagtctttggggaagatatcagcatatggttaaacaggcatttcttgttttgccaaagtggattagaatccttttgttaactttctgaggtttacaagtatttgtgacagtgtaacaaagtttcaaaaagcacgagtattctcaactattaattaaatttgaaatatttcatcaactctgctcaagaaacaaaattcttgtttcaaaactgatagtgctgctttggagaaattcagaataaggattctatgtgaaaaagaagcataccgagagaaaaaggttagattcgaatctttaattctgataaccagttttctcatttcggaatttaaataagaattgtttagaataatcggagaacatttagtgctattttttccaaattggatattttctttatttacatttatgatgttgttctcccttcctccccccaaaaaaaacccgatgttgtcccctttcccggtttttctctccagaaaccccctgtccccttcccccctcgacctgcttctatgagggtgttccccccactcacctacccactcccatctcc

SEQ ID NO: 36259 - DNA, 1550 bp, Mus musculus
gtgctgagagggatcttgcgagctctacatctggaccagaaggcagaggaaacactggggcctgactagggcatttgaaaccttaaagcctatccctggttacacacttcctccaaaaaggccacacttctaatgcaactccctaagcatttgaaaatatgagtctataaaggccattcttattcaaaccaacatgcaaataatatagaatcttagagagctcttggtttatgtcaagaaaacatggttccaccatggtgaaggaaagggttaaaaaacctagaatggtgagaaaggccagctataactaaattccagcaagtatgaatttatacatatggaatgtagtagctggctagcattgctgctttgtactcttatcttgagcagctccatagaaccataaaatagattgcattgtttgttttttcattaaacactttataaacttatgaccataagcgtggtgttaactctttttttttttttttctttaccaagagctggggtggaaaggagaatggctttggacttgcagaatgttgcagagacttgcaaatgttggtgagttaactatttgggatatgataaagtcttgttctaagcctcacttaacaatgaatgtatgatatataaattgacacttgacattaggacttttgtagaacttgaaaaattagtgcataatatctttaggaaatttgagctattattgttcctgttatagataaaaaagtctcagtagtgtgtgttcatataaccagttctgaaataagttgaatttatttaatcaaatcccagaaagctgggaagagtagtacttccacatctgtatttgggatatggcacgaggaagagcacgacttcaagaccagctttgactacatttacttatgtactcacacaagtatcagaactctgagcagtgttcaggaatgactgataggaaattttttttttaagaattatttattacagggatctgtagacaaatcaagagtagttgacctacattttatttccagcaccctgtggcaactaaaaacatttgtaactccagtgccaagccctatgattagcctcttctagcctctataggcaccaggcacttacttggcacagcagatatgcatgcaggtaaaacactgatacaaataacattctaaaaatagttttttaaaaacttaggtatactcttaccttgtcaccaattctcttaaggatttaggctatcctcccttctgctttctgtgcttcaagtagagcctagattgtcatattcatcattaagtagatatgatcaaatctaactaatttatcttctggaaatgtttatcccttagtaggatggttcttatttttagttgcagaaatctacatattaaagcaggttactttcttaccttagctgatagatgatcttcagtaagtagctgtgaatggatgttggtaataagggaaatatgtcttaaatcttactcagtttggagtttcaattttgagaacatattttaatgaagaattctgaagctcattctgcatgttaagac

SEQ ID NO: 36260 - DNA, 1391 bp, Mus musculus
tttacccttttgtgctgattggaatgtgtgttatacagtggtggcttaataactgcatttctaccaaagtctttgcttttcttttgcagtctattctaatgccttgcaagagtcagcaaacagtatcttgtataatgggttgatagaggagttggtagatgtccttcaaataacagataagcagctcatggtaagtatctattaatatgtacctatcaagttttatattgcatatgccttctgtttttcttaagaagtccaaaagtatcctagaagtggagcctgaaccttttacttttttctttttggatattaaactgtgaaattactgaataccaaatacacattgttattctctactgaccccattttcctcaaacagttttaataaaattactgaaaatttgattttgagatattagcaccttcgttcagttgtccatttgtttttgacactgtttactttgtcctcataggaaattaaagctgcttctttacgaacgttaacatcaattgttcatttggagagaactcccaagctcagcagtattattgactgtactggaactgcctcctaccatggatttttgcctgtacttgtgcggaactgcattcaggccatgattggtaggtttgcatggtaattatttacctaggaacatttcatcgtttaacattgtgctaggtaagtaactgaggaaatcccaactttctttgtagatccttccatggacccatacccccatcagtttgccacagctcttttctcctttttgtaccatctggctagctacgatgctggtggtgaagccttggtctcctgtggaatgatggaagccttactaaaggtactctgcttttgctttctaatataattgtgtgaaaatcaaataagagagggcagatttttaatgttttacagtgagtaaatagcacagaaagtttatcctaaaagagttatagtttatgttctagttgccacatgtatctattgtcaatattgggactttttgtaatccagcgtaatttggtagactggaggccctgggtctagacagtactacatgcatagtagtgtgacattatgcatggccctaagaaaaatgtatgtaagagtccttgtaaagttttagtttaattataacaggatttagattagttggttgattggcagtaggtattttgaggcaatgggtcttggcctctctggcttgcaataaaataagctgtatatatttaatcatctttatgaattgttatgcatgtggcctcaggaggttgaatatagtccttgaattcataactttattatttgacaaaacattcagcatatgtctttatcttctctccagtttcatactatgctgactcaaggggacaccaatactata

SEQ ID NO: 36261 - DNA, 2171 bp, Mus musculus
gttaatttgatgtgactcaatacaactttatttccttttcattttcacatctacaagtatatagtttttagaacagagagagaggagagcacaaacacattctgcttttattgttcattctatgtatcatagccatccttccctatgaacatcagtgctttttatatttgttaattaacctctgttagtagtcttgacttactacctccctcttagcagtaacatacaaagttgcatgttttacatctcactcagtggacgaagttttctcagaaatctttcttttcttagtaccttttattctaattagtttctttatcataacttgtactttagttgcagatgtaactatggaaagcagtccaggctcgtccatatctatggagcaccggctggatgttgaattaagggcatcaagttccaacagcagcactagcatctctggccctggcccgggtcctggccctggtccgggtcctggccctggtcctggccctggtcctggtcctggccctggccctggccctggccccggccctggccctggtcctggccctggaccccgtcctggtgcgtagacacatagatacacagtcttttacagtgactgacttattaaactagtgaagaagagaacattacacggcacttattggtacatttgaggataatcttataagaacatgtcttgcaacattttatggtcttctgttagttcacacagtatcaaaacagacatttcggagggcagataatatccaaaagtgaagtttgaagttgaatctttttactctacagtatttctgtttttatctttttctttttgttcctctgtctgtctgattttaataccggtcatatgctatctttggtgatttaatttcagctttcagaatactctctctcatgtccagagatctcactttaaatgtctgctagttttgctttagtggatatagacgggtctcttagtacatgttttgtgtgcctcttcactgtgatttaataatgagcacaatatgatacttttttctttctcccatgttaggagttcagtgtattccacaacgagcagcacttctcaagtccatgttgaatttcctcaagaaggccattcaagaccctgctttctcagatggcatacgacatggtattttgattctgtatactgttttctaagaccacttggttatccagattgttctttttcatgttttcttgatgtttttctaaagcatacttagtaaactgatagctttttgttacttaatatgtttcttagacatgagggttacttacacaactccacttcccagctttggattctgatctcttctatcctactgccacctctcatagtctccatgtctgttcttattttgaccctctattcaagctaactgcatgaataaactaaggcgttatatgaaacagaggccatagacttgatcatttatttactacagtataacatattgctacccatcacccttgatcttcgtgcctcacccagacttatcatatgtggtctttgttcatatttcttttagtgatggatggttctttacctacctctctgaaacacatcatcagcaatgcagaatactatggtccatcactcttcctcctaggtgagtagaattgaagttcgggctaggttgaatgttctggcatacatttataaagtacctggaggcaaaaggcagtcagttctcttgagttcaatgccagcttgctgcatgtgtgtgcacgcaagcttttagaacttttttttaatttctttttttatgagatattttttcatttacaactcaaatgctatcccaaaagtcctttataccactccctaccctggaccctgctttccaacccacctactcccacttcctggtaaatgctacaaagcccattgttttatcccactacgcactttggcatcacaaatgcaagttggaactccatttaaaattctataaagcaatttagggggagatgtagaaattgcaatttctttgaacatagtggagtgtacattgtacaaatacattatgggcagtctagagatttgtatttattatgactttacctttttgctaatgaaacagtttatgaatctgtatttctatcttgtgatcttgcagaatttactagtttggttttccctgttaatg

SEQ ID NO: 36262 - DNA, 1136 bp, Mus musculus
tacattaatacattttttctatccctcaaagatccctattgttttgattcaaatcctgattcctggagttcattttatttatattataaggatgcgtgggaactgtcctaacaaatggagtgtatatacagttaagacatagacctgtttctgccactaattcagaatgttgctctgaacaaggcatttagcttctctttgctttcaaattgacttctggagtggttaaaaaggtagaatgggaagggttccttattttctggatgagtatgtgctaattatttgtccctgttaattgaagtggtattacagaaaataactgatgtcttgcaaatacgttgtccctatcctgatcctgatgaagtaaaactgaccttttacttccaagtgttagcctctaacttgtttttaaaaaactttcatcacctagatgaaatttgtggaatctattttgagcaacaatacaacagatgaccactgtcaagaatttgtaaaccagaaaggactcttacctttggttaccattttgggtcttcccaatctgcccattgactttcccacatctgctgcctgtcaggctgttgcaggtgtctgcaaatccatattggtaagaaacatctagcgaaatattttacatctctgtatgtattttcattgtgttctcgcttaaggacctctagttaaaaattgataaatttgtgtgttttatattttatactatttcccatagtaaaattatttattttctttgtttttgcatttgcgtgtagttttgccatttgaattcatatgcgtctaaattatttccaggaaagctttctagctttcttcatgttgttatggtactgtttttttgttttaatatgcgcattcactttgcagtgttcgttccttttccccaagctttattagtcataaattgatatgtaatttattgcttaaaatttgccaaaaacagtttctttatttctacaacacctttgatttttgcaagttacttgttcacccctaatgccttcagttagtaattatcattctatttactcaacttgaaagtaccttatgtaatagcattgtatagcatttaagagtgttacagtgacactaaatatttattaattttgtcagtttccttt

SEQ ID NO: 36263 - DNA, 1176 bp, Mus musculus
ggtagctaggattaaaaggttgtacccccatgtccagcaaagacctgggtttcaatcctcagaaattctgtataaatgcctgacaactttgcacatgcttataatcccaacactgtaaaaaataggtgcatttctggggcttttgggctagccaaaaattgtctcaaaaacttaaggtggtcagcacctgaggaacaggttgttttctagcctccatacgcctagatactcgtacatgtggtaacagaagtacatctcctggctctgtgtttgtgtattcactatttttaccatgtttatgtctcagtaatttattacaaaaagttgttcaacagttccaaaactgggtaagagtacgttttctaccagctacactataatgtagcccagacattgctcgcactcagtatttcttgcctccaaaaatgctgggattataggcagatgatatcgaaccaaacagtaaaggttgatattttaaaaatatagtatttttaaagtataattgtttgtagacagtctcaaatacttatcctttggttgcagagtgaaattcgttctatctcagtaaaccagtggggttcacaattgggtttgagtgttctgagcaagctaagccagttatactgttctctggtgtgggaaagcactgtcctcctctctctatgtacccccaacaggtaagagaatgctcatttctcttaacatctctctttgtttttctaatagacaaagtttgaacagggtggatgagtttgattaaaaaggtccagttttttatccttcctaccttctagcctatggatttaactgacaaattataacatcctctgaatgtttaatatgatttcctggagatagttgtgttagcacaatgcaaacaaatcttgtttgttgcttcttcaagaatcaaaatttttttttattgcacttaggatagcttaggtgctcttagaggtactgcccaagcagtatataagtatatatgcagaatataaattgtaatagcacttaattctgtttgttttggttttttgtttgtttgattatttcccttgttgtagcctaccatctggatgtgaatttggtcaagcggacatgcagaaactagttccaaaggatgagaaggcaggtacgacccagggcggaaaaagatcaggtaactgtaagaaaaat

SEQ ID NO: 36264 - DNA, 1641 bp, Mus musculus
acaggctattaaggaatgctcagagtgtgagttttccctagggaagagcgtaaatggtcagccctgaaaaatttgcatacaattaacattatacagattgaacatgttatatttatcaatatatgagtatacatgtatatgcatttatagcaacaaagaaagaggccatgaatttgaaagagtgagtagtagtatatgggtgtagtattggagtgagggggagggaaggagaaagtgatacaattataacctaaaaaacaaaatgtgtacgaagaggataaaagataaggtacaagtgtattagtgatctttcaatgtaaaatactagttaatactctatttacatgttttgtcttatttgaatttagaactttcaactgggctctatccatgggaggaaaagttcctgtttctgagggattggaacattcagatctacctgatggtacaggagaattcctagatgcctggcttatgcttgtagaaaagatggtaaatcccaccacggtgcttgaatctccacattcgttgcctgctaaattgcctggaggagtccagagctttccacaatttagtgcccttcgcttccttgtagtaactcaaaaagtgagtattctacattttaaaaccaaagggggaaaaaaactcttcatgctaggtagttatcactacactctgtccatattaaaatgtgaattttgaaaaacaaatggacttggttttcagattagcttttttttttaacaaaaaacttgaagtacatgcttctgattggttcttcttgttgacttaaatgttcccaccctatcatacccaccatctacatgccagtctaactctttgttgttgttgtaactgactcattgtggaaggggcatgtctgtgagtcttattttccttctgaggatttgaattgatggggaaagtcatcatacacttttcaaatggcttacaggcagcctttacttgtatcaagaacctgtggaaccggaaaccccttaaagtatatgggggaagaatggctgagtctatgctggccattttgtgccacattctccgaggggaacctgtgattcgagaaagactgagcaaagagaaggaaggatctcgaggagaagaagaagcaggccaggaagaaggtggctcacgcagagaacctcaagtcaaccagcaacagctacaacaggtagagtgctcagattctacactttcaccttatatatagactctaatgctcaaaaatttttgatttttaacctcgtctcactgtaggcaagactgacttcaaattctgagagttatttgccactcaacttgcttgtaaattttctaagctttcataccactgctttccttggttcttagtttctcaaagcatttttttcctagtgaggaaaggtaaaaggtatggtcccagtactttgtgcagaaaacatatctatattttcataaacatattaattacattgttttcaggaacctgcaaaaatttttttggtagtactgtcaactactttctggttaaacgataaggcaaactattatagctaaatatattctccagtaaaagacttttgaaaaactattcactaaacctgtatgacgttaaaataataacattttgaaaaataaagaccaaaa

SEQ ID NO: 36265 - DNA, 1947 bp, Mus musculus
tatcaaagataatttaaaacaaaaggaagaataggttgtcaagataggaaattgtcatgggtttttggcttggaaaaagaccaagaaatgaagaaaggcctcttgaaagtatattaaatgcccagtacatttttttcctgcattagttttaagcagctgtctactgatagctgctgattattttgacaataaaagttgcaggaaatatgaagatactttatgcatttgcattttatttagtacctacagtccaacagcaacaactggcgctggtttgatgaccgctctgggcgttggtgtagttacagtgctagcaacaacagcaccattgattctgcctggaaatctggagaaacaagtgtaagattcactgctggccgacgaagatacactgtccagttcactacaatggtgcaggtacatgctcaacttataatgtaaactttattgaaaaggggatagtcctctcaggctaaggagtaggactttgttttttaaggacagctttgttttgtctgaattcttaggttaatgaagaaacaggaaaccgacgccctgtgatgctgactctcctcagggtgccacgactgagtaagaactcaaaaagcagcaatggacaggaactagagaagacactggaagaaagcaaggagaccgatatcaaacataaagaaaataaaggcaatggtatgtgccttacattttgcatttgtttttccttccaagtaagtggttgctcttgctggatatatagctcaagctagtctcattcaaaatccttctacctcaaccacccaagtagttggaattagaggtgtgcactttttgtaccatgcatttatttttaatccttttttttgttttaactctgaaagaatggatttgtttaattgtatttagtacctttggaggccagaagattatatcaagtcccctttaagccggacttagagatagtcatgagctgccccacagtagagctgggaactgaactcagtcttctgtacatgatcttattcacagagccatatctccagccccctcattatgagttatattaacatgatttaaggtagtatggcttattatctgaaactcaaagagacagagagatggtcttttcctaagacctttacatctggtcttagaattaggtgtgtttttcagctcaagtgatggctgattattttggaaggagagagatcgagtgaaatgtcaaattgaaaacactttttttttccaatttgtagatatccccttagctctagagagcacaaacactgaaaaagaggcaagcctggatgaaacaaaaattggggagatcctaatccagggcctgacagaagatatggtgactgttctaatccgtgcctgtgtgagcatgctgggagtccctgtggacccagacactttgcatgccacccttcgtctctgtttaaggctcacccgagaccacaaatatgccatgatgtttgcagaactgaagagtacacgaatgatcttgaatttgacccagagctcaggtttcaatgggtttacccccttagtcacccttctcttaaggcacatcattgaggatccttgtactcttcgtcatactatggaaaaggtcagtatttttgaagtcttgtgcctgtctgtatatttgttttttttttttttctttaatgttcctggtatgttgtgcactgatgggcctttaaccattgtaaaaattagaaaataggttcttatattttagaactaaatgaatatatcagtggaagaaatgaaaaaaattataaaaatatttacattaagtataattaagagataaatatcttaatcagcaaatctttgtacctcctaaagacttttgctgaattcttattcttcttactaaatcattttcagtaatcatataaatattagtaggtttcaccctctttcttggaacattagaatttt

SEQ ID NO: 36266 - DNA, 1106 bp, Mus musculus
gtataaagtataaatcatggctttacatataaagcaaaacttctgtattttaaattaagaaatataactggctagataagccagatcttctaacaattacaatatgctatactagataacatgagtagtttgttaaaatacaatatccccaaaagattatatatttctaaaagtttttaatcgcaggatactatacataaatttgatagctcttttagctgtcatctcaaagtgatgattgactaaataaagcatgaagaaattgttctattatgttaaatataattgaactattatagcttaaaatcacagcatttgcggagtcttagagcctacacttaaatgtggaagctatatagcatgtgtaatcagatgcacctcaataacattcatgtaagaatttagttttgaaaacctttatgacttgtatatgagacttattttaattgtaaagagtcttgaagaacaagcgtatctttcattacttaaattgacaatgctttttactaggttgttcgctcggcagccacaagtggagctggtagtactacatctggtgttgtatctggcagcctcggttctcgggagatcaactatatccttagagtcctaggaccagctgcctgccgcaatccagacatattcacagaagtagccaattgctgtatccgcattgcccttccagcccctcgaggctcaggaactggtcagtttcatttgctactattctttcagaaaattctctttaggcagatattgagacattggttgagcatttgacttagtaaattctgtatgtaattctcagtaatttctcttggcctcttaatacaactcccaaggattcactctagtctttacctacaaagtgttcattttgatgtgacaatagaagttaaattaactgcagttggtttctgtatagtgcgatcattgaaaaacaattgtttgtttgggtgacagaatccaatgaaaagtttacagtgctacctgtattcttaccaaaaagttaatgcctgtatttcattgaggaagtaattacatttatatcaaattatggaaatattttactgaacagctagcctaaacccatggtaaacacgaat

SEQ ID NO: 36267 - DNA, 1225 bp, Mus musculus
ttattttactggccttactaacagcatattagtcaaagaaaactgtctttgcccttagtatgtggcatgctatattggatgcctacctacagcttaagaattttgtcaaatgagggagacggcaacaattgtaactaatggaatgaacacatacttccatgagatatagagagaccaatatttccatatgtatctagatggcacttgagttgaattgcatagtgtgtagtaggcaaaagaaaggagatggatatttaaagaattactactaattcattatttctaggacatgaaattgcataaacatcaggaaatagtgggtgcctggatgtttggtccaagccttcctactatgtcttatgcatattcatcatctttgtcatttaactacagtggtaattagtgatttgtacaagtggcctaaaatgaagaaatactgtcttcattctacctgtggcttggtttttaatgttattccagtgtaaaattgagtgtttacctgttttctcaggagcttcaactccagaggagactcgagaagggaagaaagataaagaaggggaccgtacatctgaggaaggcaagcagaaaagcaagggcagcaaacctttaatgcctacctctactatccttcgtcttctggcagagttggtgaggtcctatgttggtattgctaccctgattgcaaactacagctataccgtgggccagtctgagctgatcaaagaggtaatatttacagttttttctttctttgatattttggttatatcctagactgtgttggaaactataatactcattgaaaggaaagctagtcttttcaccatgatgtgaagcaatcagagtaactgcaaggaaacagttgatgaaatcttttgtatcttgtttggcttgacaaatttttagattcttctttatttgagtcatttttctgtttgtcactaacactgtagtattgctatgtaaattatacagatgcatatctctttggtgatgtaggcttaagaatattattgctgagctctagaacatgaatttatatagctttaacagatgctacctgaagtttaccagggtgtatattctagtagtttatgagagttctgattgtctcaccttatgccatcacatatttcattttatttgttccagttggtttgttagtagttttgtggttaggatttgcattttcttattggccatattttaatgttttttggtt

SEQ ID NO: 36268 - DNA, 2593 bp, Mus musculus
acttggaatttgtaaggagaatcagaagttcactgtcttcatagagactttgactagcctgagctgtaactacatgaggctgtcccaaaaaaaacgattaaagacaaaataaaggagtttggagatgtttttgtttggttaattagttggaatgggtctgggtttttttttccttgataatctaagaagtattgatatttgtagtcatccagaatttattctggcttctactcaaggatttctcatgtgcttgtcatagcttcatgaaatatgacatcgacttaacttttgctttactgggttttattcttaaacttaatggaaagttgaaaattctagactttgcgcccttttctctcttagcttccattataagaacctgtatgcttatgagattggcacctattatttctatccttagttcttgtatctttctttatctcagtcccaatatggccaacacagtcaatgctgctctaaaacccttggaaacactttcccggattgtaaatcaacccagtagcctttttggcagcaagagtgcttctagcaagaacaagtctgagcaggatgctcaaggagcttctcaggactccagcagccatcagcaagatccaggtagggaatcagaatgaatggactgcaaaaactggatgggtgggagttgttgcttgtggaattaaactgttctagcttattgttgtttacccgggaacttgctggtcttgcagatatctgtcataatggtgtggaaatctgtcccacaaggaatttcttcacattacagctttgtttggctatcctcacatgaagccaagtctttttcttcatcacacattcatttatatttatactctgagaatttgtaaatttgcctaaagacaaatcactgtgttcatgcttgcctcatgatgcccagcatataaacaccttttgattatttattgtgctggttggttgattgtttcaggcgagcctggggaggcagaagtgcaggaggaggatcatgatgtcactcagacagaggtggcagatggggatatcatggatggggaggctgaaaccgactcagtggtgattgccgggcagcctgaggtgctcagttcacaagagatgcaggtagggaggcagatcattccaacattcttctgttgcggtgctgaaccaaactcccaagtgttgtgggtgggtgagtactttagatcttgcctcaatgtggtcttcagaggagcacagaatgcttaacatgtgtttaaattgttttagttaaaatggggctggggacagagccctttgggtatggtttctttgatttacttggctctgatcattattgaaagttacttagcgctatcttatgccatgccaccagatctcactggagtatttaaataccagtcttctaaggattttaaagaaagcatggtaatttggtagcagtgggtaagaaattgttcctgtatatagcagaggatggccaagtaggccatttatgggaggagaggcccttggtctcgcaaagattatatgccccaatacaggggaatgccagggccaggaagtgggagtaggtgggttggggagcagggcggggggagggtgggtataggggactttcagagaggaaactaggaaaggggatagcatttgaaatgtaaatggaaaaaaatctaataaattgtgcctgtgaaccttagctgctggctctaatgtgatctgcatgtattcctagacagtgttaaaacactaacctggtatttgttgaccaggatacagacagtgtgagtgtggatttattggaagcatgtggtaggctctgtgttaatagcaccaattatgtggtttctgtgtaacatcctatcacatattatagaaacatatgctcccttgctggctttataaaagggtttccgtgctagcacaatgatagacttgttgtgtgcatccatatgtatgttctctttctctccaggttgaaaatgaactggaggacctgatagatgagttgcttgagagggatggcggatctgggaacagtacaattataggtgagagccccagaactgagtaaagcctcttcctttgtctcagtctctcttgggaggaccatttttctcatcatctgcttgctcagctctgcctaagggctcatagccagcctagattgctgcttgtcttgatgttgatgatcttaacagaaaagaaattaacaagttgtttataggcctgtaacaggtctgaagtgttgtgtatgtcgggtggcggtgagggtaacaatcagtatagatgataacatcaggcacaccaaaagtgtttattcatggaggcctagaagaggctgtaggatgagaaaatgcttttctttcagttcttcaatgaaatccaggggctttttgcctttgtgtcttaaaatgtaaaaaagagtggtcattccttaaggatggccccttttaagtctcaaatggaaaatgacaaaggtaaacaaaccagctgccacctcactgtgaaggtgtttatatttttattttactggtcaagaaaaccaaaggattaatggaactaggcatgtattcttaaaagatacaaagctttt

SEQ ID NO: 36269 - DNA, 1396 bp, Mus musculus
tccactttatcctcagccagtttttcaaataacgttttactactgcttgcccaaagtttgtcacttcttacttggttcgctttcttctcacccacctgctgtcatcgctccagattccctcttatcaacaggatgcagtcactagcaaaataggactggaaaggcaaggggacaccaacagacttggtcaagccctacatcgtggctcctcaagcacctccctggagccagcttccacatttcagcaaccctgctcagcgtgtcgatgcattaattggcactctcaggaaatttgggctggctcactaagtctgtacaccaccctagatctgattcttcctctcttagagtcagataccccatcgccttcccactcagtctgccggcctgcacagtggcctgttttctagctactcagtatagtcctccaatgtgctccctttgttttagattccatgaatatcctggaccctgaggatgaggaggaacatactcaggaagaggacagcagtggcagtaacgaggatgaggatgatagtcaggatgaagaggaggaggaggaggaagatgaggaagatgatcaggtgaggggggactgtgtttgggttggttcagatgacctcttccatgggagcacagaactacagaaaaacggacaatctgggttactagctagcctcgtcgcctccctccctcatgtgctcatgtggccatgacaccaagcttcagaaaacacttacctccagcaattctccatctcgtattttcccttaaggaggatgatgaaggtgaagaaggagatgaagatgatgacgacgatggttctgagatggaattggatgaggattaccctgatatgaacgcttctcccttggtccgatttgagcgctttgaccgggaggatgatctcatcattgagtttgacaacatgttctccagtgctagtaagatacaggggctcagctgggtttttacctattgattcttatacccttctctagggtaaaccaagcagaactaaagcagccatcaatctgatagaggacaccacttcttttactgtcttgacatcccaggtcaagggatgtctgaatccatctctctggatagcatacatatccttgcaagaaggaatcggaggaggctgctcttactatctccacctcagtaaacagggagctcttagagcctggacaacttgatgttttgcttgattgagaaaatgagaccaagtctgactacatgaggcacctgaatcacactgcagtgacagggcaatcaataatcttttatttgtaacgctggatctcaaaggtttggatggacatcgctgagcctggcattagggagtggattttatatattcactgttcatcatggatggaactgatccgga

SEQ ID NO: 36270 - DNA, 1712 bp, Mus musculus
gagtttttaccctctataggaacttatggtctgtaaggaattataagtaagaagacaccacatttagtatgctaatgcacagagtaaaggtatatctaacctgacctgttagactttagaagtaacatcttggactgagaacaaaagaacaggtgaggaagggaagcagagtcttctaggccaaggggccagcatctgaagtgcctagagacatcactgttgtcttgaaagtgggctgggaaaaggtaggattacattgaggtggtggcataacctatggttgtatcagatcctgaattaggtgtgagaatgagggagaaaggaaaaagatcacatttccatgtgagcaaagcccaggagacatggttctacacatgaacagccatggaagaaatttatttttggcactgaccccttttgcatattttccttgcagcagacattcccccatccccaggaaatatccctaccacccacccattgatggtacgtcatgcagatcacagttccctgacactgggcagtggttcttccacaactcgtcttacccagggcatcggtcgcagtcaaaggaccctcagacagctcactgccaatacaggccataccattcatgttcactaccctgggaatcgccagcctaaccctcctcttatactccagaggtgagtttgtgttgaagcagaatcaatgagaagttggattcaatgaagctcttaagaattataactgaacttcaacattgtcttgaccataaggataaacagtccctcataaataaggttgtgtgacccatagtaagtgaaacaattttaaaatgaaagagtgaatataagtgccttataaaggtgtacaacaaaggcattaatacctaacatggtacctagcatatcaaagcttcctagtgttcaaggaactaactaaagaataatatgcagttcaatctcgaagttatcaaactgacatgctaataagaatggtagtaaaggtttaggttcagtatgattaaaatctacccataatcctataagtttactagatgtacatgctcgatctcatggttaacagacttctgtggacttgaaagtgaaagtggtaccttaccattaccctacaggttgcttggtccctctgcagctgctgacattcttcagctgagcagcagccttccattacaaagccgaggccgggcccgcctcctagtgggcaatgatgacgtccatatcatcgccaggtctgatgacgagctgctggatgacttttttcatgaccagagtacagccactagccaagcaggcaagtttattcagtaagagggaggatagagttctttgattcttcttcagtcctaagaagaagagtagtctctttcttggagaaactacattttataggagccaaaaccacttggtgacttagccaaggacaacaactctgttgcctctgggtacctgttatgtagcaaaacttgtggcagaccatgggttcttttaggaaaataatgcagtttttaggtcaatcaacacttcataaagccaagaatttcactttattttgttctcttataggaaccctgtccagcatcccaacagctctaacccgatggacagaggaatgcaaagttcttgatgctgagagtatgcatgactgtgtttcaggtctgtgacaacttgaatatcagggtagtaatgagccttccggctagaatgagt

SEQ ID NO: 36271 - DNA, 1141 bp, Mus musculus
gcttttaggaggtttttttttttttctgagtagccttgacctatctatggtatgcaactgttcccttctacctggaacatagaaaggattgtactctctagatcattagagtcatatctctggtgttgagatacagatagtattgttatttagccctcattattatgatatgccatccaagaactgtttctgggaacagattgatttgagaaagattttcatgacttttatttgaatgggtccttaccaggctgcatgtgctgattggattcttcccatggtcattcgctaagttccccttaacctcgaatatcattctttccaataaagatgggactcctatgcctgacagctatccaacaaccccctcttcaacggatgcacctacatctgagtccaaggaaacacttggtaccctacaaccctcccagcaacagccagcacttccacccccaccatccttaggagagattcctcaggaactacagtcccctgctgaagaagtggcaaactctacacagctattgatgcctatagagttggaggaattgggtcccacaagaccaagtggagaagcagaaacaactcaaatggaattgtctccagctcccaccataagtgagtagaatgtcatctttaaaagggcataaaaaagaaaagaattgcaatctttgtaacttttctctgctttcttactttaaagaattaggagctcagaatcctcagtttacactccagctttcttagtagaagctcagatttcttctttgtgtcctcagttaattattgttgtatatcttaatgataagtactaagcatgccataatttatctaggcaatactcatttctgaactaactatcatgtcaggtttgttatttaacttctttgaaaataatgtttcagagttggtggtgccttcattcataaactgaaattctatatcattcagttttcctatcatttacatacctactgctcacttatttaaaatagtgcatcaaaattttcaacaaaatacttttttttaacaaggcaaactgaaactgacttcactataccataatttctatgctgtggactggagagattttttttaaagatgccagttttgtttgtttttgtcagggactgtcacaatt

SEQ ID NO: 36272 - DNA, 1053 bp, Mus musculus
taggcaatattagatttggtcaagttgatgatcacaacataaccatcacaagacagtaaccattacaagagcctttttttttttagataactgagaccactagcatgtttgtgtaactggtacctgcaggaaacattagagtaacaaaatccctacttcagatatctagggacattgtagacgtgtgtagaacaaacgtgtggtacatagaaaagtcttaaggaacttaagggcagttgagatggaagagtgggcaatagataatcaagtggtagatgagtctgtattaactgttgcaaaaggaaacaaccctaccaaagactttgcctgtcataaccttgattcaaagtagccatctaatttctcactcttaacttccttctagcctctctttccccagagagagctgaagattcagacgcgttaacagctgtcagcagtcagctggaaggttctcccatggacaccagcagcctggcttcctgtacgttagaagaggctgtgggtgacactccagcagctggcagttctgagcagcccacagcaggtagttccactcctggggatgcgccatcagttgtggcagaagtgcaaggcagacctgatgtatcaagagaatccaaccagccacctgaggacaggtaagtactatatagccaagaggagattaggaatgcattagaagttatttcaagctaaacactatcaggcatgcttgttgcactgtgattgatgtgttctatctgagatgggtattaggaatgtttttgttgtttggtttgtgtttgctttttatggggaaactgtataaagaaggatgatttctttccctagctccccccctgcatcctcggagagttcttccactagagattctgccgtggccatctctggagcagattctcgtggaattctagaagagccactaccttcaacaagcagtgaagaagaagatccccttgctggtaagtttctgtttccaaaaaaatcattgcttggacagacataaccctccaaacactttcctccaggtcggtgtgtgagtcgggggtg

SEQ ID NO: 36273 - DNA, 1159 bp, Mus musculus
tcttctctatatctttgcaagcagtggaaacacaaatggctgattttcctcaacccatgatttgtgtttcttttctctgagtatacctttgaacatccatgaagatgtaagttcctttacatcttacaatctctttaggtatcagtctccctgaaggtgtggatccctcctttctggctgctctccctgatgatatccgtcgggaagtcctacagaaccagctgggcatacgtccaccaacccgaagtgctccctcctcaaatagctcagctcctgcagtagtggggaaccctggtgtaactgaagtgagccctgagttcctggctgccctacctccagctattcaagaggaagtatgtaagcgggaacatggtgagaacagttttagcttgaaaagagctatactcttactgatttcttttcttctataggtgctagcacagcagagagctgaacagcagcgacgggaactggctcagaatgcgagctcagacacccccatggaccctgtgactttcattcagactttgccctcagatctgcgccgtagtgtcctagaggatatggaagacagtgtgttagctgtgatgccacctgacattgcagctgaggctcaagctctaagacgagaacaagaagcccgacagcggcagctcatgcatgagcgtctttttggacacagtagtacttctgcactctctgccattctccgaagcccgggtacacagggaggcaagtgggagggctctggaatatcttgcttggccttgttttttaattagcctcctttactacctgttagttgtttgaacccagtttctcctcagttcaccaaattcagtttcctttttcttttcttgtagcttttaccagtcgcctgagtggcaaccgtggggtccagtatactcgccttgctgtacagaggggtggcaccttccagatggggggtagcagcagccataataggtacccttgtctttttttttttaaacctcactatactaccttctgagtcccttaattttgtaagtagagaagctaaaagattttgtggcggccaggatgaccattctgggctattttccttgaaatgagtagacaagcaaaatctgtttaaattccaagtgccacagctcaaaaaggcaggctagcagcagat

SEQ ID NO: 36274 - DNA, 2374 bp, Mus musculus
acttacgactaactaggatgaagcacagtagatttaacattctaaaacaattatagaaaagatcagtccttataaaagaatggcagctccttaatctagaaaaggcaaaaagcaagctgtggctcatagaccttagattttcatcacttagtaaatgataaaaatatgaatctctgctctcttcatagtcatgtaataaagagcaaattatctgatttgtttgagcttttttcactcacagtctcaataatgctgtacaacatccttcagggaaagaagttgtaaagtacctggtatatgatagatacacaatagacttgttgctgtggattgttttgtcttcttttacagtcttcctgggattatcccactcgttcttctctcatgtacctcatatactgatcctagtgctttagctagtgttacccagaaaccatgctctgtttccaggccttctggcagtaatgtggacacactactccgcctccgaggacgactccttctagaccatgaagccctgtcttgcctcttggtcctactttttgtggatgagccaaagctcaatactagccgtctacaccgagtactgagaaatctctgctatcatgcccagacccgccactgggtcatccgcagcctcctgtccattttgcagcgcagcagtgaaagtgagttatgcattgagacacctaagctctccacaagtgaagaaaggggcaagaaatcaagcaagagctgtgcatcaagcagtcatgagaaccgtcccctggatctgctccacaagatggagtccaaaagttccaatcagctctcctggctctcagtatcaatggatgctgctttaggctgtaggactaacatattccagattcaacgttctggagggcgtaaacatacagagaagcatgcaagcagtggttccactgtccacatccacccccaggctgctcctgttgtttgcagacatgttttggatacactcattcagttggccaaggtgaggagcttgaaggaatccttgaccccagggttttttgggcatcaacaccttgggtgagatctggacagtaaagggctaacagatctctttgttgatttattttatattgtgccatttgctgtttctgagaaattgtccaataaataacttcatggagttttatctctgttctttacaatttttaatgtactatctcagtcatcgaaacaactgtttacactctatatgattcttgttttacagataaagaagctgagattcagagcactttagtggctttgtcgtttgactagaaagtgacaagctcagtattttttgaataataaacagtgctactatgtattgggggcccacctgtactaggcaccaggcaaaatgcatcacctcatttaatactttgtgtcgttctccttgtttcattaagtgcagagagacaaaagatttagaaagatttttaattttgtcttgcttcaaagtccttatttttttaggctgcttcaccatctactggatagaagtcatataatccatctgtcttgtattagcagagctggaaaaggaatagtctgagaagcaattgtcttttcctgtcaggcttatcctttacagagactccttagatcgaacctattcttttccctgcaggtgtttcccagccactttacacagcagcggaccaaagaaacaaactgtgagagtgatcgggaacggggcagtaagcaggcctgcagcccatgctcctcacagtcctccagcagtggcatctgtacagacttctgggacttattggtaaaactggacaacatgaatgttagccgaaaaggcaagaactccgtgaagtcagtaccagtgagctctggtggtgaaggggaaacttccccacacagccttgaagcctctccactggggcagctcatgaacatgttgtcacatccagtcatccgccggagttctctcttaactgagaaactcctgagactcctctctctcatctcaattgctctcccagaaaacaaagtatcagaagtgcaaactaactccagcaacagtggttcctccactgctgccacctcaaacacatctactactaccaccaccaccactactgccactgcccccacgcccacacccccagctgcaactacccctgtcacttctgctccagctctggttgctgccacagctatttccaccattactgtagctgcttctaccacagtgactacccccacaactgctaccactactgtttcaagtaagtgtttaaagtcagagctatggggtatgggctcccatcttactctcacttcccaatccagataatattctctaaatcataattattgtgagaacaggatgtgttcattcttagcc

SEQ ID NO: 36275 - DNA, 3037 bp, Mus musculus
aaaagaactggaggaatctcatgaccagcatgcagtattaggtgagttgctctctgaggttacagattcccagccccttggtctgctcttggacactctctgtctggtaatggtgctggcgattatcttgctttttcagtctaagtttgttgaactccctctgtgtgtctgtaacaagaattcaaaagaactgccctctcttagttaactctggtacttgtgatttgtctttataattgattgcctgttttgcttttctaacttcctctttttatttgtattaccctgcaagtttaaattattctatgttttatatttgtgatgtgtttatgggaaggttaaactttataaagtttatgttaaactttgtaaagtgtcactttgctgtcattgctatcctccagtgctacagcctgctgtcgaggccttctttttggtccatgccacagagcgggagagcaagcctcctgtccgagatacccgtgagagccagctggcacacatcaaggatgaacctcctccactctcccccgcccccttaaccccagccactccatcctcccttgacccattcttctccagggagccctcatctatgcacatttcctcgagcctgccccctgacacacagaagttccttcgctttgcaggtacatggaactcttagacccatagattttatccctatctaattaagcaaaatgagagagttggcaaacatgcttgcatactaacatccaacacacactttggaaaaaaaatagacctagttaattacaggagagttctgctatagaacttcttagattccttgcgttccaaaggatttgggttttattgtaaagctaggtgttataaatgcccattcatcccttaggagtgtagcccttgcctttagctatttcctgatttaggcccctaaaacaaataaaaccaagttggttgctagtagactgttttgtagtttcttaggacctataatatgctgattcctgctgttatcttttctctcagagactcaccgcactgtgttaaaccagatactacggcagtctaccacccatcttgctgatgggccttttgctgtcttggtagattatatccgtgtcctcgactttgatgtcaagcgcaagtatgtaccctgggatatattggggtgaaggactatataaacgatacctgtgtcaccttccaggggaaaaaagctatagttgttcctagggttataagggtttcttggtggtactacatttctaaagtcccctctcagcctttagagtcatagcagcagtaatatagtcaaaatgaggttcaagactccttccttgtcatctctactccttcttatacagataaatgtgctttcttgattgttgcagaaatcaaattggctctgtgatctctcattcactagaaataggaaaattttgaattcgtaataaatgatctagcccagctgctatagactttccgggtgtgggggggttaaaagatcaaagggaacatgtcactgtgagttttccttctgaacagacagatataagtttgctttaatcacccccaatcctacttcctttccttttctacatcctaagatatttccgccaagagctggagcgtttggacgaagggctccggaaagaagatatggcagtgcatgtccgccgtgaccatgtatttgaagactcctatcgtgagctgcatcgcaaatctcctgaagaaatgaagaatcgattgtaagaactcaggagagaaaacagctaagatgattcagggcctatatgctatatcgtagcagtgacctaatgtggcctcaagtttaggggaagtggtcacaaaactcccagtagcattctggcttagataatgttaattgagcttcctgcatttggacttggactgctgacttagtcaccaagttttaggcagacaaggatgtctttaatgcctttgcagtgcaagcttaatatattattaggctaggaatagaaatttgcctgcaaagcagattggtaaccctgggtttgggaggcaccatgtgcttgagtgccaccccccactccacccccagtcagtaattgttcactggtgaagccacctggaagaaattgatagcttgtagccataagtatcacagtagctaatgagacagattaaaatcatggtctctcctggtactctgtttacttcttcatctaacagtggactctccaaagtcagattcacagaatctttctcccttacatgatgctacatgaatggtcagatctgtcctggctttctgcacagctctcttatttctgctcttatgcaggtatatagtgtttgaaggagaagaagggcaggatgctggggggctcctgcgagagtggtacatgatcatctctcgagagatgttcaaccctatgtatgccttgttccgtacctcacctggtgaccgggtcacctacaccatcaatccatcttcccactgtaaccccaaccacctcagctacttcaagtttgttggacgaattgtagccaaagctgtatatgacaaccgcctcctggagtgctactttactaggtctttctacaaacacatcttgggcaaatctgtcaggtgagattatggtagcctttagactgcctttttagccctatgactctcttatctttatcccccttttatttctgttcctcaagccatgaccctatctaattgcatttttctaggtatacagatatggagagtgaagattaccacttctaccagggcctagtttatctgcttgaaaatgatgtctctacattaggctatgacctcaccttcagcactgaggtaagttgggggattactttggaactgactctctgtatcaacagttctgagaaagcactttgacttcatcaaacaggaaatagaattggtaaaatagtccaagctgtctcctagtttctcctcagtgggtaagagcacatgttttgcaagccttatggcctgagttcagatctgacacccaggtatggtcatgattgagtgcttggaacttttgaa

SEQ ID NO: 36276 - DNA, 1149 bp, Mus musculus
cctgcacaaacatgaccaagaagcaagttggcgaacaaagggtttattcggcttacacttccatactgctgttcatcaccaaggaagtcaggactggaactcaagcagatcaggaagcaggagctgatgcagaggccatagagggatgttccttattggcttccttgctctggcttgctcagcttgctctcttatagaacccaagactaccagcccagagatggttgcacccacaaggggcctttcccccttgatcactaattgagaaaatgccttacagctggatctcatggaggcatttcctcaactgaagctcctttctctgtgataactccagcctgtgtcaagttgacacaaaactagccagtacaggtgtcaaactgaggctgtattaactctgttcagttgtatgagttctgattccatgtcacttttttttttttttaaaccaggagccatccgcaaacagctggcagccttcttggagggcttctatgaaatcattccaaagcgcctcatatccatctttactgagcaggaattagagctgctcatatcagggctgcctaccatcgacattgatgatctaaaatctaacactgagtaccacaagtaccaatccaactctattcaggtgagcggaggtatccccatactcttgagaagtatgaaacacttatcagtgctggtttatggataacagtatacctatgcctctttttgttcttctggagctgatgttctcacctatcctgtgaaggaacaaaatatttcaagtccattgccatttccttaaatttctttacaagctctctttggctttttgtgtgtctcttcttacagatccagtggttttggagagcattgcgttcctttgaccaagcagaccgtgccaagttcctccagtttgtcacaggtacttccaaggtacccctacaaggatttgctgcccttgaaggtatgaatggcattcagaagtttcagattcatcgagatgacagatccacagatcgcctgccttcagctcacacatggtaagaaaacaacttaaaagtttctccttttcagtgattttattgaggttgtagacttgatgacttctagacacctacccaagattgggagcacaagtatggcctagtctacaac

SEQ ID NO: 36277 - DNA, 1600 bp, Mus musculus
gcttttgcagaagattcagattcagttcccagcacccacatgatggctcacaaccatctataactgcagttctcagttctctgatgccttctggcatcaacaaacacacagtaaggtgcacatacagacagacaggcaaaacacttaatatacatgaaataatcttgttttaaagtgaagccttaagggatagattaaaatttaccaactcactatatatgtgactgccagctatctcttctccagtgcattaaactttaacctataggttaaggccatggtgtataagttatagtaagagccaatttatgttgctagtattgaggccagattagcaagttggagaaaaaaatgggagagtcagcaagaagcagtgagtacatgagctctggctcagaaaggagcagaaggtttcattgttcttttctcatgaatttaatctttattcattctagttttaatcaactggacctgcctgcctatgagagctttgagaagctccgccacatgctactattggccatccaggaatgctctgaaggctttgggctggcctaataaataaggccctgcctacttctgtggggtttttctaccattgttggacctggggaggggggtggatttaaaagatccagaaagaaaatgtcaaaatccaataaatgaaattcaccaactcaccatgtgtgtcccagctgcccatcttccctagtgcatacctgttcgcttctcattctcttttgtctcccctttcctcgcctctcccttttccatgccgtccatgatccccaccccatgtgttaagaaggcagtagcctttacagggacctgtttgtcccaaatgaacagtgtgctcctcagattctgtgttcagaaggatttgctgcattgagacttgaaacctttggataggggaaaaattatatatatatatatttttttgttctgtttgcatttcttaatttgtgcttggaatgtgttgatgtgcacagctaatgattcaatgcgagacaagattggcatctgtgttgtggaggtttcaaataaagagcactcttcataactcacttttcacaacggagtttttttcaaactgaaaaagaaaaccccatcttatacacatactagacaaatgaactttccagaaaaccatttctgcccttcctgatcacccacccacctccacttctggtatagaacttcttccttcagtcagtttccccagagaaaagactgacagacaccgggaattggggggatttttgttatttaaaatgggtatttggaacacactgcagcaggtactatcaaaacagttaacccatgcaatgtttcgtttggtaagcatttatgataatctcaagtttaattttcttaaaagttttggtccctttctagtaaattttaataagcaaaatatttgactagctcgccacaagaccaccttttttgtctgtcttgtcatttgtttgcaagtattcacagattatctagtagtctcttgtggtttttactctatccagcactttatcagactttgatggttccagccttgaacaaaaatttaataaaaaatttagttagaaaaacaatcccaagt

SEQ ID NO: 36278 - DNA, 1169 bp, Mus musculus
tgttttctgggggaggctgttaagtcttgtggctttttagttaatcttgtctgattccaaaagcaatagtctgtcttaggaaacatatagcttcactttttaagcttctgatataagtgaacatagaggcaatgtgatttcttactcggttctgaggtgctaattgggtcttccatcttttaacatgtttattcagtccttaatcttcctcttagccaaacttctatctttggaaggagcattagaattgactgctgtactagtctaaattgcttgtagccatacaagtctaacaagtccctcccctcgggctgttccccttcctatcttagtggtatcatatagtacaaaagtagaggactgactgcaccaacaagcagcaatgagtgtattcatggtagcttatacagatttttatcttgcccttctttgtaagctagtaattgggattcctaagccttgtgcttcagtttcccttcttcctttatattcagtatggccgcctcattgacctctgccagcctacacaaaagaagtatcagattgctgtgaccaaggttttagggaagaacatggatgctattattgtagactcagagaagacaggtcgggactgtattcagtatatcaaggagcaacgtggagagcctgagaccttcttgcctcttgactacctggaggtaaggcttgtgaaggggtttggggtcaaggcagtgttatgggcccctcaccttggctttatgtattctgttgcttcataagattcttcacacaggtgaaacctactgatgagaaactccgggagctgaagggggccaagctagtgattgatgtaattcgttatgaaccacctcacattaaaaaagctctgcagtatgcttgtggcaatgcccttgtttgtgataatgtggaggatgctcgacgcattgcctttggaggtcaccaacgccacaaggtatgcaccctccccccctttctcaggttggagttggacaggctcagtgtcttagtcagggtttctattcctgcacaaacatcatgaccaagaagcaagttggggaggaaagggtttattcggcttacacttccatactgctgttcatcaccaaggaagtcaggactggaactcaagcaggtcaggaagcaggagctgatgcagagccatggag

SEQ ID NO: 36279 - DNA, 1153 bp, Mus musculus
caattgccaaataccagcatgctttcaagtttctgttattccaagtgtccccttcagaatggagtacttccttgcagtcctccctcatctccaagtaacacgagtgctgcttcctttgctggatacccaaagtatttcttatgggctgctatggctgttttcagttgttatgaatagagtactgtgtgcctcttgaaggcagatactagattttcctcatctctgccatagaacactatttattgaatgaataaaactgagaagactgaagactaataaagacttctcatatctgtatttatctggggaagtggtacatgcattcaactgaactccaggccttgaaagactagcctatttagggccatgaacaacccagcaaacacctctggcttctaacagagctctctggaacgggatattgtctggaggggcctggtgtttgaagactgggaagggtctatattcataaccctttgcttttctctggcagattgagtcatacgtatgccgaatgtgttcccgaggagatgaagatgacaaactcttactgtgtgatggctgtgatgacaattaccacatcttttgcctgctgcctcctttgcctgaaatcccgaaaggtgtctggaggtgtccaaagtgtgtcatggcggtaaggccttcccagtcccagttcacatgggatatctttgcctgcctttgtatagtcttaaggggagccttctgcctcagctatagtattactgtgttttgggacctcaagttctgcagagctttgtgagaaaaagaggatgtaatttatgctcctatcctctgggagctcccagactatctatggggtattacatttagatggactgtgtgtgatggtgaactatgtgtgctgacatgtaagcagatattaaaattgatgttagaaaccctgagttgagcctggtctacaaagtgagttctaggacagccagggctatacagagaaaccctgtctcgaaaaaacaaaacaaaaaacaaaaaacaaaaaaaaaaaacaaaaaaaaaaagaaaagaaaagaaaccctgagttgtagttgaacagatagaaaaggtgggtttgttggttggttagttggtttggtttgtttagttgtgatagggtcttattctgtagcaccgg

SEQ ID NO: 36280 - DNA, 1482 bp, Mus musculus
gaactgaacctggctcttctgcaagagcaacaagtgctctgaactgagctatctctgcagcccctgagagaaacaatttaaaggaaaaaagatcttggctcacagttgtagaggtttcagcccattatgatggggaggtgcttatggctccactcacattattataggtagaaatcagaaagacaaagacagtgtacggctgggcaaagatactgcctccaaggaactcaacgtacaacctactttctacaactaggccccacctccagaacactatagaacattccaaaatagcactaccatcttgggacaaagtctttaataggtgaactttttgggaaggacacttcaaaccctaacagtgagcagaagtatgagagaaatgcctgtggcatgaatacatgtgatgagctagctcatgtgggaggaaggaaaagatagagctgcaaagcaaggctttccctaggatcctggaaggctgagtgagagcaattctccctccctccctccctccctccttctgtctcatgtttcagttccacttgagatgatttgctctttgcctctatttttatgatttgttctcgtttgggttacaggagtgtaagcggccccctgaagcctttggctttgagcaagctacccgggaatatactctgcagagctttggagagatggctgactcctttaaagctgactacttcaacatgcctgtgcatgtaggtgatgcagggctggggtagtgctgagactaggttcataggcactggtactgtacctccctaaattaatgttgacaggataagatgtcatttactatcctgttcccccagatggtacccacagaacttgtagagaaggagttttggcggctggtgaatagcatcgaggaagacgtaactgtggagtatggggctgacatccattccaaagaatttggcagcggtttccctgtcagtgacagtaagcggcacctaaccccagaggaggaggtgagtgggtgattctcatggttatatgtcatgttacatgagcttgggcaagttatttagtatctgaaagacatcaaaatcccttttgatgcctgcctcaggtagttactttgaagtgtagatgaactgctatagagtaaagaacacagcctaggtagtatctggaatgtgcatggatgagatgctgttttaaaaattcttcttgccaggtgtggtggcacacgccattaatcccagcactcgggaggcagaggcaggcggatttctgagttcgaggccagcctggtctacaaagtgagttccaggacagccagggctatacagagaaaccctgtcttgaaaaaaaaaaattcttctctcatacattacatcccaaccactgtttcacctccttccagcctcctcacctcgtgttttctctcccccatatccactcctcttcagaaaaagaacaggcctcccaaggatattaactgaccctctgaacctg

SEQ ID NO: 36281 - DNA, 1144 bp, Mus musculus
gaaggcaggcagagccagttttggcaactgctgaactttgggggtcagtgataggccctctctcaataacattctcaataacatagagaatgatagaggaagatacctgatgttgacctctggcctccacatgtatattcacacttgtgtacccacacaaacatacactgaaaatatactacacacacatacacacacacacacacaagaaaatgtaaaaaaaaaaatgctgggcttggtagttttcacctatgattccccagctactcaggaggttgaggcaagaggatcataagctcaaggcctgctagggtaacttagtgagactgtgtctcaaagtagaaggaactcaggttacagtgatagaacgaacatttgcctagcatttgtgagcccagagttcaatcctcagtcctggggcagaaactcagttccttagcataatcctcatccttctgtacaaacacttgacctgacaggagtatgctacaagtggttggaacctgaatgtgatgcctgtattggagcagtctgtactgtgccacatcaatgcagatatatctggcatgaaggtaccgtggctgtatgtgggaatggtcttctcagccttttgctggcatattgaagatcactggagttactctattaactacctccactggtgagtggggctatggcaagctggggaggtagtcagggtgatctccctacataactatgcacatgaccattctgtgtcctctaacgtgaacaggggtgagccaaaaacctggtatggagtcccatcgcttgcagcggaacacttggaagaagtgatgaagaagctgacacctgagctttttgatagccagcctgatctccttcaccaactcgtcaccctcatgaatcctaacacgctcatgtcccatggtgtgccggtgagtgcccagaaaccataggaaggtataggaatgatgtactgatgacttttatgctagcaattgtagtcttcacttgtggtttatccctgctttctcttattcctcttctgccttgatgggactgttttgaggtctgtgatcatcgtggttggttagatatgcaatgtgatagtgagttctttccatgggtttgagggatactttaggctaccttagggatagct

SEQ ID NO: 36282 - DNA, 1194 bp, Mus musculus
tgctacaatgcccagctcctaatctgaatcttacccaactttttctatcttcttctcttttttttgtcctgaagtccatactgatcttgtcaattatgatccatcagaacccctgctttgagattgtagagttgacagaaggcagatgtgatgtgaagcttggctttccagtcttcacaaccatcatgaaaggtttgagttactctgatagtgagatgggatttctgccaccctgactggttctgaacaatgtgtgggttgtatgccccagggtatcaccgaggctgagcgagaggcttttgagctgcttccagatgatgaacgtcagtgcataaagtgcaagaccacatgtttcctatctgccctggcttgctatgactgcccagatggccttgtctgcctttctcacatcaatgacctctgcaagtgctccagtagccgccagtaccttcggtaagtctagggcctatatgaaggaaggaggagagtgccaagttgggctaaagtgtactctgcgctgtgcttttccaggtatcggtacaccttggatgagctccctgccatgctgcataaactgaaagttagagctgagtcctttgacacctgggctaacaaagtacgagtggccctggaggtggaagatgggcggaagcgcagtgagtgactggggctgggggttgggatggggaggttagagggactcttcagacaagttctattcttgtttcttctgtatctctggcccttctcctctgccttgaattaatattgcctaatccttcctgctctttctccaggcctggaagaactgagagcactagaatctgaggctcgtgagcgaaggtttcctaacagtgagcttctacagcgactgaaaaactgcctgagtgaagcagaggcttgtgtgtcccgggctctgggattggtcagtggccaggaagctgggtatgttgatgtgaggtgaaaagtgtgttacaaggggtggattctgaatacagtggggtccttggaacattagcaggaagttgccaagtatgaggtgatagcctgggaagtactgcagagtgcaaggataggcaacttttcatggagaatgagagccttgacaataagaaaaattagaagtgtttataatcaacatctgtagaagatttgagaggtaggttgagggagtttgtgagcagggaggagtgt

SEQ ID NO: 36283 - DNA, 1256 bp, Mus musculus
gtctgagccctgtgaccatgggcagaccacttgcttcctgagctcagttttcctggtttgggagtggggtattgcgttcagagaacgaaagaatcagcttgtttacctattcttccccctttcctgggcacggcagatcgtggccttcaaagagggggagcagaaggagaaggaagggatactgcagcttcgtcgtaccaactcagccaagccaagtccactggcactgttgacaacagcctcctctacagcttctatctgcgtgtgtgggcaagtgccagctggggtgggagctctgcagtgtgacctgtgtcaggactggttccatgggcgctgtgtgacagtaccccgcctcctcagctcccagaggtccagtcttccctcatccccactgctggcctggtgggaatgggacaccaaattcttgtgccctctgtgtatgcgctcacggcgcccacgcttggaaaccatcctggcactgctggtagccctacagagactgcctgtgcggctgcctgagggtgaggctctacagtgcctcacagagagagccatcagctggcaaggccgtgccagacaggttttggcctctgaggaagtgactgctctgttgggacggctggctgaactgcgccaacggctacaggctgaatccaagcctgaggagtccctggcttacccttcagatggtggagagggcactggcaatatgccgaaggtgagctgcttagcctagctcttaacttcaaattcctgtccccctagctctgcccctgtttctcctgttttaaatctcctttggcccagcctttttgttccatcctattatctgtccaaattcctaaaccctgctctcagctgacaccccatgtttgccttcctccaagagatagtcttccaggtttggcatgggtgaaggaagagtagggcctggctcttcagttcagttaccccttgccttttcctgatcttgatatttgataggtccaggggctgttggagaatggggacagtgtgaccagtcctgaaaaggtagccacagaggagggctcaggtaagagaggtaggtctagctgtagtgtgagtgggatgttgaatggatattatcagtgtggcccctgatgtcctcagctttgttatagcggtgtaggataagaccaagggaagcctctaatccatcctgtccctgcatcttccagatctggagctgctatcctcaatattaccacagttgtctggccctgtgttggaactgc

SEQ ID NO: 36284 - DNA, 1973 bp, Mus musculus
acaatttagtctttttgccttctgtgttcacagctggagaaggcagagcgccatgggagtcggacacgaggccgagccctagagaggagacgacggaggaaggtggatcggggtggggagccggatgacccggcacgagaggagctagagccaaagagggtacgaagctcaggaccagaagccgaggaagtccaggaggaagaggagctggaggaggagactgggggtgaggtccctcctgtacccttccccaacagtggcagccccagcatccaggaggaccaggatggcttagaaccagtgttagaggctggttctgacacctcagcccctttctctactctgacttcccggctgttgatgtcctgcccacagcagccatctctgcaacaattgtgacagtggctgagcctagcacagaccccaacaaagatccttccttggcctcaaggatcctttctgaccatcaagcctgcttcttggaggtgggcgggtaggtggagagacttccccctcaccaccatccccaagatcgtgacttttatattctgactccaaggtattgttcagacctcagctcctgggggccggcccctggagtcctgcgtccctggtaacctctaaccagcattcccagacaccagaggcagatagacaggtgggcaggggatctactggggctgggccagcaccattccagagacaaatccagggcacatgcaaactgggggacctctcccttatccccagttctgaccctgggtcaggccatgctacactaaccttccctccccacttcacacttttgctcccccccccctcccagtccattttacttctttcctctccccttcatcttttcccttccccttactgttccacccaggaggaggaaacttcacatagctgtcctcacccttttattttaaatgaattttgttggggttgagcagggctgcctatggtctgaaggcttttggtgcttgtccacacacccacctcaacccttcctgcccatcctcccctatctcctttcctcctcctgggttcatgctgtaataaagaagattgttggtgtgtaattaatttgttcaaaaggagaaaaaaaaaagcaaaacaaactttgtttcaactaaagcctattttaattttattttattattttcctcattagaaataaaacccttaggaatgttttttttttttttttttttggaaacatgtttctgaagtgcatttctcttcaaaaagagagcagaaccttcctcgcctgttagtggagcagctgcagtgccagttagtagtagtgccagggccagggaagcagggctctgaattcaaatctcaccaacttctctctaaccttggaaaagatatccttcctggtcttcccccaagccattgcagactggtgggcactggccccctttgataatttgcacgacagcttcccctagctttgtgctcttgattttctattctctgggggactttttcttcatggctttattgaggtagagtttccatgctataaagttgagctgttttaaatatgtaatttggtgagtcagaccatccttggtgtttctccattagttcttcctgcccctaatgaatgtgtggttaatttgtaacgtctgtgtcactgttaaactgctctgttgagatgaaatgtgcatagatacagttcatccacttcaagtatacaattcagtgacttttagtatatttcagtcattgaatcactgcaaaaagtttagactgtttttacaaccccagaagacattgcctaggtagtccctccttcctcccatttgtctcttctggacattttatataaatgaaatgatacaatatgcgctccttttgtgtctgccttctttgacttagcctattaacagtcctacagtagttgtattttcgcccttctgagcctgaaagaagggactacgcttgatcagggactgacctct

SEQ ID NO: 36285 - DNA, 1337 bp, Mus musculus
taatatacaatggtgggaaggcatatacagacattccagttcaaaaagggcaaaggatatgtgtgtgcctgtagcagttggaaacaggagctgtttccaaactggtccgttacaagttaaatccatctgggcatatgaagttccttgaattgattccaaaactgaggatggtttttcatacccctgtctctgctttctgggctcttgctgtcacctgtgatttttttcatgagaggtagcacatgcttgcaaccaagatttttttttctgtttcctgccagaattttggagggccaggactgacttcttgcagtgcatgtgtaatcaattatcatcaaggcaaaggacttctttttggcatgttgagcattcaacagtaaactacaatgagattggccttcagggcaaccctgacttagagcccatgcctgctatcatggccactttgttcagaagcctattggcaaagataacggtgacaggatagagattggccacacccatagaatggaatatctcttttgagattttctatactggtgcttgtttacgtgggtcatgaaaattctcactgtgctcattccaaaatggacagctatttgcataggcctttttcctcagatgtctcttcaacatttcagtcttgttatttccaaatccttgactgtatgcagacatgaaccagcaagctgtctatgcttttgactgtttctgtaatagtaacccaaagtggagctgtaactctgaaactagccacttgtagcagaggctagcatgtcctgcagaacatctgtaagccaagcgtgaatattgtatccctcagttgtctggtctcaaggaaactccccatggggtctcaaaggaggaaaaaaggatgacaatgtagcaagtgtgagtttccagacctgcacataattttagcggacatgatggaacagttgcaaattattgtttgatgtcatggactcagatgttcatttgagaaaatgaaaaagtccacttttctatttttatttttctttgcttctgagatcttgctacttgcagttttgccctccatttttgtttgttttgtcttataaatatgttgtatcttgggccagtgagatggcccagtgggtaaaagtacttgctacacgagcctggtggcctgaattcaatcccagggatccacgcggtaagagagaatcaactcatgcaagttgtcctggtcaccatttgtgtgcgtgcacacataaaatagatgtaataaaaataatttttaaaatgttgtatctctttattatttcctgttgaatcccagaggagaaatgagtcttcctcccctaccagggccc

SEQ ID NO: 36286 - DNA, 1796 bp, Mus musculus
acatgaacttccggaggacacattcaaacaatagtgggtacatattctttcctataatagagatatctaattgtcttggcaccttttgttgaaaaggaaattattttccccactacattgtcttgacaactatgtctaagtcaatggactatattttataaatataaaggttaatgtctggactctaaatttcatttatctatatgctttatcactcactacacaaggtattgtctttattacttgctatatttgagtagcatgtttaaaattaaaaaaaaatatgagtactccaattttgtacttttaaaagcttattttggctattgaaggcccttactttaccatatgactttctctatcagcttatcagtttctttttaattttgattattttagcacattatatgtctagctagcagtttatctagtgttctagattttccaggagtggttgaagtttaattgtgggttgagagtatttaatctcgtatttgtttttaagacaaggtctgtctgtgtatcccttactaagctagaacttgctatatagatgaggatgctctttaacttacacagatccttctattgctgcccccaaacgctgtgattagaagcatgtagcactatgcctggctggaatatattttcaaaatattccctaataagagacaggaggatttctgtgactttgaggtcagcttggtctacatagtgagttctaggacaaccagagatacatgatgaatccctgtctcaaaaacagaaagtattctctaatgatcctctagattgtattaaaattaattgtaatattcctttttccatctctgatcttaattaattctcacatttcttgtctttagtttggctaggggttcactgctcttgtttttttcttttccttatgttttttttaaagatttatttattttatgtatatgactacactgtagctgtcttcagacacacactagaagagggcatcagattccattgcagatggtgtgagccaccatgtagttactaggaactgaactcaggacctctggaagagcagtcagtgctcttaaccactgagccatcttctctagcctccttctattgttcttttagtctccatttcactaatttctgccataaccttttataaaatctgtctctgtatgcatgtttgtgtatgcatgcgcaagtgcgtgcatacacacacacacacacacacacacacacacatgcctgcactctcaagctaactactgttatctgtggaacccacaggtgtcaggtctccctggagttgcagatggttgtgagccatcctgtatttctctgtgcagtcgtactgtctgggactctctttgtagaccaggctgacctggaacttatagaaatccacttgcctctgcctcacgagtgctggaattaaagacatgcaccaccactgcccagccaatttctcttttgtgttaaatatatcctacctacttttattcctttgtaactatgttttaagttaaattttcagagattactctaggtgttaacaattgaaattacaacttgaaatgatatactttgggtgtgtatcaaaagcttgctgtgctgctgaggcaggaagtgagcaagagcctgtagtacacagcaaaatgctgtcaaagaagggagtgaggggaaagggggactttctccagaataagaaaaatcattaagagctgggtgtggtggtgcactcctttaatcccagcactcaggaggcagaggcaggcagatttctgagttcaaggtcagcctggtct

SEQ ID NO: 36287 - DNA, 1215 bp, Mus musculus
ctatccctaatgtggttggaggtacaatatatataacaatgagagtggcccaaaggtagggcacaaaactggagcctggtcttgagctacttgtaagtctcattgaggagtctctgtttcttggccttctctgttaaacaggtagaaacaccaaggatggggagaaatttatattaagctacttttcagccagctttgatggtggtgcatgactacattcacagcattcaggaggattgccacaagttcaagatcagcctcagctacataatgagtccaaagtaaacctgggttacaatgtaaaacactgtcttgcccccccccaaccccaccaaaacatttttattttgttggtttttttttcaagaaagggttttgctgtgtaacagccctagctgtcttagaaatcactctgtagcccaggatagccttgaactcacagagaacagcttgcctttgccttctgagtgctgggattaaagacatgcaccaccaccagggctacaaaacagtttaatagccattatgtaatgttggtcaccacagatagtccaaggatcttctaattatatccccttgtaggcctgagcatcttttctgtccttatctaggagttcttctagatcagacattttgaaactccctgtcaagtatcacaactctcttcccattcctatgctaatttttccatattcttgctatacctttgtcattctgacaactatagacccaatagtctattttaataatgtgtagtttgcctccttcactattttttaatgaagagcataaaaagtagactctgcatacacaatcctcccacagcttataatgacattttaattgtaatataatagagaaatttttttgtttgtttttcaaggcagggtttctctacgtacagcactggttgttctggaactcactttgtaaaccaggctggcctcaaactctgcctcctgagtgttggggctgaagaacaatgtataataaaacagtatgcacttcaatacgtaaatgctttgatataacttcactaaaagaaataattttacacattatttcatgtatctgacttgtacatgtgacagctacatgtgtattgattgagtggtgactcagaaaccatatataggatatagttccttttccataaatgatgagtaattcttcataaagttctaaacaaaagaacgtgtatgtatatgtctcttt

SEQ ID NO: 36288 - DNA, 3246 bp, Mus musculus
atgccaaggagcttaaagagaacctggaccgccgtgagcgcattgtgttcgacatcctggctacctacctcagcgaggagaacctggctgactatgagcacttcgtgaagatgaagtcagctctcatcattgagcagcgagagctggaagataaaatccacctgggtgaagagcagctcaagtgtttgtttgacagcctacagcctgagagaagcaaatgagaggcacattcctacagaaggtggacaccaagccctggagattaatgcctgagactataagagtgaacccaagcctatttgcccatctctggagagacatactctggagccacgaggctagtaaaaaagcaataatgtcctgctagtatgtgatgatttatttatgattttcatttctgttggtttgctgaacatagtttcatatcacatgtgatttcacagaatgccaggctttgctaaacaacaagggttctctagccctcctttgcagcagtggcaccaatgttcctccctcgtgtagatgccaaatacagtcctacagtgcatgagaggaaagacccttgtgatttagccagacacgggctgctgtgtgttctgtccttgttcatttaacaatgtgagcattcctcattctgtcatggtgacattctctgactcagtaaaaatcagtgatgatatttattcatgtgtggaaaacatgaacagtttcctagtagttaaagactaactataaaatgaacaatctacatattggatccattcattccaagattaaaattatcacataacttgtgtgcatgttttgaaataccctaaacagatatctagtatccttcttgtcacatcttaaatactttctagccaagtgattttaattggataaaagtgtgtctactaataatgttattgcttgctttttatttcctgagaccaatggaatattttgaagtttccttccctggaacactaatttgtgtatatgatctttaatgataatcagtggtttatctctttttatgtctgttaccatgggccacatgccacatgccacataccttaagacttaagactccatctagtggtcagaggtcctgtggagtgactagtgcttacatttgaaacagagttttgtccttaacagttcaaatggcaagatgacaaatagagtgttattcatgaaagctacactgtcattctgttggtttccagttgacaggacagattgggaaaagacatttttaaatcatgtgtctgacttgttgctcattttgtttttgttattatttgtttgttttagaagagtctaacccagattggcttcaaactccctatgtagtccaatgaccttgaactcctgatcctcctgcctccacatcctgagttctgggtttagcagcatatcccacttcatgacttcatacatctatctgataaaggatttgtataaagaacttccaacatccaatagtaggaattgtttgaaaaaaaaaaagtgggcaaaagacttgactagacccttcaccaaagaggatatatgtatggcagataaacacatgggaaatgttcagctaccaatggcgtgtataacttgcttatgttaaatgtgtgtagatttggtgttgttcaaaaggtgtttctgtaactaagtgcatggtaagtgatgagcaagtctcttggtgacttggtatttaggcatcactagtctttgttctaccaagggattatttaattcgtatgttcccctgagactgcagcatatacgaagatttccctctcttagcagtagccacaccttttccaaaatacacatgcacatttacatccatgtgtatgtgcacgtgttcacactcccacacacagttgtcttaaaggaccagaatccatgcttcttgagccagaggaacagacgttgacagcagaagctctggtgaagatgatacagtgtcctccatacagctgagtcaagattggcgagattttatatgcagaccatggatgacatggttgacatcctatcactgtcagtcagaagaaaatctttgcaaaagtgttgattcctgttaaatgaaactattctaccttttgaagttcctgatctgccactgcagcctctttctccttccacttggtcatcctttgctgtgaatgtgggtcatgtcagaaaacacgatattggctctccacaaactatccaaggtgttgcagactattttgtttttaatttacaccaagctatttacctgtggttctttaatcccaaatacagtgttgtgaacattttaatgatatgtgtgtaacatgtgagtaatggaattttgtttgtctgtaacctgctttttcatgttgcttcaagcttgtctgttatgggaaacaatatgtagtgctctagcatgcttgtaatgaaacacataacaattatgaccttcttatccatcccctgcttgcctgttccatgtctgattagcagggacccaagaattccagagagtccatgtacatatgtctatgacttgtgatattactgcataagaaacaatctggtgctaatggttggtccttggcatgcataggcatgggcatgggcacagctatggaactctctgtaaatatactgaccttgcttgtggtcagcttttgtggctttaccctgaactctgccctggcaaatatgcacattcatgcttgatgcttaccacttatcaacagatcctcttgcttgactttaacaaaataaatagtgtctcttcagatgaaagtagaatgtctttatttcctactgtatagctttgtaaaaagaataaaaataccagtgctgggcatgtagcccatggggaagggtttgaacatggtgttctgacttcaaatagtagcatttctcctccagaaaatagcctaagccaggcactgtggggaacacctgcaatcctggtccttagagtggtgcacagctggacccacagcacagtttttccttctatatacgggtgccaaacacatccttaaaggggcatagtagataaaattcttgtgatttagcttgattcaggctgctatgtattttgtcctttctaagtcaacagtgtgacttcttatcacacatgtcataattgtgtgacccaacaaaaatcagtggtaataatgtttagaaatataaatggtttccttgtagttaaaaacaaactaaaataaacagcatacatgttgagtgtactcaatcaaaaattaaaatcttaaatgcattaac

SEQ ID NO: 36289 - DNA, 1194 bp, Mus musculus
tgtgccctcagaaatgccctcttctcccagttcccagtcagttactgttaagtgtcctcctcctcagaagaggaccagctgtactcacaatgctattatcttcagaccttgctctttgcaaacctttctttgtgctttttctccttgtagttcttcctctcatgatttatctggctcatgggagcatacaagcctacagcgcacttctgaccacttcagctccatgggcagcatagacagcctcgaccacagctcccaactctacccatctggacacctctcatctgccaagtccaatagcagcattgaccacctgggaggccacagcaagcgagactcagcttacggctccttttccacatgctccagcacccctgaccacaccttgcccaaggctgatgcctcttccactgagaacattctctataaagttggcctttgggaggcctccagaccaggcagcagccgacaaagccagtctacaggtgatcctcagggactgcaggacaggccatcatgtttcatacctagggttcctggtaacagtagtaaaagtccaaggccggaggataatgttgaacccaaaatagccactcatgggagatccaattttgggcctgtgtggtatgttcctgacaagaaaaaagccccttctcccccacctcttggacttcctttgcgcagtgatagcttttctgtggcagccaggggccatgaaaaagcccggggccctccattctcagacttggccagtatgcagcactttatcaccctgccccatgtgcaaccccggggggaccatagaatggaaactacagatcgtcagtggaagctcacacacctaagcagtggaaaagaaataggaaatgtgggttaccagtcagaaggccacctggattgccgttggctatgctctgatgatagagcaggtaggccctcagggcctccgggcaggctccagttctccgatgtgcactttctgaagtcttaccacgggagccagcaccaacagcagtgcagtgacgagagcccaagggccccctcatcaccaagggaactgcttcatataactcctggtggcggtctgcaagagcctcctgaaccatctcaggatgacaaccctactcaggtgaggtggcctggttctgctcaccagaagctagatgacagagggcggagccactattttcctgg

SEQ ID NO: 36290 - DNA, 1179 bp, Mus musculus
ctgaaagtgactcatagcttgtagctgttaacatttgaattgttgtccctgcatagactccgctccccttaatgacagctgctccctgcttttatttcctgtgtttcttttatcttagtttgtgaggtaaccaggggaacagccaactggaatgagatttcaatagggcagtttgacaaagcagtggtatcttgtttcacaaggccccagcaatcttgtcctctttgagaagcagtgtcctgactttaatgcctgaagggacatggtgatatctgtattcccagtgaagattcttccacagacaaaagagagtggttacttttcgcagggttagctggggaagaaaaaaacttcaactatcatctccagaaagagcacatgttcttcatgatgtccaggtggcattcggggctcttgagcagtagggtgggggactctataagagccagatctgtggggctgtgacaagttgagtcagcatgcctaccttgttctttggtttccaaggtgtttgatgtttcagtgtgtccctttgcagtgctatgtagtttttagtatatatttgtttgtctctatagagttgtcacctgctttgtcctcctcagtgcacagttctgcacctggtgatttcatggataagggctggcatggatctgggctctaaggttttcacggaaggctacagactttttgttggggaccagtgttgcggtaaatcttcaacccaaatatgccccaacaatgaaaacacgactcagttattatgaatccatgctgtgtgcctagattgggcagctctactactacattatctttcacatcaatgagaccccttagaacttgcagtttctccaggccatgtgtttctgctctgcttttcttcttcctcctcctctgcgtcctctccctcttccattttctcctccttctctctcttcaccttctgctccaccttccctttatctgcccaatcatcagctctcgtttattatacaaattaaggatgggaagcaggtttacaggaaatcacctgagtgctgactctttccttgtttgcaacccctccccgaagaacggaattaacattaaacataattagccccagggcaacccacaatttagcagtgttggtttggccactcagttggattaaaaacagaaggaggcagagacacaagg

SEQ ID NO: 36291 - DNA, 1148 bp, Mus musculus
tagaggattacaggtatgtgcttccattctggacttatatttattttttccccctctcctttaaaaaaaattttttttttctgtgcgtcattaagatggctcagctgtaaaaggcactcgcttgctgcccagtctgacaaattgagttcagtcccctggacccacatgatggacagagctgacttcctgaattttgtcttctgatattcacatctatgctatggcatgcatgtatgttccctccttaaataaatataattttatttttaaataaattttaaataattaaaaataaattgtatcctccatgacaatgacaaataataagtatggattttcataatgtataaaatgtatgttattatatatctccttcctttgttgtggcattgttgcacagaacgagagagtgtgcatgctagacccataagttacaccctaatctatttcctttgctatggtttatttaccttgtccatttgggtcatgttatgatttgctgctgctgtggtttgtttgctttttttttttaaagtcagagttttactatatagcttaggctggcctgtaactcaaggtcttcctgcctcagcttcttgagtactgaattataagtacttgagtactggaattataaacattaactgccatgcctggctctactgtactttgatgttcaagcgtcacattgtaatttgacaatttatatagtaaacatagttaattaatgactttttcaattatgacttgtttctttttttcgtttttattacatttattgtgtgtatgtgtttgtgagagagagagagagaaacagaggcagggagcgagggaggggaacaaaaatgaacacacatctttaaggagctggttctgccctttcactttgtgggtactgaggcttgtactcaggttgtcaggcttggaggcaaatgccataacctgctgaaccatctcacgagcccacattttaatctctaaaatatgataaattgccgggcagtggtggtgcaagcctttaataccagcacttgggaggcagagacaggcggattccaggccagcctggtctacagagtgaattccagaacagccagggctacacagagaaaccctgtcatgaaaagccaaaaaaaattcataagttt

SEQ ID NO: 36292 - DNA, 1163 bp, Mus musculus
gaaaggaagaagtcaaaatatcactatttgcagatgatatgatagtatatataagtgaccctaataatcccaccagagaattcctacacctgataaacagcttcagtgcagtagctggatataaaattaactcaaacaaatcaatgccctttctctacacaaaggataaacaggctgagaaagaaattatggaaacaacacccttcacaatagtcacaaataatataaaataccttggggtgactctaactagtgaagtgaaaaatctgtatgataagaacttcaaattctcctctctagtagccgagcaagatgcccaaagggaagaaggccaaggggaagaaggtggccccggcccctgcggtcatcaagaagcatgaggccaagaaggtagtcaaccctctgttcaagaagaggcccggccacccggatatgagccgttctcgcgagagccgtccctctttctaagccagcgatccgtcagggtgaagccatgttcagctcgagcgccaagatcgggaagcccaatggcgagaagccagacgagttcgagtctggcatctctcaggcgctgctcgagctggagatgaactccgatctcaaggcgcagctgcgtgaactcaacatcaccgcagccaaggaaatcgaagttggtggtggtcggaaagctatcataatttttgtaccagttcctcagcttaaatctttccagaaaatccaagtccggctagttcgtgaattggagaaaaagttcagtggcaagcacgtggtcttcattgctcagaggaggattctgcccaagccaacccggaaaagccgtacgaaaaataagcagaagcgccccagaagccgtaccctgacagcagtgcacgacgccatccttgaggacttagtcttcccaagtgaaattgtgggtaagaggatccgtgtgaaactggatggcagccggctcataaaagttcacttagacaaagcacagcagaacaacgtggaacacaaggttgaaactttttctggtgtgtacaagaagctcacaggcaaggatgttaattttgaattcccagagtttcagttgtaaagaaaatgactgaataaagtgtcattcatagtaaaaaaaaaaaaaaaaaaaaaaaaaaaaagaagaggcccaagaactttggcat

SEQ ID NO: 36293 - DNA, 1180 bp, Mus musculus
ggaagaaaagttaccaaaatgcaaaaatgcacagggccctaatcatagggagtagtgaaaacggctagctggcaggtgctgaaattgcaaccttctcctttaactctgagcagcgagtgggcggggccgcgtccatcagtgtctaggtgcccgcaggccgccctaagggccaatggcgcggaaatgagagcccgggccacgtgatggcgggtggcactctggctttcctaaagcagtctctatggtattcttccaagcaaacccagggcccccccaaaagggtagcggcacgtgacaggccctgggactacggcaggttcccacgtgatcctggcctgcagtagcgtggttgcggtgaggttcttgcgctcctgaagggcgggcgcggaagtaagagcatcctcaggcggaccgtgactggcagcgaggtcgggaggagccaccaggcagtgaccgctttgcttctgcagctccgctccgctcattccgttatctcagcctttgcagtctgtacagaagctgaccaagttacctttgggtcttgagaccttggcgagtgaggcccaaactcgggaccaactcctcatccaccttgccctccctctcctccatctcttcctttgcacgcaccgaatcgaatcgcttgctcctttgggctggcctgctcggctgtgcctggagactaagttcgggtcggtaaaggtaactgtgggaaaagcggccccccagtggacaaaggcggaggcagggatagatcaggccccgcgggccctgggtgctgagcgtaggcaggtgagccagaagaacggtactgcggatttagaaggcactgtgaaggacttgttgcacgatggaagaatctgactccgagaaaaagacagagaaagagaatgtgggcccaaaagtggagcctcctctaggggagccggaaggatcgcttgggtgggtaaaggggattatgttgcacctgggagggagggcatgctaattgtaaagagtattgtgagatgcaacaacctctaacctgcagtgatgaattgctttaatttaccaatatggttgattgatatcatgcccttgatgacggaaaacagaatagaaacaccctttgcctggatgtgggattcctggtttatgcgtagtcttctaattgagacagttctgagttgttttctgtttt

SEQ ID NO: 36294 - DNA, 2583 bp, Mus musculus
gacaaatattcaaagcacagaaagatagatcagtagggagaagtattctaggaaaatacgtgggcagtgacaggcaagagcagacctgggagcaccctgtgaacaattacttggataaggtgttagaactgctgttaatcccaagcctcgttcagagggcagcctgttgaaacatcactttcgatgggctccactgtactgttgattcttttgtttacataaggcaaccattcagcgtattacctgatgagaaattgcacactgagcacgttatagagaggtgaggggttgcactaaaggaattttgtttacttcatgccattttgggcatttgttcttctctttctaatgggatggaagaggttttctttctgacactgacatatagaaagcatttttttggatgttttacaacttctattaatacccaagccatttattttatttagatataacaacaagatgcttaatatacatttggttgcccaatcagactgttcataatattctctggggcataaaaccttctgttcctggccctggacctcatatctacctcttcgtggcatatttcctctcctggggaaaaaggagaggggctttgtattagtaggattggacacagcctctcgcctaaaggttttcttcatatgaaacctttatttcttggcagatattcaaaatgttctggcttgaacaatttaggttactacctcctgtggctgtactttctaactaaagcctagaattctaccatccagaaggggtcctgtctacttctacccatccctcacgttttacagatgaggcaaatacgggtcagattctttctccagataattccttgaggccttacagacctgtatacaccgtctcccagggatcacactagtaaaccaaattaaagaaaaagaagttatgtgattggttgcaatatttgtccaattttatgttacacttcagaaaactttaaattcatgtatatttggtgacaaagtaagtagggtgtgcttatggtcatgaccacttaacaccaggcacacagtgtttcaagtcacattttttgataattctagatttgttttaatttaccttgtttcaagtttcaatgtctttgcagagcataaattctccataagttaaggcctacttgtacttttcaacgtggcatgtaggttttactgttactgctttggtaagggatctgtcctgactctgggtgtacaagttccaggctgtatactaattactaagcactaatcaatatctagggctagtctactaatggggaccacaatgtaaaacagattgaaaaatgtatattcctaccatatatgggcttaagcttataattgagtagttggtacaatactatagaacagagtccaaagggttatgtacttctgttccactttggatcctaaatttgttttccagagattggaattggcatgtgccccttagacttcaggatattgagacatatgtttattaatgagcactatgaaattatagtactcataagggtgatcagctgaggatcccagatactgatgttcctagcatctctgagcctttattcaagtatgtttctgcagagtcttaatagactttgcaaatgctttgtccattgtctttagccaagaaccaattctaaccatattctctttgctctttttgttcccaaatggcaaaaatctttccagttacaagcatagtctttacaaatgtgtcatgattaagagaacttcgcagagtaaatgaactcaaacagtacagtgcagaattactgcaccaaaagcacatacgtttgctacatagtgggatataaaggaaaccattccacttctcttggttaacatctgaggtttaactaagtgtaatgggcttacaacagccaaagactgttaggatgacatttgcctaggatatggaaattgtgtctggatggataatattcaggagtttattgtagtgaagtttctccctctgtagacatctggcagctgaacataattgttggtaattgccattgtaaagtgtaagaaatgtaaactggtttgatggattagtggagttcattatgtacaaacccacgaatgtttgtaaagagaatttctttttaaataaactttacatgttggaactctttttttgagattttcaggaaaatgtgaaggtagaacagagttcctgctgactctacattatatatttgtttggtatacttgttacaattagtgaaattataccgatacattaatattaactacaatcaatgctttcgtcagactaccttggcttttatctgctgttctttttttctgttttaataccgccttcaaaatacaacattgtattaataataacagctccttattctcctcgttgtgatagcttcttggagttctttgttctcaaggaccttggagtatgtttttcagttggggtgtattttatattcttctcatgaaaattttctcattaaaaaaaaaaaaaacgaggtcaatgaaagctaggcatggtggcaaacactttccttttaatcccagcacttgggaggcaaaggcaagtggatctctg

SEQ ID NO: 36295 - DNA, 1581 bp, Mus musculus
aggcgacatcaacgcggccattgagaggctgctgggctctcagccatcctaattacgtttctgtaccttgaaaaaaaatgtatcttatttttgataatggctcttaaatctttaaacacacaaaattgtgctttacttttattttgattcttttaaatctgtctacctataaatctaataggatgcattttaaggtggagtccctccctccctccctccctccctccctgctcctcctccccccaccctctcccttcccttccagcctgccctctcccctctttgtttccttcattcctttcttttcttcttttgatttccttccttctctgatttgaatggtgggaatcaatactgtttcactcaaaggtgttgcatgcaaacacttctctttattctgcatttattgtgatttttggaaacaggtatcagccttcacagttgggtgaacaagttttgtcctacagatgtccagtttatttgcattttaaacattagcctatgatagtaatttaatgtagaatgaagatattaaaaaaacagaagcaaattatttgaagctctctaatttgtggtaaaatattgcttattgtgactttggcatgtatttttgctagcaaatgctgtaagatttataccattcattgatcgtttttgctatttgtacacagtacagtaagcacaattggaattgtacatctagaagtattactgtagaatctctgagcagaatatgtgtaaccaaaataagaaagaatataagaaatattcctgaagctaggtatgtctcacaattttgtagaatcttacagcatatttgataaatttctcagtgaaaatgttggctaggcaagttcagttaaaatatagtagaaatgtttatcctggtttctctaagtatacattaaattgtacagaaaccttacagtgtaacattgtgtcaacagttgcagattgattgtatatgaccttaatctttgtgcagcctgaaggatcagtgtagtgactccaggaaagtgctttttatctaagagttcctcagcttctcccatgaagagaccttcatatgcattttgatttgtaattggaaatgtaacttttactggaagtgtcatgtgatgtttgcattacttttaactgctatgtataaaggaaagtgtatcttttggctctatcagttatttctcttgtgcacagggaaaaatgcattaaaatgactaaaaaaataaaaaaataataaaaaatggagaaagctcttttattttgccttttggccctagaatcacatctagaagggttagctcccctcacaagtgtttatttacaggattgtactatgggaaattatttttgacatgcacatttagatgttctaattattgcccccaaaggttaaccaattattaattagtatttcccctgcccccccaccagtatattgggaatgtgactgggcttattttaaatagataaaatatgggaaacgatagtatcccggtgtcttttagaaacaatatgttgttttatgaggtggggtactgggaggattgttaaaagcaggatctcactgactagcttttt

SEQ ID NO: 36296 - DNA, 1170 bp, Mus musculus
ctgggttctcagatagtactatgtccaattttctgaggaaccgccaaactgatttgcagaatgattgtaccagccctcaatcccaccagcaatggaggagtattcctctttctccacatcctcttcaacatctgctgccatctgtcccaggcagcccctgggttcctgtgtcctgagggttcctggcaggttcttctgagcagcagtgatgatcctaactgcactcaatggcctatccacactcctgggaggctcactccctcctggtgctatctgggtatggagccctgtggcagaggatctgctatagtctgaaacggaaactggaaggctcctgttccatgcccctgggttcctgtgtcctgagggttctgggcgggttcctctgagcagcagtggtgagcctacctgcactcatgggcctgtctgcactcctaaacatttctttttatgttattttgtgtgtatgagtatttggcttgcatgtgtgtcaatgtaccaatttcttgctacatagccttgactggcttatgtatacaaggctgatctggaactcatagctatccacctgcctctaccacttgagttgtgagattaaaggcatgtgccacccaccatgccctgcccactcctttttgctatatattatattttcttgcattccttaatttattatgaatttagggctcgaaacaacttaattatactgctgtagatcagaagtctggtgtaagtttcatctaattaatcaaagtgctggccagctgtattcatttccaggggctctagaagagaatttgttttctgctccttaagtcgttggcacaatcgagttccttacaaaggtaagagtaagatccccgttttcctggtggatgtctgctatgggtgttcccagcacttagaatcccttcattcctgatcctttcactggcttccaagccggttgcgggttgaacccctctcacacttaaaatttctccatttcctaattctcatccatcctctctctgactcagagagggaaagggcttctgtgtttaaatatacatccagtcagagtatgccagtcagttaatccagaggaaattcttctgtcttgaaatctataaccaaattacatctgcaggtttttttttttatcttgtaaattgatacatacagtcacca

SEQ ID NO: 36297 - DNA, 1176 bp, Mus musculus
tgtgttgcataaaataacttataaaaactttgttccttatagagtactattttattaaaaatggcattttcacatgagcaaattcaatatataaaagctagtgtgtaataaaataaacaaatgactgcttttcattttcttctaactaaagaaataatagtgtatgttaaacccttattttatggtaatatatgttgagatatcatttaactaaggtattttgaaatttttgccttttatacataaaggaatttatttggcaattattagttgaaagatttgtggacagaacatttaaacctgaagtgtaacttaattggaaattgattagaaaccaagaaaaattttcttggaagacaacataaatcagtgaagtttcaacagaaaaataaatctgatatttttagaaagagatgtatttcagcatttacaaattctggagtagctataaatgacaatccccaactgccaaatttcttctaagaataaaacattactatggtaaagaaatgaagtttaattaaataaagattagaaattcttgtctatgatcatatcatcctgaatgtacctgatctcatctgatctcagaagcgaggcagggttggacctggttagttcttggttgggagacacattaggaattccacttttcactttctttccttacccctattttatcttagtggtgtcttaatcccacactgatgattaagtagtaggctactgtctaaaaacatcactgtccatggagctaagattagtaatggatgaataatggggcttagaaatagaccattagagggaatgcatgaatgtcactgagaagggaagtagaatagatatcatgggtggatgcggggagggtattgggtaggaatgggggtgaggatggaaactggagggaccacttagggggaggatagagggaaagagtagtgggaaggacaactggaatggggggaagcatctctgggataagctagaaaatgagagcagaaactcccaggaatctataaaggtgaccttaactaagactcctagcaaaggggtatatagagcctcaacaggccatctccagtaaccaggcatgatttacaatggagggattgagaaactaacccagccacaaaacttttgccttacaaattgtactttctacaagatatgctgggg

SEQ ID NO: 36298 - DNA, 1198 bp, Mus musculus
tgcttttgggaacacttgcatcctaccgggttgcttgtgtgtacctttactgtgtactggtttattgatataaaagagaagaaattattgcaatgtataatgaaatagatattaaaaacatgaaaaagctactgtagttaatggatattgcagaattcttagaaggaaacattatcattcataattttaaacacattaaatttttgtaaagatagtaactgtagacaagtattaagtcacgttaacaaagccagaaacaaaagcgcataccttctataaaattcaggaataggtggtgggagagacacattagcagcaccaagcatgcactacaccagtcttgcagaggaccagagtttgagtctcagaaactgcatgcccctcccccccatagctgactcacaactgccactccagctccaggtaatcagatgcatcttggcctcacttgcacatgacctcacataaatatatataattaaaaataatagaaaataacatttcatacatttacatatcctggtctctatgaatttgcataaacaacagcaacaacaaactcctgccttgctctgattgaaggacttccaggactgctgtctgctcctgaactacgtgtatcctttccttgtattttgaattaagaaataaagaaataaccccttattgttgaacatgttggttgtcccctttattttttcctctaggggacatatgaagcaagttattctttttctgtatctttttcttttcttttgtaaacattttggtcaagtttgtttaaaaatagctttatagagagcttctgaggcggcgccatcttcggctccagacaaccagccaccttcctggtgagagcacaggggtccgcccggcccgagaggtttctgcctcaggctctggcaagagccaccttggctccgggactctgcggagggcaggctgcacgggtgacagtgtggaatacagaggccagccatttctgggacaggcgagagccacagagcttctgaggcggcgccatcttcggctccagacaaccggccaccttcctggccaaagcaacacagcttctgggaaagatcctgttttgggccttcatcttcagccaggaggaggtccaaacaccacataactgtgcaccttccctgaaagaggagagcttgcctgcagagactgctctgaccactgaaactca

SEQ ID NO: 36299 - DNA, 1198 bp, Mus musculus
atacgatctcaagtatataggactggacgggaacatcacctgcttcgtgaatggtgctgggctggccatggctacctgcgacatcatcttcctgaacggagggaagccagcgaacttcttggaccttggaggtggtgtaaaggaagcccaagtctatgaagcattcaaactgctcacgtctgaccccaaggtggaagccattctcgtcaatatctttggtgggattgtcaactgtgccatcattgccaacggaatcaccaaagcctgccgggagctggagctcaaggtgccactggtagtccggcttgaaggaactaatgtgcaggaggctcagaatatcttcaagagcagcggactccccatcacgtcagctgtggacctggaggatgcagccaagaaagctgttgccagtgtggcaaagaagtgatgttctccctggctcccacgaagaagggcatgtccctgactactgtgaaagcaattgttttctcactgggaagggacacacacaaggatcatcatgtgaaaaatattaactctgaactttctcaaatacgttatccagagtgcctaaagctgaatttatactgtagtcattgtttaaaaaaaaaatcactccttacaatttcacatcttctcttgcccattcagtagcagggtctaccagctctgggccacagtcagtttagccaaatagtgtgcatacatacagtatttaaagccagatctaggttcattcacaagggcatttattctacattagaaaattttacagaaccctcaagttcagacaggctgatatttaacatagtggcttccagaagggtacagctaagacacccgagcttctgtgaccagtggtctccactggcccctaattccagtacattaagaaagcccatgaacattataaagtgtggcttatattgggcatcccgtgttgatatatgtacattgcacacattttaccctgtgccttaatgttgaatctactgtttgcctcacactgagttactgccagaagccttagtcatgggtgtgaggtggaaggtttcattttgtgtcagagttgctgaatgttaatctatttcataaagagtcacactaatgatctagctgctggtagcggccaggctttcccctcttgtcccctccacctcacatctatcagtttgccacagaaagatgagagatgcca

SEQ ID NO: 36300 - DNA, 2492 bp, Mus musculus
tttggtttcagtagacctttaatttggacatgtggaggaatgaacatcattgttttgttctggagagaagttcctgatagtgtttctcccctctcacccccaaattgacttagatattaaaatttggtgcttttaaaggttttaaaagagtgattagcagtgcttcaattaaaatgacaaaggagacctcttacggtgtttgtccctttatttcagcctctcttcctctttcttacctctgatggcctagggcaaaggtgtattctatctagactgttaactgcactcagcataatgtcaaggccttgaggaacgatccacaacctattatatttgccgcccccccattataaagttgttccaaggatagcagaagatttttgcctgcctgaaaagggtgaaagtcaaagatgatttctgttactgctctccctgattagagatccaaaggcctttgagaagactgtaggatgtgcaagtgcacactagagttcatgtagtcctgtggcaaaataacttaactcttaagaaagtgcatgtgaatagcaacttggcattgtattgtggataatttgaattgtctatcctattgtttgtgtaaaatatttacactgtatcagtagaatggtatttttttttacagcaagtaaaacattgaaaatttactaatggaaatcaggctcaagtttcattgtccctcccaagataggaaggaacaaataagacaggacaagacaaatgatctttaaaagtgagcgcaaacctatgccatttgttttagattgacatggaagaagaaacaatagagaataaaaggagttgatagttatgttcaaattagatgcatttaacaatatttttggtgcatgcatagggtaaaaacagcccagtagacacttctccacccaaattcttccccagtgctttgaaaactttgtatattgtggagaattgaaaacaaatgtactgctacagttagaatattagctaaggccaattgccccttacccactgtactgttattcttacgattacttttgaaacagtgactgtatgtatgtagcccagtctaacctggagcttattatgtagcctaggctttcctggaagctcacaagaattgagcttgtaccatcacacagcttaattcttgttaccatttaagtaaagaaagcaagtatatcagctgctggggtaatattaatgaggggactgacctgcgtgatccgtgaagagtaacttgaggccataaccacagatccactcataattcgggtgactcagttcctgctaagcaccaggtggtagaaatgaagaggataaggttatgtgaggctaattggttatgagatgcatttgggataaaatgaaggaagtggtgttgaggaaaggaggaagaaagaggtttttatcttgagtgataaatgtgaactcagatgtgactgatttgctgaaggagggtctccgttttgagcccttgttattttgacaccgaagcatgcaaactgaaccaacacccaccctaccctgtgctctactccgacccaccttcgctttggctgcctcttaaggaatgctaatggatttgttgtttttcttaatactgtagtgttatgtagtgtgaaagattcttttaacagtggaatatattatggtgtcctgctttttttttaatgaaagacaaaacaaatatggatagagtttaaattctgttcaacacagcagatactaagaattgatttattaagacatgaaatgctgctttctcttggaaatgtgattgaatatttataaaagagctccacctgggccggggaaggctgggttggtggtggttttagtgggctagaacattactatctgaataaacaaatgtgctgcttcttcctgtagacttggaatagtcatgtccttgctttccctaacaattgctgacacaagactttgtatttctgcctgtcatctgtctctcaataaatggatcaatttcatcccgtctccattatgcctgggaaagggaaggaaaatatgtgttatgttctggcttggcctctttctgagctgctcacactggtggttcatctgatagttctgttttctttctccttccttttttctttttggtttgttttcagacagggctctctgtgtagccccagctgtcctggaactctgtaaaccaggctggcctcgaactcacaggaatccacctgcctctgcctcctgagtactaggatgacaggcgtgtaccaccaccaccctggcaacagctcccctttcaaagcactttattgccactgaggggttctctctggtaagacttgctcagaaaagacaacagtacttgttttcattgtggaactagctacttaacattcctctgacagcatattttttttgggggggtgcatactattctagaggccaattggtcagcagtgttatcttgttattacacagcagctgctatgtgaccataaaagaaacacctg

SEQ ID NO: 36301 - DNA, 1104 bp, Mus musculus
ttgtattctgtctatgtggccaacttcatgtgtgtgtgttaaaaggttgccttagatgtatctaaagtgataacttcttccttaagggtggcctaaattcaacaggattactactagtcttcttcacgtctctcctatgccctgcttcagttacttacgaggctcccagaagcagaggaccgtcagctgtccctacatctgtctcacgtacacctctactcattctctctctgtagtgctctgttcctgtcacatcactctgtttttgctatcgttcatttttttgtcatccaacaacatccaacatggctccttcactcagcttctgcaaccagactttacctgcctcagtttttatttgaaaaggttctgtatttctattggtttggtacatcatatacatgtgtatctttaccccatttgaggtagtatctgcctgtagtggaggccagatgattgtgagctgccatgtctgtgtcaagaactgaacccagggcttctggaggagcaaatagtgctctttcctgctgctatgtctttccagccacaattctacttgtatacatagtacttagaattctgcttttcttttttttttttggagaaaggagcttttgagtgacaagaattgttcagaggttgcttctgaaaagccacatgtgtaaaaatgaaagcatgtgtgggagggtgggagtgtttcaggaatcaataatagcttcaggggacttcctgagccaatggaaaaaagagacccctgtgcaaaggaggtttggagattaaacatacacacacggctgctgtcacactctcttccccccttacttaaacagctctttcttttttttattacgtattttcctcaattacatttccaatgctctcccaaaagtcccccatacctccccccaccactcccctacccacccattcccactttttggccctggcgttcccctgtactggggcatataaagtttgcgtgtccaatgggcctctctttccagtgatggctgactaggccatcttttgatacatatgcagctagagtcaagagctccggggtactggttagttcataatgttgttgcacctacagggttgcag

SEQ ID NO: 36302 - DNA, 1372 bp, Mus musculus
taataggaaccatacactgaatatcattttgagattttattaatgatgggccattattactaataatactaaagtcatacaaattactaacttttattgcagaaaatatggcattgttgtcttctaagatcactcaggaccaaaatgtatctgcatattaaaaaggcacagaccttttcaggtaaagcttagagaatgccgtgaaatactcacattaacttcatcgcatgcatgaagcagtttactaatgaaaatgtatgtgtgtaaatcattgttttcaatactgaggaaaacaatttttggtatggtacttagcccaggacctcacacatgcgagcaagtattctaccactaaactattatccatagaccatgaaactattttaataagaggaaattctattcattaacttcattttctgagtgaaggcaacaatacaaaaccttatttcttattagctgctgaacacctctgccagctaatctttagggtcgggtttgggtgcttctctcctggagtccagatttgtatgcaaatggcctcattactaaagaaaggagatgttacttattgtctcttccgcttccctgtgggctcctggcttccctgtgtagtgcatgcgctatcagaattgcttaatgtgcttgaatgaatgatggtgattagtgttatttatggctagaaaagcatgcttctatttaagctgtaaaaaggattgtcgaatagttactgtaaatatatgttgacatagtaaagcttggaatgtcttatgtccctggtgtattatcatctttatggaaaaattcattttggtttctgtagagcatttagaaaaatgagttatattggaaaaatgaattatgttggtgatttgaagaagtatctttttgtgttgtctctttgttcagcagtgaaattttattctcagtgttcctattctgcattgtttacattcttaaggtttttattttaatcatccataagtgtgagacatgtacatattatttttagcatctcagtttgaagagacatacagttaaacttgactttgataaatacttctaggtcattgtctgtgcgaacagcagattgtaagcatacgcttcctagtgatgtagctttctgtcattgtgtccttggtatttattgaacatccacatactggtggcacacagatttgttccaataactcctttaattgagctgtaattcattttaaggctttaatttgattttataattgtcagaatgtgatgtttagcaataaaagaacaaatgtaataaaccagcattttacgtttatcatcttctgtatcatattttttacatttgaccttagacaaaagctattgtcttgtcagtgtccttttt

SEQ ID NO: 36303 - DNA, 2028 bp, Mus musculus
tttttctgtgtagccctggctgtcctggaacttgatctgcagaccaggctggcctctaactgcctctgcctcctaagtgctgtgattaaaggctatcactgcccagctttaagtggctatttatttatttatttatttatttattggtttgcttaggggttttgttgttgttgttctttgttttgtattgttgtttgggttttgggctttttttattgggggggggtgtttgttataagaaagaatgttagagacttaaagtagagagacctacagtaatgtcacctcccagtgacttctcagaagatgatttccacttgtaatctcatagctagctccttaactgatcgttacccaggtacctgatttctctttctggagctctggctattgttaatgcagtgccctgctttgccttggatggtcaatggattttaaactctttcctggatgctacccttacttcagtaattggagacaatgatgtcaaagatctgattggatttttcatcttgcttggtggcagtgtacttttggctgccaatgtgacactgggactctggatggttacagcacggtaatgtttgctctcatccaacagaattaagaagtaaagctacatggcaatatctgttgccattgaaattcttactagttatgaaatgtaaagtgtttccttaaaacaccttggccaacctctttgagctcctaatatctagagaacccaaaaactctgtagtagagggagtagaagaaatgaaaagcataattcctgactatatcctactttaaagattgaatgtgcaaactctgaatgtttgttgaataatttgtaaacaagtgaaaattcattcatgtaataccattttgtgtgaccatatagcattttggaatagtaaaaggaaaagcagaatcttgtaggaaaacgtgtgtgtgtgtgtgtgtgtgtgtgtgtgtgtgtgtgagagagagagagagagagagagagagagaatgcgtgtgtatgtggtatgtgtctgcgtgttctactagtgtttgaaagcagggccttacttatgctacttaggctaagcttgcctgtcccaggtaaaagttactgaaaagtgccattaaggtgatgtgctggtgcacacctataatcccagcacctgcctctatgtgtttggagggctaggcataaggatcgtgaattcaaggccatcatctttagctacatagtaggttccagaccagcactggccacatagcaagaccctttcgtgcatgcatacatgcacaggcgcgcacacacacccacccacccacccacacacacacacacacacacacacacacacgcacatacacaaaatcattaatgattggaaggaagctagaccttggttgaatggaaagtagagcaagtgctcttggttttataactcttgtctttatcttatttgaaaagtattttaaagtttaatggtgtattattctgtactctggttacaattctatgaaagtatctgctaacatgaaagcaaaaactctgtacaagtgctatcaagtaaatgagcaatgttgaaagcagataaggcttgtgatgtgataagacagtttgtcgcacaagtattacatttttcatagtgtaagttacactcaacatttttaagccttgttatatatagagtatgctgcaggaagggtctctcacggcagcatgtgagctcaggcagttagaggtgaacttgagaactaagctgagtcctctaacagatcacaacagaacttcagcaaacctacttaaccacttcctagagctttgcagcttagaactcttccagagtagactttttcctttgtgctgcaagaacattcaaccttgagccatactctgtcgtcaccagcacctagtatgtttctctctgttggcgggattaaacacctcctctttgttttccatctccccctaagctacctctgtgagtacataaaagacttggtagtctagtgagaatggctgcacaaatgaaaatttcccagaatcta

SEQ ID NO: 36304 - DNA, 1194 bp, Mus musculus
atcttacttgtctgatatgatcattaaaataaatatatagctaaaacaaaagctataatgccttctgtctttatctattttgtgttatttagttaaaacctccatgtttcagatgccacattttatctgagaatctacaaatgcatagtagtatgatatcctatatagcaaaacatggaatattgaaatttatagttggtgcacattaataaatagcacattttaatgtcaagatcattccttatctgctgggtgacaagaaaagcatgaaggaatgcaagttagatttttcttgttaataggtacttttttttttttttttggtattttttgagacagggtttctctgtatagccctagagctcactttgtagaccaggctggcctcgaactcagagatccacctgcctctgcctcccaagtgctgggattaaaggcatgagctatcactgcctggctaataagtactttttaacattgactgatattatatttttagcatacgtgtctacctgcccggaaagcagttgaagctactcaagtttgtagaagcaataaagattgcaaaagcggcgcaagttctagcttctgtatagtaccgtccttggaaactcacacccgactaatcaaagtgaaacatcccccgcaaattgatatgctgtatgtagggcacccactgcatcttcactacacaggtgggtacttctggggagctcttccaagtcgttaggatcacatatggtctcagttgctttgcttccatttaggataaacttggcgacttatcagagtcttattaacttgttcttaagcattacttaattaatgattgattaatcatttttttcagccactgatatgctttctgtttctatcaatgtgtctatactccaaatttcatataaattgaatatttccaagttgctgatttcatgtagcatgttttcaaggtttatcctttatcaaccatagtttcatttttcatttatcagtagatgaatatttatatcttatgttcctctttaaaaagcattgctttgtgtttattttgcttttgtttttagacagagactcaccatgtagccctggctggctggcctagagcatgctacatataccaggctcacctcaaactcatagagatatgcctgtggctgcctcctgagtgtcaagattataggcacacactaccac

SEQ ID NO: 36305 - DNA, 1180 bp, Mus musculus
ctgctatggaactttgtctcaaaaaaagacaagaaaaaaataaacataaaactagaaaatactcataaagagatattagactaaaatgcaagtttcaaaatcatgtttgtaagttttgagaaatgggtgtataggcaagactagaaggctatggcagtgcattggaaatagttctgttttctgtttgcagagtgatggggttagaggcttctatttccctattttgtttttaaagacttatttatttgtattttatgtgtaggaatgttttagtatgtatgttcacatgtgtggatttcatgctcatggaggcttgaacagtatgtcacatcctggacctggagttacagtgtgagctacagtatgggtgctgggaatttaacccaactcccctacaagggcagtatattgctcttaaccactgagccatcttgccaaaccccaattttcctgttttaggcatttttagttagcattaaaatgataattcataaatgaaggaaaggattttctccagagagaaatgggtgttccatgttgtgatggtttgtatatgcttaggccagggagtggcactattatgaagtgtggccttgttggagtaggtgtgtcactgtgggggtggcctttaagactctagtcctagcagtctggaagccagtctcctagaggactgcagatcaagacttagagctctcagcttctcctgcaccatgcctgcctggatgctgctgtgctccccccttgatggtactggactgaacctctgaacttgtaagccagccctgattaaatgttgtccatataagagttgccttgggcccagcgtggtggcgcacgcacgcctttagtcccagcacaggcagagggaggcagatttctgagttcgagtccagcctggtctacagagtgagttccaggacagccaaggctatacagagaaaccctgtctcagaaaaaaccagccccacccccctacccccgcccaaaaaaaaaaaaaaaagagttgccttggtcctgggtctgttcgcagcagtaaaaccctaactcaaacagaaattgctaaggggactagagtattgtgattggcttgaccatgcttttgtctgaaagaatgtggatttggaaaacaatggaatgcttttgtggggcttaatgggctgtcctagtaggaatctga

SEQ ID NO: 36306 - DNA, 1239 bp, Mus musculus
tggctcacaaccatctctaatgggatctgatgccctcttctggtgtgtctgaagacagctacagtgtactcacatacattaaataaataaatcaatgaataaatcttttttaaaaaacctgaataaacaaaactattaaaattgccttccttgatatttaaactaatttttcacaaagctaaaatgcgataaataagatgcagacagtagaatagaaaataagtaatgtgaaataagtgaatgccctaatgttaatagcatttctaactatagtaaacacgagcaaaactgggctgtactaaatgagcaaatagagaggaacccctgccccctcagccctttttttaaaaattggcagtgatatttagctttttagggtgtcagagtatgaagtttgttagaattacctatgagtcaatcagttcagatagggaaataaggctgagctattggtctttttagacattgtttaaaagttacaaaatgtggccaattactttgttagtccatgcactgtgaagaattgtatacttacaagtttgtttttgttcttgttgccaggttcaattttggaatggtgtttggcgtgattgccatgttcagctctttttttctccttggaaaaacactgatgcagactttggcacaaatgatggctgactctccctctccttattcttcctcttcctcttcctcctcttcctcttcctcctcttcctcttcctcctcctctcttcacaatgaacaggtgttgcaagttgtggtaagtacacgcttttttgtcttaactgcttaaacacagatattattttttctggcttaagtagacattaaagtaaaatgcctcataatttttcagattacacacttaactaaaaaccattaataaaagattagcagagagccgggcgtggtggcgcacgcctttaatcccagcactcgggaggcagaggcaggcggatttctgagtttgaggccagcctggtctacagagtgagttccaggatagccagggctacacagagaaaccctgtctcgaaaaaccaaaaaaaaaaaaaaaaattagcagaaattgtcacagtatttgatggcagtggaaataactagggcagagaataaatggatgactaataagacaggcagtcataaccgctcccccttacctcaggttgtcttcttgagatgtgtaatgattatttctttcaaggagcaagcatgctgacttgagatctctatatc

SEQ ID NO: 36307 - DNA, 1173 bp, Mus musculus
aggtggcaccaaccttgactttcagatggagcagtgcaactacaaaaggaaaagtgatggtatctacatcataaatatgaagaggacttgggagaagctgttgctcacagctgttgctcacaggttctccattgagaaccctgctgacgtcagcatcatctccaagaacactgacccacaagggagctgtgctgaagttcgcggctgccacaggagccattcccatcgctggttgcttcacaggtggaacctttcctaaccagatccaagcagccttcagaaagccacggcttttagtggtgactgatcccagagctgactaccagcccctcagagaggcctcttatgtcaacctgcccactattgctctgtgtaacccaaattctcccctgtgctatgtggacattgccatcccatgcaataagggagttcactcagtgggtctgatgtgatggatgctggccagggaagtactgcgcattcgaggtactatctcccgtgagcatccaggggaggttatgcctgatcattacttctacagagacccagaggagattgagaaggaggagcaggctgctgctgagaaggctgtgaccaaggaggaatttcagggcaaatggacttcaccagctcctgagttcactgctgctcagcctgaggtggccgatgggtctgagggtgtgcaggttccctctgtgcccatccagcagttccacacggaagacaggagtgtgcagccagccattgaggactggtcagcagctcccacagggcaggccaagaggattggagccaccactgtgtggttctgagctgctctgtacacatctgagcaaaggggaaaaatggtggaaggaaaataaagttcctaaaagctgaaaaaaaaagagtagattgctatttgtttgtaaataatgatggggattcactgaaataacagcattaaggaggttgagaaccactactctagggtcttctgaaccattcatcctcaatgtgtgatctctgtatcagcagcagcagtagcattatattgagaacttaccaatagtcaggattctcaagtccaactggaactgttaaatgaggaactcagaaagtagggatcatcacctctctttaacaagtcttccagatgagtcttacatgtgctcaaatatgagaatcactgct

SEQ ID NO: 36308 - DNA, 1169 bp, Mus musculus
ccgcagcgctctctgccgctgctgcaaaagaaaaacggagcgccttaggtcccctactcctaggttttgaggtcactgagttggaagaccccagtataacttttgcttcctgtccatggaggtgagcgggtgaaattcaaggagatcagcggacgctgtaaaagggctatctgattttcctctcccgggatctgatgatcggccctgagatacccaccccagtgtcagaaacccaaacagtatacccaaacaaggcaaaacagaatttccgcggacacatcccagcaccgagcttttcacagccgccactgtcccagaatcaactggcgatctaaaaaaataatgcagacaagatccattccagggtatcagcgctcctctccagagtggaaaatcagttcctgatggtggcgcgtctgtgattcctctttcttgacttttcgctgaattctatcctcgcagcggactttaggggattacagaatgataggctgggtgtgtgtaatagttactgagcgagtgaccccatttctggaaagcatgactgaaacgcgggggtggaatggggcaggctctgatgagtggtgtacttggcggcagccactgcccccatcggcctccgcagtgtgagaggtgggtagggttactggttacgtcagtaaaactcgggctcagtttggtgtgagatgcgggacgctgacattctctgggaggggggagagggggagggaggaatccgttcagatcgttttttctaatttttctcccctgtcacctccactaccatataaaaatatttacttgttcttaaatgcaggaagagttgtaataaagcttacaagttcatgcttaataatttactactggataatgctgttctaaaatagcaaagacataggtatatgttacttttttttttaaaggaaaggctggtgtaaaaaaggaaatcgtgtttttacgactggcagaatacaagaattttatttgaatttagagccaatatgatactataaatctttaataataaagttaaacttagaatgcttaaccgtcatttgaatgggtagtgtggaaaaacagtatggcaagggagcctcttcattttttcttaaagaaaaaaatttgcatttaaaatacagctataaaggtggttaaaattgctgaacctg

SEQ ID NO: 36309 - DNA, 1149 bp, Mus musculus
tttcaaacctaaaacttcactctcctttcccactccgctttagtatgcttgcttggcagctgtgtgaaggatagaaccatgtccactccagaacagttgtcagtccctctccccaacaaacatgtctttaatatatggcatttgttccacctgatatactcacacgccagacacagtacagtactctaatctgctattttcaaatgttctcacacacttttgttgttcaaaactatcctaattatgtaaaatagaaataatgaagacttgcaaataattagtgctagtattgtgtagaagctgataggacctaatattctcctaacatttaacttaaaagtataattacttgtatattttctgtttacttgataagtcagcaaagagtagttttgtgtattaattcaagggattcttatatgctatactaagttaagattatttggttcctaatgagagtcattctgggctaacaatgggttgtctctatatttaccttaacaggaagaaggcagtatcaaagaaattgcaatcacacatcatgtgaaggaaggacatgaaaaggcagatccttcccagtttgaacttttaaaagtattagggcagggatcatttggaaaggtaagtcatagttgtttgctataaacaaagtttatagaaattccatagaagtagaaagtagagtgctaatcacacaaggctagggatagagggaggctagctaatgggtaccaacattagatacatagaagaaatagggtctcatgttctataggacagtagcatgactagagctaacaacaattcattgtatttttttaaagatttatttatttatttattttatgtatatgagtacactgtagctggacagatggttgtgagccatcatgtgcctgctgggaattgaacttaggacctctgctcactcgggccccgcttgttccagcccaaagatttgtttattgttatatctaagtacactgtagctgtctttaaacataccagaagaggatgtcatgccagatggttgtgagccaccatgtggttgctgggatttgaactccggaccttcggaagaacagtcagtgcttttaactgctgagccatttctccagccccattatatgttttattagaagagaagtt

SEQ ID NO: 36310 - DNA, 1196 bp, Mus musculus
cataaaaagacatgaaaatagacaacttaggaaggagacgatggcaagaaggtaatggagaaggtgaatgtgattttttaaaaaactaaagaagcaagaaattgtgatgtaggactggggctgtagctcagtaggagagtgtttgcctagtttgaatgagaccttaagttacaaccctagcatccggaaaaattgaggcactcaggagaatttggttttgataaagcagagccgacatttcctgtggtatactttgaatgtgtggagtattctctagctgctatattcatagtagagttagttgtcatactgtgtatattacatgctccttggaaactagcaaacgacaaaatgaaaaagaaaacaactatcctcttacaatgaaatatcactatataaccactgtttgaaacttcaatattttggacaaaatacatgtataatatagtacagcatatatgtgtgtatatatgtgtgtgaatatataaatggagtcttggctgtaataaaggaatttggtttgtaattctttgtaatgtttattttctgtcatttaaatacaggttttcttagttaaaaaaatctcaggctctgatgctagacagctttatgccatgaaagtattaaagaaggccacgctgaaaggtaagtgctgccactatttaccatgttcatgtaacctaaccaaactgacggtctcagaactcacggggccctgaggctacctactaacattctgaattggctcttgtaaatgctttaagtttagactggcttttagtgactttttcctaccggactaagagtcatattactgttaagagcaggacttgccatgttagaatggaaggactatgagttcatcttgggctttaggcaagtagaagttgaaaagattaaaactgggtttgacagtacaggggaacgccagggccaagaagtgggagtgggtgggtaggggagcagggtgcagggagggtatagggaactttcaggatagcatttgaaatgtaaataaagaaaatatctgcccatggcaaaaaaaaaaaaaagaaaactgcgtttgattcattttcaaataattagtttaatatttttggaaaatatgctaattacctagatgcaaaatagctttaatttttttagtattttgtcatcctgacctctggtctccaaacaagttttggaatctgatt

SEQ ID NO: 36311 - DNA, 2272 bp, Mus musculus
tctgtttaaaagggtatcttctaagtgcattactcccttaaatttaacagctgtgaagtaaatcttttttcacaaaccaccctaaaagtctaaaaataaatgtagcaagacccaaagtcaacatgctgtgaggctggcatatggaagagtcagttcgagtgtctggagggaggatggtgggtatttacagtagtttccacgtttcacgtgcattgcactccaaagaatagggtgggggtcaacgattttccaactgttctttagatgtggcttttgttgggatcggaaaacatcaagagaagtgggggttgtcctctaagctatgcacatactcgcagcctagaaaggatttgaacagagagtaggtgcagaagcgtctaaagaaggcatgtatttgatagggaaaggaccagagtaggctaatcctggggtgatagttgcaaaaggctttctagactttggggccttggtataagatgtccttaattattgtgggggccagtaacacacaattcaacatgactttgatagtctccattccctggctttatgaattacctacactttcaggttgttttgctgtattttataaaaataggttctatcttactatggtgttgaaaatttgagacttgggaaagcagacagagagctctggaatgcaaaggatcaaaaacagccagctctcttctgtgactcacaaaaaacaatggatttcatggctgatcttggtgcttaaaccaggaaggtccagtctaactctatctgttcctctgcaagacccaactcctgtgactaacctggatgtatactttgagccttatttaattcacagagaagttgacttaaatcagtgtttttatttcaattaatgaaaacagtcctctttcaaccccaggttacttaacattttgctgatctcccccaagagatcattggtggagaccaattaatgaaggagtgaattcagtttcttgagactgtggtattctacagagccacacctaaccactttttccagtgaagaatctacacaataatacccaaatatggatggccaagaagaatctgtatctacagtgtgctttgtgtgtttttgacactgctgtattttgtgttgccaagtgacttgtaactggttccaacgtgacagttctttaaaagttctagtaattaagtcaacttaaatttttgtaaaacctggtgtcactataggtctcacaagtaccacttttattccagtctttaactgttcataatgggcatagcaagggttggagtgagagcctacttcctacctcttaaggcactttcctcattgttttgccatataaccttggactgcatgataagctgatgaaatatccatgacttttcccagagcaactagcaaggtatatgacattttggctagagattagtgggaaggaaaatttagaggtttaagtccggatgtatgaacctcaaaaaaaagtcttctaaacacatatcatttaagtacaatatatggaaatgtatctgagcagagagtcactataacagttctctctaagtagattagttcaatgtccaatgaaagtgaacatctttattcctatattactatagtactggatgaactgtatactgagtttttcaaacaagtatttaaagtagaacttttaagtacgagcaagggcatgaggataaagactttgggttgtgtttctgtaagtgtagtttaccatatagagctttgtttcttaattttaaaaaaggtttcaaagtattgccattcattagcatccttaatgattatgagcgatgagtgtgtaactcgaaatcatatacatgtattagtttatcttaactttttaccctaaataaaagggaaggtgtacacctaaaagatgtaattattttgcatttttggccatgggtgggaatggggtgggcatctacttgagcagtttttaaaaaagaaaaaaaaaatcagaaatatttttctactattatatatgatcttcctttatactagtttatccctagtaaggcatgccagaagcccaagcaaggtaccatatcaagggttcttacgtgctgtacctttcgttggtgggtaatcgaatcagatgcttggcactgtggtcatagttatgaagtgcttgtgaggatcagatttcactgaatactaatttgttttacttaagagtctaatctgggaagtttgcaaatcatactattaatgtgtaatctaagctctttccaatgtatccatgaataatcctggaac

SEQ ID NO: 36312 - DNA, 1106 bp, Mus musculus
tgccaacacaaaaggaactctggaatcttggcagggttttgttgttttttttttctaacttttcttaacagctcctttacttgtttcttaccgcgtctgggttcgggcttttgtggcgttcctgtgtgtgaacttgggtctctctgtctagatgcaattcttgggctttgcttggtggttttgctgttgtgtctttaattttgttattattccttagatgccttcattttctcatgacacagggaatgaaaccatacggggtgggagatggggctaaagaataagaaatatatgaaaaattgagggtgtcacttaggaaatttcatgaggaggctaacgtggtaacattaggcacctgaacatggtaagtttaacatgattaaccagattgcatcaatttttaaatttaattgatttttaaagatgctttctagctgggaggtgctagtgtacatttcgtagtgttttgcacattactgatatatcttttctttcttatcaaaaccactaggaaaaggaggcaaaaaccggcgtagaggcaaaaatgagaatgaatctgaaaagcgagagcttgtgttcaaggaggatgggcaaggtaagaggctgagaagctgggatcttgtcggagtttcctgtttgtttgcctgtgttggggatcgaacactttctggctaacagactagactcctggctggctgcctctgataatgtttgagtttatttgcactgacatttggctattatcttttcttaaaagattctggttaagaatttggcattttaggccaggcatagcaatatacacctttgtttttaggatttattttatgtatatgagtacactgccagtacactgccgccttcttcagacacaccggaagacggcaatggatccccttatagatggttgtgagctatcgtgtggttgctgggaattgaactcaggacctctggaagagcaggcagtgcttttaaccactgagccatctctctagtccagtaatacatacatctttaatcccaacactcagaggcagagagacaagcaggtggatctgttgacttccaggctaaccaagactatgtgacaataaatctctcatctc

SEQ ID NO: 36313 - DNA, 2399 bp, Mus musculus
gttaactgatacgctaagtccactttgttgattcgattcaatggtccttaagactgtttaagacaaaaagcctttcctactttgaccccttccagtaagtaaatgggtgttttgaataaaccatttgccttgtgctcagtataaagtatgactaagccctgcctttgcatagctgttgactggacagtctttgtgtatattccagttgcccagagattttgatacacatggaggcagaaatctgtgttttgtttttgttctattttgagacagagtctaactttgtatctgaggctagcttggagttcactgtagtgctggtggacctcagacttgctgggatcctcctgagtgctaagggcatatgtatgtaccaccatacctggcagaaatctatttaaaggcaaaaatgataggtctgcgtttcatatttaagtatgtggctatttttatactggttttgataccatgtacattttttttcatgattttattttgcagtcatcggcttactggaggaggaaaggcatttccaaaatggttttttgggtttggaggtttgtttgtgggcggggagtgttgagacagggttactttgtgtggccctagcgataatgaaactcactctgtacaccaggctggcctcaagctcaaagacgttttcctgcctctgcctcccaagtgctgggattaaaggtgtgcgccgcagctaccaccgacaccagcacggcccgtctccaaaatagttttcgaaactggtttttcatgccggttttgaattaaggtcagtagttgcaaaaattgaacattaggtgatgctcaattgtcttaacatagaaatactattttaattgttgagatggttgcttgtctcaactagtgtgaataggaaatttcccaaacaaagaaaagattgttttaatcatgtgcgtagaatatttttacccaacagaaagatggtattggagtattgcttttttttttcaggagtcttactcacataagctacaattttgagtactttataaacacacaaaacataggcaagtgaaaatataaattttacagagcaaaagtataaattaatgctttttcgggctttccctaaacttgagaggaaatgaggggataacaaacttatgcctgacataatggcatggcctgtgaccctgcgcagaagggcagggcaggaggatcaggagttctgcatgttttcagaaactggtttttaatgccaattttgaagaaatgtctcaaaaacaacgttcataaaaagatgttttcttatttctgaatcaaagagctatagccgaaaaagtagtgtgtcgcagaggatcttgtcgtctggttttacattaggaacaagtttaccgtggggagggtccaggggaatcccattttctttctactgggaaattaggtttgctcttatttaggagttctaagactaggagctgagctagtcggaactcactagacatgctgaaatcatttgggtttcaaaccaagatccatcctgcagcatgcggaccttgtattttgctagcagccagaaagcttttcgttcatgaaaactgacacacaaaggaatgcgcctttcacgtggtttcacaaacaaggagatctgctctaattatttcctaactatgacttcatctcctcggtttgcacactctgcctcaaaagccgaggtaccataaaaacattgggaaagacacagtggtgcagtgtatatttcttcttctgtggagttcctccgtgtttatcttggcagactgcatctgagaacaaggctgccaatagcctcgcagcgtttgctgagcaattgtcttccttagtaattagacctctgtaccttaaaagtgtttcaccagctggatgtagcgtacccctgggatcccagctctgggggatttgtcattgaatagtagctagggctacataaggcactggctcaaaaacaacaatagaaaccatttttgctcaatttgcatatatatagattactctatgagcagtgctttgcttctgcttaggtgatacagctcgagtcttgattttctattttctgtaacaaacaagatttgaaatgattttagaaattagacaatgaccccacttcctatctcttctggtggttttctcttttcttcttcttcttccctaaagcagcattattgagtgcttttgcatcctggaagatctggagacattgatttaaaatagttgaatgcagttgtattaatacagtatacaaatgctacctggaagagttctttgatgtgtatttggtgtgggaatcatacagtgtcacaaatccagttttagttctaataaggaatggaaatagtctttaaggaaattatttggtttctttatttttggttcctatagtatag

SEQ ID NO: 36314 - DNA, 1199 bp, Mus musculus
tttcaaaatcaaatgctgtccttaaaagttatatacaaggctgaaaattttcaaattatactttaatttcctcaaatggggaataggttatgctttcaattagaaaggctatatttggtaccaggatcaaatttcttaaccagacttaagacaggcttgaaagagttaatgcttattgagcattattcatgagcaagtggagctggcatagcaacagtttctccccagggaggagaggggaggagacagacaggacaggacacagtgttcacagtctgtggttggagagccagcactagcctagctgtattgtttcctctccaccccagcacaaaggtactggtgtggtgaagagagcacatgtgcctgggtttgggatgctgagcacagaaagccccttttggtgcctcttctggagcactaagacagcagcagtgcagtacagctgaatggtccatactgtttctgctaaagttctacaccttttgtaaattgggcaggagcgcctggaagcaatgatgcgccggtccctggagcgtacacaacagctagagctgaagaagaagtgctcatgggcaggatcaccagggcctggcggacgtgatggtgagtctaatactgtctctgcattgcagggccctgtagggaatctcgggagtgactgatgtctgcaggattggaagatcctgtgcacagcttttaagatgcttaaactgccatgcttcctgtatgtatatgcatttctcatagaggagagctgtcattctttttgctatcaggtactcaaagcatgaatactgggctttagggaagagtgaaagaaaagcagagaaaataaatatagagcctggtagctgaactgagcacacaggtccaaaaacagtctcattttaggagagggaaatagcagaaggcacagtcacagctctagatatgcctggaaaagcagcagttactctctaagaagggctgggcggtttccttttttcccctgtttgttgctctgattttattttaaaggaacttaacttactttactatctaattcataatcatctttaaatcttcaaagacctaacttatggattattactactatcaggatgactttcccctcttttcaatgtcatagtttgtttcaataatctcagtattctattatacaggagttgtatgctacctctttctgagagcagatt

SEQ ID NO: 36315 - DNA, 1655 bp, Mus musculus
cctcccttgtccttcataaatctgccctgcttcttcaagggagaactgatcttcacttaacccaaacaaaacatgtgccacttttggagaagtcctatatgaggaaaacttgaaccactaaaataatgattctgtaaaaactgtacactatttctgttgagaaatattgcattaaccaatgaagaatgcgaaatacttggtgtctgcttcaatctcccatgctgttgcttttgaattgacacaggtggtgtttggatcaccctcgaagctgtcggtgttgcatctgagctgctggccgcctgaagaagcttcttttgcccttaactgctgggctccaaattactagattcaaaatgtaactgtattcctaggtagtttggcaaaccctggcctctcttggtagaaaccttgcgagttttgctttgtggggctttagcagagtttcattgtatggttctccttatgagcttcagctgctgctaaagcccttccttgaccttctctactatcatagcctgtgtgatgctgtctgggaaccctactctaggacactcgaattcccagagatggagcacagagacatttagatgtctctttctataaaaatcttctatttacccacactctagttaaacgtgtactactcaacctggctgcttctctccctgtcttttgtgtgtgtgtatggggtgagggaaatctagctactttctccccgtctcaggattctgttattttattattaagctccatcatctgcagagcattactctcctttactgtttaggggttgaagaaaggtttggttgaatgaataagtaaatagtggcaattatttcttttcccttatgggagctgaatctagcaaggaccctttcatgtcacccctttaaaatcgccaaattgttgctccaaaccattgaatggcttttcagctgaatgaatcaagtaacatacaggtggctattttcatggttttgctgttgtttttctattagatcttggaattttcttttgtttgctcctgcatttgactaactgtaataaaaaaaaagagtcagtgctttgaaagggggccccaagttggtcccagtatgtcactttaatagactttaaacattcaaaagtctgaacaaggaaaatgacactagaatgtataactccatgtatgccatatgctatatttaaatgtttcatttcttgtggtgaaatgtagctttattattaaaatgaccttttctttggaactttttgttttgacttgtaccttaaagcttttgaaaagatccttaattctgagaattacaaacagaagatagaaagaagtcttaaagctggtacagttaaagaatgtattagtctcagaagctgtgtatgtttatgtgatagaatctaaataaaatacagacatctaagaatgctgtgccattgaccttgatgaatatctaaggagataaatcttttatgataagcacacagatgataacatggtctgacatacaaaagtgtctgtttcactgagttccattgcacctctcaacacagttgtgatcacctgatgcctcatttgcatgatgtgtacattcggtttaatgttaatacatcttcattgaagagtctaatagcttgctgttggtttgtttttataacctcag

SEQ ID NO: 36316 - DNA, 1194 bp, Mus musculus
ggcttctccggggacctcatcccttctccggttcacgctggggccagcgccttccctaagcggctgccgcccctcgaggctcaggctcccttggcgcgcccgcttggctctctgccctgagggggggtgggttctgaggctgtccccgccggtgctattcctgagccgccgccagctcgggcacctgcccgcccccccccccaacccccaggtctgcccgcccacggcggcgggcaggtggcggcgccaggctcctgccgcgtgggtccccggggaccagggagggggcggtgccgggaggctgaagcccgaggacgcggagccctccggagcggagcgatgctcccggctttgtccgccaaagatgctctggcctcgggagccgcatcctccgcggacaaggtcaaaggctagttagctagcgcagacctccctgggaggaattcagtcaactgggccaccggtcaggaccgccctagagaaacttagccctcgaaatatgcttttttttttttgtttgttttgtttttttttttttttttgagttacaccttgagtgactgcttctctggaacacattccaaacggccaggagaaaatagggccctcgaggcttccggtcaggctacctttttaacttttcttttcttttataagcctggaaagaaaagctaggcccttccccatggcaagcaagcactccaccgtagagctatgtaccttttgagatagagtctcactcaacacaggatgctgtttaactcattctattggtcaggctgggcagtcctcgaactttgtacccactctccatcctgagtagattataggcctgcgtggccaggcctggcatatttaaacttttctttttccctagatgtgaacaggtccaaaactttaaaaggcttgtttgttcatttatgttgaggctttctttttttcttccttttttttaaaaaaagggagtctttaaagaaaggatggtcttgaactcacagtgtagccaaggatagccttgagtttctgactcccggtctctggcccctaaatgccagggttgcaggtgcatgccagtcatgtttgttttattttcctcggttattgatagcagttcagcttcccagttactccgtgttctaaaaaaaataaaacaagttagtaagggtttttctaagtgaacaaagtttgaagtta

SEQ ID NO: 36317 - DNA, 1125 bp, Mus musculus
aatagaaccaaatgatctacgacatgacattgagagaaggagaaaagagcgattacagaatgaagatgagaatatttttcacatggctagtcctacagagaggtaatcagtaaatgaaaaacatcctgctatctgggagcttttggttttaggagcttttacattttttgtgcttaatttttgcccgattgttcgatctgttttgtgtgtttttaaaatgtttcagttattcagtggtcattacaggaagcttgttctacacattaaaaatggagtgggtgaatatttgaggtcttttaattctagaagtgaagaatatccaactgtttgactattagcaggagctatgaccagcaacccttatgggctatttgaatccagcagtttgaaacgaataggtttagacccttagattctgacttaggagtacaacattttttgatgtcagtacagttctctttgggaattcttgggtctatgaagtagacagttgcagtagaacaagtggaaggtatggtggcacacacctttaatcctagtactgtagagggagaggcaggtagatctgtgtagtgagaccctgtctcaaaaacaagacaagacaaaaaacagaaaagaaacagcggagggagacctcaatttggatctcattgactctgcccatttacaaactgtcaataaattttacgaatctttagaattttctccatagtatagtgataagaccatcttattatacaggggcagctatactcttaagtcactggcatcttagcagaagttataaagatatcattgtcatatcattgttaaattcaacctcataactctttccaggggtctttagtcatctagattgaccctagtctacctctagttctaagaactagtaggacctatgacgattgtgtgaccccaaaggattatggggaataactgaatgagacagactgtctagtttgggcaagggttctttgtgtccctcagaaacaggactatgaataggaagggatagtgctaattgttcttctataacctttagtatcaactttttaaaacattttaagtatttgactagataattttaagtcaactccaaacttgattaaccttacccaaaataca

SEQ ID NO: 36318 - DNA, 1404 bp, Mus musculus
aagttgtggaatcaggaaagatcatggtatgtgctgggaactatatgtacgcagttaactatctaaggttcaatgtatgtgtttggggatattgggagaaaacaggtagtaaagccataaaataaagagctagggcaagaaggacacgggaaaccatcagcaatatggattttatcccgtacaaaatacctgggaagggctgaagcatagcagttggctcactatggaacagggcctacaaaagactagaagaggtcttaattgcattgtggggagatatgacaaggaaagaattgccaaggcctatagaaatgagccttccaggatgttcctcgccagcagacctaattgtcagagactcttgctgtcattgtcaggagctaggagcctgtcctttgcagtatcagagcccataactttgccagtgaggtgaccatgttttaccttccctcttataaatgagataggtcaggagtcactgatagatacttctgccaagtagaatctcaggaattgggcgggggcaggcagtgatgcttttacttgagggggaaaaacttccatgtatcagccaggaatcctgtcattgaacctcagattgagaccccctagtacaaggaatatcgctttctctactgatagtttccagcttagttaaataatatttgttgaaaatgtcagtcttaatgactatcctttatcattttcgtagtgacagagcattgaggttttactggtgtgcggtatgtttgaagactttgctttttaactgattaaagtaacaagattcttttttccttttgttaggaatcatcagtctcccagtttttcaaaggtgaagactattcgtgctgatggatttcaaaagcctccacattttataaaatcaaattttagaaaatttattcagaaaccttacatagtaagattggagtttcaagtttttcatttttgtatattctttataaatatatctatacttttcaaagtgcttgtaacttcattatgtgttataagagcattgaggcttaaagatttttatgacataatataactcatctcttgatttagttgaagttcaatttattatagtactgattttcttaagctgttttggtaacaacttaattaagatataatttatatactctaaagttaactcatttcaggtgtataatttggtgagttttagtaattctccaagatgtgttagagtcatcaccatagtccagttgttggacttgagacaggatttcactttgttgctcaggctaagcaggggaactcaccatatatcccaggctagcctcaaatttgcagctctcctgccttcaccttctatgtgctaagatgacaagcatgtggcaccatatctgagtaggatattgtcattacccagtaaac

SEQ ID NO: 36319 - DNA, 1149 bp, Mus musculus
agttcttatcatatagaactttagtttgcttggttagagttacatcaagatattttatattatttatagctattgcaatgggcgtttccccccaatttctctttcaacccatttatcatttgtataaaggagggctactaatttctttgagttagttttatatccagccactttgctgaagttgtttatcagctgtagaatttctctggtggaattttgggtatcatctacaaatagtgactttcttcctttccaatttgtatccccttgatctcatttgttgtcttactgctctgactagaacctcaggtactatattgaataggtagggagagaatgggctgccttgtccaagattttagtgggattgttgcaagtttctctctatttaatgtgatattggctaatggtttgctttatattattgcttttattgtgtttaggtatgtgccttgaatacttggtctctccaatacttagaacatgaaggagtgtaggagtttttcaaaggcttttttagcatctaaagagatgatcggggctggagagatggctcagtggttaagagcactgactgctcttccagaggttctgagttcaattcccagcaaccacatgatggatcacaaccatctgtaatgggatgggatgccctcttctggtgtgtctgaaaacagcaacagtgtactcacatacattaaataaataaataaataaataaatatttttaaaaaaagaaacactctggtattaaacacacaaattaaaaaaaaaaaagatgatcgtgtgatttttttttttaacccccttagagtttgcttatatagtggattgtattgatggattttcatatattgaaccatccctgcatccctgggatgaatcctatttgatcatggtgaatgattgttttgatgtgttcttggatttcacttgtgagaattgtatttttgaccatttttgcattgatattcataagagaaatcaatctgaagttttctttgttgagcctttggttttgttatcagggtgactgtggcttcatagaatgaggttggcagtgttccttctggttctgttttgtggagtacttttaggtgtattggtattagctctttttttttttttttttaaagatctgattgaatt

SEQ ID NO: 36320 - DNA, 1143 bp, Mus musculus
ttttgaggcaatattctactatatagttcagtttggctttgagttcatgaccatccaacctcaactactcaagtattaggatcatgacatgtacactgagtttctttcatatatttttcaaaaaggtaagcatattattctatataggtatattgacataaatattctaccatatgggtatattaattatttcagcttcccaagtccttttacttatatactcaataactaattttcatttagaagatacacgagtgggactggagagattgctcaaaggttaaaagcttgtgctgctcttacagagtacctgggtttatgttcagcatccacatggtgtctaacaactgcccataactagttctagaggatccagctccctctttagagagagacagacagacagagacagagagagaaacacatagagagagacaaagagagtgtgtgtctatctaaatatataaaccaggctagcatggaactcactatatagatgatactggactgaaactagagatcgatttgcttgcctctgcttgccaagtgttaggattaaaggaatgtgccatcatgacctggcaaaaaccaattttttgtttgccttaagacaagtactgcatggtactggctggtctatgtatgtcaggcttgccttaaattcacacagatccatgtggctgtgcctccagagtactaggactaaaggccaacatttcccattctttgttcactttcttgacaccatcacttataattcagagtgttccatgctgtgggtgcctcccccaggtaaaacaaaataatagattcaaggagcctgtacagatggctcagtaagagtataagtgcatacctgaatttcagtcccacagtctccataaatccagaaaaagcagtgtgcatctgcaatcctagcatccaccaagataggggagatatgagaatccctggaagcttggcagggtggcttgtgaccagtactgaacaataagatcctgtctccaatggtagtgtgttctagtgacctaaggtgctgtgtaattaaaggaagctcatgactttgaaggagcatggtaaaaataaaagggagagcttggaaggggagatgggagaaaatgagaaaagagaaaaagagaaggg

SEQ ID NO: 36321 - DNA, 1296 bp, Mus musculus
aactgactcttccatggaaatccatatttctcttgttttctcttgataggaatacccagtattgccaaggacaaacaacctggaattgttgcaagtggagccaaccctatatgaagacttaactgagcatctcatttttgtcaggaattggaattgacactaatactgtaactttcttgataaaatatctttatttttcagtagtggaatgctgcaacttttttacagtattcaatttcagaagttgtatttaactacaagctcttttgcaaaaactctcagcagaagcatttgaggggcactctttgttgatgcatctttctctcagcatggtttcactgagagaatttaattaaattacatgtaaacatttatatgttgaaagctttctgttataagaacaggtgtcagaattatttagtgtctgtacatgaaagaacttttaaacagtggccttacagtatcaaattttatactggcttttctttttctgatgacattttggcttctaacttgaagttttctgaagtttctgaagatcaaggcctgtatgtgtcatccattttgtaatacaatataagaagcttaaagaagaggtgcatcttctccatcgggtcgtgtgtatcttgggttttcccatgaccatttgctcttttctagtttcaaatgctattgtggaaaatatgtaaggattttataatctctattccatcttcttttccctcagggcaagcttatgcatattatatttttaaaggcttttaaaatctgacagacaaaactgcatatttgaacattgtactttactactacggtattagacattttgcagacacatcttacagacagcatatctttggttcagttgatagatatttcatatctactatgtgtaagataggatccatgggatcgtaaatacagtctataggtccaaaaacttctttgttttctttcttctgcttaaaagtacatatacattcccagtcaaatttttgtgacatgtttatttgtaagaaaataaaatattgttctttctgcttgaagctgttacctggcagttggtgagagcattctttgtatttttcatgaaactgataacctatcgatactgaatactggtgaacacatagtgatgtatattttctccatttgttctttttgaaatgttttctttcacacaagagccactcttccttacctgggtcagtgaggagggaagtccgagccttgattcagtgctcattgggggataggtagacggtgcacacgggtgactttgtatcatgtgctacc

SEQ ID NO: 36322 - DNA, 1139 bp, Mus musculus
aagtgattttctcatacactgacggagcatttacaataatactgattaagaagacacacactcagtagatcttgcttattaactgttagttcagataattcaaacagttaaaaacattaaccaaatgaccaactctgggagtagttcacaatcactatgaagcatcattaatgaaacttatcctgagctgtccagtgtgtcctccctaatagcctttcccagtatagagttgtaaacatactagatgttctctcttggttagatgttagtgaactcaaagtagttagtgcttatgacagtttgcatttgtaggctgctttgaagagccactgttttgccgttatctgcttttagctttggctcaggtttcattttcttggatactcaacttttcatccaattcatccttgtgattctctccgctcagcggcaagcatgtcttgagtgcctgcaagtgtgcatgcaccaaagtgcatccctgggtgttgttcctcagccactgctctctctctcttctctctctcttctctctctctctctctctctctctctctctctctctctctccccccccccccagacaagcatcgcactggccttgaatttgtcaggtaggctagctgggctggccaacaagtcctaggggcctacttctctagcagcaagcacatagcaccatgctggctttttaacgtgagtgttgggaatctaacgctggtctttttgcttgcaaggcgatgctttattgcttcggttttcggtgtcttctccttctagggacttccagtagcagaattccacagctgtagtagaattcctacaatgggtatgtgctgggggcaggggaggtagtaatgaaacttcttttgaaagaggattttaaatgtgcttgaggaaggcaaggaagggtcagtgtggtttcctctcatcttgctgtctactttctctctgaccagacactggttcttttgttaacacagactgctctgtgactcagcccttgctctagctctgattgctcctactgagcacgttttcctgttgaaatgctctcaacttctctccttttgacctggatatggcctcttgcagctgattcggcttagctatcctgaagcatacatgtccatctgtaaagc

SEQ ID NO: 36323 - DNA, 1144 bp, Mus musculus
cctaaaacaaacaaacaaaccccacttcattcacagccagcccttttctttcatattcaaggctctttcagttgctttgaagccctctctgttctttgtgctattcctccagaggggccttggaggaaacctatttgcagccccaaaggaagctctaagttctgcatggttttgttactctgagcagcacaaccagatgctccatccaacagctttggtgctttgtcacttagtctacactgtcatttcatctttctttgagtttgtagattttcttttagactcatactaaatgttcttaggtagaccccgtataaagaataatctccaaccccttccctcagtcatactttctgggaaacatctagttcccgatgatccccatcagctgctatctacctctgcagagttacattgatataagttctaagaagctgtgggcatccagtaaggaagtgctaattgcatacgagacaggctgattcagtacactgtagcatacacattgatatccttttgtttttgtttaggaacagggtcttgagccgtgcgatcctccctcctcatcttcttgtgtgccaagaaacatgacagtgttttgttttgtttttaggcacagatgggggaatcctactgttcatttttttattataatatttttgttcgattaaattagaatcttaaaagtctttttgtattgatccacttagatttatacactttccttaatactctatgtagtatacccatgatttaactaatcggtcccctaataggaggacatttagaatgtttctgatttttcactgttttgaataatttagcaataaacattttgcacacatccatttatatctgtagcagttattttttgtcaacttgctataaattatagtcacttgggaggaaggaacctcaattgaagaactgaggtgatcagattggtctgtgggcgtgtctgtggaacatttctttgattaatgatagatgtaggaggacccagcccacctagagggatgctacttttgggtcctggggtataaagaaggcaggctgagtgaaccagtacatgttgctccttcatggcttctacttcagttcctgcctccaggttcctgtctttactttacttgatgatggactc

SEQ ID NO: 36324 - DNA, 1177 bp, Mus musculus
gtgatgggaggtgatggtggtgattggaggtggtggtggtgatgggaggtgatggtggtgatgggaggtggtggtggtgatgggaggtgatggtggtaatggtggaggtggtggtgatgggaagtggtggtgatgatgggaggtggtggtgatgggaggtggtgatgataggaggtgatggtggtgataggaggtgatggtggtgatggtggaggtggtgataatgggaggtgatggtggtaatggtagaggtggtggtgatgggaggtaggtgatgtggtttcttcctactatttctttatttcaccctcaatggttctttccaaacacgagaagaatatgcaagccatttatcacatagaatgaatccatacggcaaaataagaacatgttaaaggggaaatgacacaatatttagactccaaaattatatctccagcattagtattcccagaaacaatgagtagataaacacacgaatggatagctaatccagggggctcaccatgtttgcatactccaatccagtcctgtaccgtgcagctggccccctcattcttctgtcctgtgtttctgctcacaaatgctgagctttagttaattaaaatgtgcaccagcaaccttctccctcccccaccctgttggcttagaaatactgctctatggaaaatggcagcaacaaaggcaactattgttctatggtttgaatctgaaagttgttagcaatctataacaacctttctgtattttaccagtttgcttttaacagtttcttcccattctggcacttcctcacttaaatggcttcaacatcttatggtattgagcaattatttagtatattgttcctatggactaggtagccacaggaagctaatatacagttggccactaagaaaagaaatttggtggcattcttccaccttaaaggcattgtatgatcaggagatacagactaaattggttaaaaaaaaagctacctaccctacacatctagaaccttgaagatatagtttaatgacagaacttagtactcaaaatatcatttgaaccctgccctttagtgttataattaatgtcctgacaccaaaggaagagtatatgccctgaaattaagtagactcaaatagcgtctccattttagaaccatgagtgtgggcagagcctagggagaaag

SEQ ID NO: 36325 - DNA, 1152 bp, Mus musculus
tattgggaagaaaagggagcctggagaaaatgaacaattactgggatgtaggtcagttcttcaccgtcagcatgctggcaagtgatattgggaaagctgtccaggcagcagagaggttgttcaaactgaaacccccagtctggtaagtcccatctgtgcctagtaatctcatgtctccaatcttatcctgttctgaaatatctcattcaaggagaaaatgtgaaatgcaaaagagcaacaactgcctgacttcttcattaaagcagttaagatagacataacagctctgagagttcattgcttttatgtgcagggtaaaagagacagatatatgctcacctggaatgtatatccttgtatgctctatccctgagactaaaacatcagtcctcttgactctttttagcttttgtcttcaagagcaaaatgctgtttgatattagtatttatatgtgtttgtgataaagcttatatagtaaagctgaaaaacaacaccaagaaaacaatgttcctgagcaggaggcctgcagtggtctgctggccatggtgggatttgtggtgatataacgtattctgttagcatcctcctcagttgctatactgcctggctactccacagtgtatccctattcctggagaaccacacttggaaaactattgttctttagttttaatttaaaaatgtatacctggtatgctactcatagaaaaagcatgggcaatatcagacttccccataaatacatgaagcttcattagaattgtggttacctcattgattactatagtctcataaaaatgcttactagacaattatataatgagttaatgataaagagatgttatcctgggtattgacagtgcttatcttaaagagatgaccttataaaagttttaattttgtgttctctcttatcgttgttatctgagttttctaaaatacagatctatttccggttgaaaattccttatctgaactacttggaacaactctaaagcttttgagatttgggagtttggattttttaaaatatttgtatagacttcactatacaaatagagcttcagtagattcaacatctgaattaagaaacgccattgtctatctcttgctacttaattttgttttgtgaagtttcatttttttaatta

SEQ ID NO: 36326 - DNA, 2427 bp, Mus musculus
gattcttggagcatgctggccgaccctcagtgatagatagtactgactcagaataaggaggtggagagcaatggaagatgatgcctgatatcagctctggcataggcaattgagagttacaaactcacagtcttaagtgactaatcacattcatacaaaaactttgcttctccctttttcctaaaaatatgctttccatttttaattcatatgctgttgaagagtcacataatattactaccaacaacaggttctcaaacattctagttggttccaaaactgccctggattgaaaacaatctcttgtattgtaatctgccgtttaggagattgatgtggaagtgaggaaagaaatcgaggatgctgcccagtttgccacggctgatcctgagcccccgttggaggaactaggctatcacatctacagcagtgatcctccctttgaagtgcgtggtgccaaccagtggatcaagtttaagtcagtcagttaatgggtgactgttaggtgggtggatgggtgttcccatccagcgtaaggaactctgtgctctcaacttggacaggaaatacccagacaacaaaaggcttgaaaacatgtaaattaagggagagtaaaattgcatgcagtttgtacattgctgtatttggtgtattcattcatgtgaataagagtgtattggatttgtataggatttgagatgggtattgcagagtttataaccatccatcatatcccgggttaggtactaaaaaggaagaaatctgccatttggtggtgtggtcctagctgtgaatgcctgctggggaaatgcaaagcagaggtagaagtgtagcagccaccaggaattgtggaggcactgaccatcatgtctctgatcaaaggctagacaaaatcatgtgtttcaaaataagggaacttcagtcacctcaaaggtaaaatagtttaattttttccatttagacatttaacatacatgaaactgtactcccattgcaaggcacactttttaacctttcacatttaagtaattacactagtttataaaatacgtatgctttatctttccagcgatatgctgactttttaaatattaggtcagggctgacattacttacaatcttgtttataaacaaggatgctctacaatcacacgtgcttgaattaaatggacaagggtctttctgtggaaactcggagtttgtgagtacaccaacagaagctttaatcatgagcaggtgtaggggactttttgcccattctccccaggcttggctcactgtgaagactcctgcatttgtcttctgtgctgggagactgcatgccagagcctacagaggacaccacccctgcaaaacaataatttgcagaagaaaagcaaacttgaagccagccatctactctttaaatataatctctaacttaaaagcaaaagtatgtcgcctttttctgaacatggtaccataggaatgctggtggctctgtgtagaggtgtggatctttaaacaagagtgtaaagaaaggtctatcacttcatgccttgccaccctgaacctgagaaaatgagctctgtttgctgtgacataggaaagataggggagagctactagcatttttaagtattcacatgaaaacaaccctaagctgtcggggaggctctcttaccgtagtcggaggcaccttaggtcttccttagtgatatcattgagaatatcagaaagtgtatagtcctcttcaacaatctgaaagattcaacgtatggataagcagcttttcaacaatatcataggaatactttgatttagaaatttaccttttctattgtattggcatccactccttgtagttgcaaccagtctataagctctctgtcggttcccagtccatcagggggtggagggttctctgtaccacctataatgattccaattttgttttattgtatagtaatgtataaccataaaatgctttaaaagtaacaacgtggatgtaatgatgtatcgcaacagaaatgtcatgtgctgtgaaaaggaaacgaattaaacttgtttgattcagctacttttacagttcttgagttccctttccagagaacagttgtctccacctaagatgcttttagtgagtctggacttgagatactcagtctcacttaaatgcctgttctcatctcgggctggatcgtcctcactccactggaacaagaagcttgtgttaagactgtagcggagctcccagttcttcatcccaagagctacctctgtgcctgaggggtacatgtgagagtcagtctaatgtcggtaacctttttgattcaaagtcgtggaatgactatcaaagtcaaggtacatttttgttaccctgccctttcttaatactctgagctctacccattatgatcactgttcatgtagtatatggtaacctca

SEQ ID NO: 36327 - DNA, 1171 bp, Mus musculus
tacactttctgatattctcaatgatatcactaaggaagacctaaggtgcctccgactacggtaagagagcctccccgacagcttagggttgttttcatgtgaatacttaaaaatgctagtagctctcccctatctttcctatgtcacagcaaacagagctcattttctcaggttcagggtggcaaggcatgaagtgatagacctttctttacactcttgtttaaagatccacacctctacacagagccaccagcattcctatggtaccatgttcagaaaaaggcgacatacttttgcttttaagttagagattatatttaaagagtagatggctggcttcaagtttgcttttcttctgcaaattattgttttgcaggggtggtgtcctctgtaggctctggcatgcagtctcccagcacagaagacaaatgcaggagtcttcacagtgagccaagcctggggagaatgggcaaaaagtcccctacacctgctcatgattaaagcttctgttggtgtactcacaaactccgagtttccacagaaagacccttgtccatttaattcaagcacgtgtgattgtagagcatccttgtttataaacaagattgtaagtaatgtcagccctgacctaatatttaaaaagtcagcatatcgctggaaagataaagcatacgtattttataaactagtgtaattacttaaatgtgaaaggttaaaaagtgtgccttgcaatgggagtacagtttcatgtatgttaaatgtctaaatggaaaaaattaaactattttacctttgaggtgactgaagttcccttattttgaaacacatgattttgtctagcctttgatcagagacatgatggtcagtgcctccacaattcctggtggctgctacacttctacctctgctttgcatttccccagcaggcattcacagctaggaccacaccaccaaatggcagatttcttcctttttagtacctaacccgggatatgatggatggttataaactctgcaatacccatctcaaatcctatacaaatccaatacactcttattcacatgaatgaatacaccaaatacagcaatgtacaaactgcatgcaattttactctcccttaatttacatgttttcaagccttttgttgtctgggtatttcctgtccaagtt

SEQ ID NO: 36328 - DNA, 1286 bp, Mus musculus
ttattttacattattttaacccaaggtctcatagagcctgagttagctccaaactatctagcaaagggataaccttgaacgcttgatcctgtagtaaactttcaattgatgagatcataggtgtatgctatcacacatcctccctcccctccctccctcccctccctctcccttcccccttctcatttttcttaactccctatctcacttcccccttcctcccttccttctttccttccctccttcctttttggttttacaagacagggtcctctctgtgtagccttggctgtcctggaactcactctgtagaccacgcctcaaactcctatagatcgactgcctctgccttccagggtgctgggattaaaggcgtgtgccaccacagcctgcttatgccttcttgaagcacttctgaggtctgcatgtctttgctgttcaagttgtctgttagtggagctggatcttagaatgagccagcagtatctgtggggtggtaactggaggggggccatcttcctccacttcagaaatgtgaccttcatcggctagaagagggccccccagtcaccacagtgctcaccagagaggatgggctcaagtactacaggatgatgcagactgtgcgccggatggagctaaaggcggatcagctgtataagcagaaaatcattcgtggtttctgtcacttgtgtgatggtcaggtaagtgataggtttgttatacggccacattattgggatttttaaataggttgcttccttcttcccttctttccttccttccctctcccccttatcacttccttttacttctcctccatcctgtccttataactttaacatttaaaaaccaccatttatttacctatcttgtgtgtgtgtgtgtgttggggggacatttgtgtcaccctgtgtgtaagtgtgtatgtgtggtggcggcatcagaggacagcttgcagtggggtttgactcttcccttctaccatctgggttctagggattgagctcaaaatgtcaggcttgatagcaaactctttgctttcactgacttctgcctgccctcccacccactttttttttttttttttttgaggctaggcctcgatgcccaagctgagataggtaagagccaccacacttagctttaaatatagtttcttttttttttttttttggttttttgagacagggtttctctgtgtagtcctggctgtcctggaactcactttgtagaccaggctggcctcgaactcagaaatccacctgcctctgcctcccaagtgc

SEQ ID NO: 36329 - DNA, 1156 bp, Mus musculus
tgcagacatttggttgtgatgggctgctcccagcatctagtgggtagaggccagggatgttgctaggcaacctccagagtgttccggcccattactagtaccaaggttaaaaagtactgcctgagaccattccaggccaaccactctgcagaatttgccttctggccttggcctttccaggctccataactgcaagagtgaattcctcaacattgtattctctttaagaatcctctaccactgttctcaaatccttactatcctattgtttgtttccattgtcttggacctgctaaaaggtgcatactttgggaggaaaccagagttactttatatatgtttgagaacttaaattctaggttagcatccttagaagatctttcttagccgtgaggcttatatttagaagcaagcagcagcctggcagattggcatgatttttaccaactgctcaaaggcatcatagctttcagctgtgtctacggaaagaaaatgtctttgttttttttattcaagtcgtttaatagctctttaaaaatattagcatatggcagactgattagaagcaaaactctttcttggtggttgtgatgtggctattctagaagtattgtgctgtatgctttggttaaatctgttttaaaacatgctttaagactcaccatatgcagttgtatactttaattctaagtaaacctatcctggtcagtctctagtcatgctgtgtattataaaagtatgttgtggttgtagagttagccagtttagcatgttcctaatcagaaaattagtggactccactaggaaatgctatcccattttcccttcccagtacctcttagttgatatcatagtatcctcacttaaactagtctttagagtaaataaggaaaaaaagccatttattttcttctagccatgtattgagagtaactcatatgtgtataattttttcaaaggccagaggattacttctccagcgtgtagaaggctgtgtccattctgctcacctaggtttcagtggtcacagaacttttggcaaggatgctacgtagctcattggaagtcactgctggggctcagctgggattcagcaaaactgcatatcgcttgtgctcagaacctgtgttctggatgacattgctttttcatttgg

SEQ ID NO: 36330 - DNA, 1142 bp, Mus musculus
ggtaacttttcagtatttactacttattccagaattccgagagtgtcagtccccaaataaagtcagctatcactgaaatctgctgcgtaactgttaacccttccctgagattttgagaatcatagcactgatgataatgaagattataaaggtcttagattctttgaagcttaaattgtgtgcatattgcatatttatataaatactattaatgatgtgtattgattatatatagaggtcattttaaggtgctttttatttaattttaataagtataataggcactaaaatgaaactcaactgggtactatcatggaaacaatttgattcatttgcatgctcttgcgttcttttcctatcttgtttctgttaccagttcagtactgtctgggtagctctgaattctggcttttcccaggcaaactcttcaattatccaagtgaggtagaccctcagcagtttttgcctggatataatgacactaaaaaggtgtatatttaactcttctttttcatactagatctgtacctttgtatcccctgcccccaccatgtcccctgcaaaccagaaactacattttgtttcctctggaaagacttctcactgtgctgtgtgcttaggaacttcgaggtcccattgccatgctgtggcattcgtgactcgtcgtcaccaaggggctggtttcccatgttgtcatctttgctaacactgggatctcagatgtttgccgaacatttatattcatgatggttctttaaagaagggctagaacaattgccttctacctagagcaaactaatcctaactgatgaagtcaacacttaacttttcctacattcccagatttgagccagaaaatagctacaatgttttcaactagtgtttctgagctagctcttttatcctcttcttagctcttgtcggttctgactttcccttgatcctcaataagctataagtgaatctacaatcccatgcattctcttcctgctcacagatgggggcagtaacattttctctcagatctaataatgagccctctcttagcttttaactgtcacttccccttctggttggtcattcagtggcctcaaaaagatgtcatccactgcaggaaggagttgactgagagtcacaaaacc

SEQ ID NO: 36331 - DNA, 1222 bp, Mus musculus
aaaagagagaaaagagaggatgaggataggagagacaggaggcaagaaaaggttttgactaggatcctggctgcagtaggagaaagagataacggaaaaagaggtagacagtcagggaacctgagagacaaaagacagcagggaccaaggagacccaggaaaggcgggcagcgcctggagaggaaccaatgcgcatattgcaaggaaatgggccactggaagagtgactgtccgaaaaaaaaacaagaggtaaaggtgctttctcttggagaagatgaagactagggggaacggggctcaacccccctccctgagcctatggtaaccttagaagtggaggggacccccgtggactttatagtcgacacggagacgaattttcagtactcaaaacacctctaggaaaagtgaagaaaaatgaaaaaaccttggtgatcggggccatgggacaaaaatcgtatccatggaccacatcccgagtagtagacatagggcgaaatcgagtaactcattcgtttctagtcaatccagagtgtcctatgcctttattggggagagacttactaaccaaattaaaagcacaaataactttcacctctcatcgaccggaggttttccagggaataaaagtgccccagactctagagctgtctttacaactaggggaggaatatcgactttaccaaaataaagtaaagccccctgagggattacaggactggttgattcgataccctcaggcttgggcagaaacgggaggagtggagatggcaaaactggtccccccccccgtggtgattcaaattaagtccggggccacccctataggggtctgacaatatcccatgagcagagaagctcaagagggtatacgcccccaaatcaacaaactgctccaacaagggattttggttccatgcaaatccccttggaacactcctctacttccagtaaaaaaaactagggaccagtgactaccgtccaatccaggaccttagagaggtcaacaagagagttcaggacatacaccccatggtgtcaaatccttataaacttctcagcaccttgccacctggttggacatggtacacaatcctggatcttaaagacactttttttctgtttgaggttacaccccaacatccagcccttgttaactttcgaatggcaagactccgagagtgggcaagccggacagctcacatggacgaggctgcctcag

SEQ ID NO: 36332 - DNA, 1143 bp, Mus musculus
gagtaacagccaactattccctagcatcttatgtacctggaggatttgacctagacgagtgtactgactggtgccatcagctcagtgtcaccttcactgaaccagggaaaagagctctgggatggacaaaagggtatacctggggtcttaggatttataaggaaagatatgatgagggattattgttcactatcagattaaaaatagagaccccctacaatcctttaggccccccaaccaagtccacacccctcacccatacaattactcagcctactccattgattgcggacccccttaatatggccgctatcacccaacctcccactcctcaggtacctctaactattacccccgagattccttcaagacagaggatgtttaacctagtgagaggagccttttatgcccttaacagaactgatccaagcgctactgaggactgctggctatgcctgtcctcgggtccgccttattatgaaggaatcgccttcaatggagatttcaacagaaccagcagccatacttcctgctcttggggtacaggacaaaacctgaccctgactgaagtatcctcgaggaatccaggtctctgtataggcaccccaccttccactcacaaacacctatgtggacaaattcagtccatgtccagaacggaagctaattactatcttgtaccttccccggttggatggtgggcttgcaatacaggacttactccctgtgtatcaactaaggtttttaattcatctcatgatttttgtgtcatgatctagctgttaccccgcgtatatcatcaccctgcatccagtttagaagaaagctatgctggccggcggtcaaaaagtgaaccaattactttaaccctggctgcattcatgggaataggtatggcagtaggagtggggatgggagtgtcagctttgatagaaggaagacagggaattcagtctttgagagatgctgtcaatgaagacctagcggcaatagagaagtccattgacgctttagaaaaatctttgacctccctgtctgaggtagttttgcagaacaggagaggtcttgatttgttgttcctaaaagaaggaggactgtgtgctgcccttaaaaaagagtgctgcttctatgcagatcatacag

SEQ ID NO: 36333 - DNA, 1125 bp, Mus musculus
ctttattattgggaaagcatagtggattaaacaaagtgttctcactttacgtgtgaataatttttgtttttcatttcataccgcaataaagctgagaaaaaacgcaagggcaaaacagtcaccacaccttggactgaggatcccagactttttgcagatcaaggagcagccccaggtgattgcattgtttgtttttttaaaaatctatattacttacagtatatattctgtacattgaatgagagtgcaatgttttcaggggaaactatctttctaagaaaacaaattcaagaagcagcaaaatgagaaattggcagaaattttcattttggttagtcaaatttgtctcataataagttgaccctattggagaattggattttatactaattatgatttaatttcaacttttctccctaccctttcttccttccaaaatctctcatggattccctctgttttatttccactttcatggctcttttttcataatttgttcttgcatttaagaatatctatatacacatgtattcatacatataacctgtacagtctctctctctctctctttctctttctctctctctctatatatatatatacacacacgtatatatagacaaatgtgtatatatatgtgtgtttatgtgtgtttgtgtgcgtgtgtgtgtgtgtgtgtgtgtgtgtgtgtgtgtgtttctgacttgatttgtagacctttccatgaatcagtgtgcttttccctgcttattcccacctctatctttcccagcttttctcaattggtatagtcctttgtgtagggttgaggcatcacatgcctttttctttgtccagcatgtacatggattgttatgatttttgttcagctcactttttggtggtagtgttggtgggattttatgtactgcacttgatattactaggagtctttgagcaaactccccaactctctgactctttccagtctttctgctacctcttgagcagtattccctgagccttaccttaggtatagtaatgttctgtagatatatccattctgattggaaatcacaactgttgccattgattggttgtttttcctgcaatcatctctgtcacttgcaaactaaaattttcttg

SEQ ID NO: 36334 - DNA, 1147 bp, Mus musculus
tagtagttttcatctcatccgtttttattttatagaatgtttttatagaaatattttatgaaagttgtagtacattaatagtatactcttattctttaaattccatctaatacgtttgtattagcatgattaaaactggctgttcattatttatgtcttcagttatttttattgtgtttacaagtgtacttcatgtggcaaagagaagaaacatttttatttggattaatctttatatctagaaccaaacagctaagtccaaggaggaaaataccagcacttctaaaaacaggagaaattttttcttcaaaagagaatttcaagatgcacttaagctctcgtcagctcaattattttagtctggttttatgatgttttgttcctgatctactagtagaaagggaagagccatctaaattattcttttttctgtcagtgcccttttttgttcatactacagggggaaagcaattttataagcttatataaagtgttcttactagtttttgatattttttaaactgtaggctagattaaaattgataattttgtgcaggagatgtttattttaccagagtgaattggagagaattggataaattttatacctattttacaactttctatatttttgctaaacttgaacattagacacccaattctgacatctttattttctaagatatttgtgtccagattttaaatttgtgttttattttgtgtttattactcatacagatactttagcatatttatatactattatatatatgtgagaagacacaagtgactttttgaattgaatatggcactttacactgccacagaggtaataaaggtatatatagatgtttaatccctgaaaaaatatatacatcatttttctatcatcagtacctctcagcgtattattcaggtgataagaaactgcccataaattggctcccacatagggaagctctttatcctatgcaatatttctaattatttttcttagttctgagccatcaactttgctacattttgaaaggtgcattaattctgacattgagggttttgtttttccaaataatagctttcaaagtaaaatggtgctgcatgttataactttatatgatggtgtagtgcatataagctatgagaatca

SEQ ID NO: 36335 - DNA, 1179 bp, Mus musculus
gataaactatgctcttgtactgctacaaagggccatcatcttcaggcacatgttttgatatagcagtgtgtcacctggaagctgagcctcaagtactgtgttattaatggcaggcacttgggaatgttttacttccaaatataaatgagagcacatttaaaactgcagctaacttcactttgactcccagtttgataggctttcataagtgagagagaaaacagcttgcttgccaggaatcacacatgctagcaccatcagacatatgtatcttattggaacagaaatgatgagggtgttgtaagaaaagctaagaaagtgcagttcctatgcaaattctaagccagaaactaggtaaaccaaaccaaatcaaacaactcctatgagccttcactggaggtcagtgagtcctgtagttaacttacattctcttctcctttgaagcagagaatgttttcctaggtagaatcatgatgtttccacataataggtcagccccctcaggccatttcttggggtctttatctcacaggaatagccagtcctatgactaatcctaagcatcctttatctgggaaacagtatcctgcctaggagtttccatgactgctctctgccctcaggtctagattgaggtccagtttctctgcattccaatccattcccattagcaggaagcaacaaacttctgtcaacgaaagagtttatcactgtgggcaaagggttaatacagccttttccccttctcatggaaatctgtccttgtgttaacttaccagctctgttgccctggaaacgtggtgaaggtggaatgtcaactgtgttaccaggcaatattgcttatagtaaaaatgacccaattgttaaattgcttctggtgctgctggattgtaaatgaatctaaatacctgtcagggagccatagctttgggcttccctgactgtggaatacatgaccccaggaaactgcagttgtttacaaaatataccatcctgtgggatctgggaattctaagccaagatagaccttctactttgttgttgttgttgttctcttctgagctgctacctggggatccagagatgaatccatggatggatgtggtctcctagaaagaccctcttagaggacacatgcctggagctgccctgctgatcagggtggtttctgactctttt

SEQ ID NO: 36336 - DNA, 1159 bp, Mus musculus
gagacagacagagagatagagaggagagacagagagatacagagatagaagcagagagagacagaaacacacagagattctgcttccaaaaacaaacaaaacatcactaagtgctataagtcagtggtagggcgcatgtttagcatgtgcaaagcactgggtttcatgccagtactgagggattaaaaacttagactaaaaatcaggccaggatgatatggtggaagcaagaagaaggtattacaacagtgtgtgtatgtggggtggcggggcaaagtacaagcttaacatgtgtatatgaaggggtagggagagaacaggatgggtggaagaagaaatggcagtgactgatgattcttgtaaggagttttgctttgaagggaaatagagaactggagcagaagctctgtgacagtgcagtatggaaggaaaatgtcttcaaaggtatcagcatgttgtgcatgcttggtttccaaggagaggaggaaatcagtgctgggaaagagatctgaacagttatgaagtctgagaagcagagatggggtaagattaaaaacaccatctgaagggaaagtgacagatccgggcagagaggcaggtgagctggtggactgacagaggtggaggcggagccgggtgtttccccttgccattaaaaaaaaaatgatctctattttctctatgaagtaagtggtgagatcatgagctgagagggtgttggcaacccgaggagaggaggtaaggtgttaataagctgtctcaggggaacgtggatgcagtaaggaagtgtagtgggattagctggctgtgtggagagcctgcggagatttatggtcctaaacttgaagcaagtccagcttttcagtcactaacacctgaggctttggaattacttcatgggactcaatgccaagctgtttcagccttagacatttcttgttgttggcctattggatattgctaattacatttagtaagtgagttttaaagtaaaatttgcattgatgcctgacattcctgagtttaaaaagaggtaggcagcttctaaattgttcatgttggtgaattttcacaaaatagataactcaaggaaaaactactcagatggagagacaaaagcattgttgtgctgtctctaagacactatttaccttgccag

SEQ ID NO: 36337 - DNA, 1243 bp, Mus musculus
atttcactaatgatattcattatttaggtgacttataatttgtagggtggaagcagtttaaagaaaccttttctgagcctgcaagatggctcaacaggctcacttgttttataaaccaccatatgatctaagattacatgcctggaactcatgtaaaagggagaggaaagaaccaactccccaaccatgcacaaaattttcttaacattttaacaacctagtaaaatttacccacactcatataataataaaacacatgcactatatcaattgacattgcactgtcagctgggatcttgatattgtgctacacacttgatgactgaaggaagtgactaaacagtgcatggcaaataatttagagtcactgaaacaccctttaattgatagtaaattctgtttttacctatttggttgttatctccaggctgaaaatatttacaatgatgaagagtcagatgtcacggcatcggaactggaggggcaaggatcttaaacccaaagtatgagttgtttttattgaatgtattgctacatgaatgcttgatttgtcaagcgccaaaaaggcattgtatagtaggaaatgtaagtgggacggcttctggcattctttaccctctgattctagcactttcaagtgagctgttgcgtactgtatcatattgtagctattaggggataaaaaggaatgttgcttaagaacggacatcattgttttaagacacacattgctgggtattgcctttgattcaactgtcattttctcaaacttttaaagtgcttgctcaagttcccaaatatgcgaggataacttttacactttttccttccaacacttcttgattggctttgcagaaataaagttttaaaataaagtttgttttgttcttttagaagatgtggaagggtgggtgggtgtgcatgctcccatctctcatagtatatatagatttgtatgagccacatgagcaaccaaagaataatacacagaagctgttaatttcatcatacatatttacttaatctctacagaattgagtagataaaatcagatttacggtagtgaaaaatctctacaaaatgtctttgaaaagcaaaacaagactgcctcttaacaattcatatcctcatgaaagacgtgggctgtaaaaataaagcagtgtgtttagcacaaactatatctgcatcattttttcacagttatttccatctacagtctgaaagaggtagatttttttttctg

SEQ ID NO: 36338 - DNA, 1775 bp, Mus musculus
aacttagtactcataaagtagtcctaatatattgatttgaggatagatgacataaaaaggtgattattccttgaaaagtgcttttttgcagtttccagcaaaaacataaaagctcccttcctcaccatacattctggctttgttgaagttttgtgttcatttgcattaagactcaacaagcagggctgtacatgtgtgtagctcagtggcaagcatttgcctatcataagaggctctgggttgacaagtttcatcagcaaagaacactagttattttgtttcctaatagagaatttaaattatagatcagataacataagataacatttccaaagtaaaaacactggaaccagcttgggaaaacttggcagattgtttacatagtcaaaaagacgcctagctttctagtctatttctccgttttttgatgctatcactttaaaacaataaaaaccagtattaatgtttgacactttgatatttatggctcagccatgcaaattactaggtctttggtaaagtaaatttattaaaggttctagtaaagcaccatattcagagactgacttgttcaattggctaaaaatttcatttatactccttagcacattttatttttatggtcaaatctaggttcaaataattgaaaaaatggccaaaagccagaaaacagtccctgtagatggttatttttctaaactaatcaaggggtcaaaagtaaaagaagtgaaaaaagtgaagtcagaaacaacaaaaaaaccctttcagtagcctcttatcaaatactggactttttccccatgaacgtgtcagaaatattgaaattactactaatgattacatttcacaagtctgctggatacacagctcttaacatttgattaagccatgtgtgtagcctgccacatttttgtggtacttgtcctgtgtggaatattgcatattttcaagggctttataaagcaatgcgattaacagtcctggcctgctgctttcggcttacatgcattttcagctagatctttagaggacagagattctgtatgaaatatgcatatgcaaaatctctcctcctgtgaatgaaaacagatgggacctcaaagaaggatgccctccctccctcccttaaagtgatcacctcagcagcccagtgttgtggctttgtagcacgccctgtactaccgtattctagaacactgtaatgctactgtgctggcccagaaaagatttctatgttgaattcacttactgcatatggtgcactaccatgcaatcttgatgtatatttttagtgtcagtagaccccaaaatgtagcgaaacttgggtatcaggccatttcatcctcagacttgtagaagtacattttctggtcttgagacctgtattttttagttatgtatgcaactgcctttattacacacctggttatcacaattcaactctcaggtgttgcagaaaaaaaaatctacctctttcagactgtagatggaaataactgtgaaaaaatgatgcagatatagtttgtgctaaacacactgctttatttttacagcccacgtctttcatgaggatatgaattgttaagaggcagtcttgttttgcttttcaaagacattttgtagagatttttcactaccgtaaatctgattttatctactcaattctgtagagattaagtaaatatgtatgatgaaattaacagcttctgtgtattattctttggttgctcatgtggctcatacaaatctatatatactatgagagatgggagcat

SEQ ID NO: 36339 - DNA, 2101 bp, Mus musculus
aggcaggccttgaacttgggatctccttctcagcctcctgagtagcctgggcacaacagcttctgtgagcattgtgcccatacacctcctagtaacagaaattcttttggatactcaggaggagaatatgcagcaggcacgagaggaggaagaacgacgtaaagaagcaacagcacatttccagataactctaaatgaaatccaagctcagttggaacaacatgacatccacaatgccaaactgcgacaggagaacattgaactgggagagaagttgaagaagcttattgagcagtatgcactaagggaagaggtaatatagcactagattgttttatactgcttctcactgctagtagcaacttgtgttcactactataggaaaagtattactgcaggatgttttagaacttctgtctatgtgtaacacaagcgggcttattagaatagggaaagaatcaaaccattgcatataaccaaccaggaagattgagaatctgtctgcacaaataggtaagataatttccaggagtcttaagtactagttgcatgtgatactagaaaatggcaattctcacaacacagactgttttcttatcttgactaataatggctaaatttagccccagaatgccctgcatctatagccatttcattatatctgtgtttcagggtttgctttggtttagttttatttattttgtcattcagattgggttttgcttatcaccatgagtggcttccacctaggtttttcgttaattgtgctcttggttaaatacagagccttggccatactctgaagcctttctgctactgagctagctatcttcaaccctatttttttatctttttcatgtcaaaatcaatcccaagaaccttgtgtatgctacgtatgttttatcatttaacttacatcccaggcctgtcttttgtgagtcttttttgtttctgttgtttttcgggggtaggggttgtcctagaacttgctctgtagaccaggctgacctcaaactcaagatctgcctgcctctgagtgctgagataaaaggtgtgtaccaccacccctggccttttgtgagttttgtttttgtttgtcctttatctgtggcccaggctgacttgaaactcactgtattcctggcttgcctggaacttgaggcaggtgtagtctttgcttcttgagtggtaagagttcaggtgttttgttttgttttgtttcttttttccagacagtgtctgaaaaaagacactgccttgaacagtttttaagtttttcagtctattttaaattatatgtatatatgtttgtctttgtctgggtatgaatttacacatgagtgcagtggctacagtggcctgaaaacggtattagatcccttgcaactgaaattacaggtgactgagagatgcccaaggtgggtgctggggaccaagctcagaacattatttgtatttaattgctaagtcatgttcatagctctgtcttgaactcagtgaaacactgtaaattatcttctgtgtatggatcttctgtacgcatgtgtctgcacatgtgcctggtgcccaaggaggctagaagggtgtcagatcccctgaaactggagtcaacacatgcttgcaagccaccgtgtgtgctggaattcaacccagattctctggaagaacagccagtgatcttaaccactaaaccatctttcaagccccatttgtagatactgagtgtataaatcaaagttcttttggaccatatcatttgaccataaatttaatcactgctagaatgtatttgcttttcttctaaaattctttgtgtgtgggtgctccaagaggtcagaagaggatattgggagtccctggtgctggaattacatgcagtgtgagctgcccaatgttgggtcctctgcaagagcaacaagaagagcagcaagagctcttaaccattcctatttttctgttaatagcaacatcctgaattaagaaccaaataaagcctatctgttttactagtttatgtctcatctccaaaatacaagatttctttgtcctgttttattattgaagaacttattaaatagttttgtggtttggttgtcatata

SEQ ID NO: 36340 - DNA, 1429 bp, Mus musculus
ccttttcaacacaggtagatttagtatcaagaatatgtgaagggggctagacatggtttagtggttaagagtgcctagctacttgtccaaaagactcaggattagagtcccagcacccacatggcagctaacaacctactataattccagttccaggggatctgataccctctctggcctttggactaggaaagtaccataaatgtggtacacatgcaggcaagatgcccacacacataacatttttaaaagatacccatgaaagaacacctaggactggggatgtatatatatctcagtcagagcatttgtcttatatgtatatacaaggtcttagattcaattcctagcacaagagaataataataatatggaaaaataaaataatatctacaaatatgaaaggaacaaccaaccagtggaaaacagggcagaagataggaaagaggcattccatagaagtagaaaaccagagataacttgccctaacgacccataaagatagatagagagaggtattaacttcatgtagtggtcagaaaagaagatcacaatgagatgtcattttccatccctctctcttaaagactggctttcactctgtagccctggctgtcctggaattcagcaaggatcaccagtgtttgccactgcctcctgagtgctgggagtaaaggattggaccatcatgcctggtcctttgttgttgttgttttgtttgtttttgagacagtgtttctctatgtagccctggctttcctggaaagtttctctatgtagatcgtggctgtgtagatcaagcttgccatgtactcacggacttgcacttacttacctttgcctcctgagtactgggattaaaggcttacaccatcaccaccaggctggctcacaaggtagcactggtacaactacaaaatcttcttgaaattttatttatttaaatataggaatgctctgtctgcatatacacctacatgccagaagagggtatcagatactttatagatggtcatgagccactttgtagttgctgggaattgaactcaggacctctagaagagtagccagtgttcttaaccactgactcacctaacgaacccacatgcctggtccattttatatcttttatgtggcataaattaagaaatataatctttgcagggcgtggtggcgcacgcctttcatcccagcactcgggaggcagaggcaggcggatttctgagttcgaggccagcctggtctacagagtgagttccaggacagctggggctacacagagaaaccctgtcttgaaaagccaaaaaaaaaaaaaatcttcatatacttaaaaagagtagatttgcatggtctcttgtctttatttcccactttttttttttattttcagtgttggtttttttcgagataaggtttctctgtatttccc

SEQ ID NO: 36341 - DNA, 1203 bp, Mus musculus
gtttcagagacatcaatttttcctggtgtcccagcccaccagcgccacactatggcccagagtgagcactacaagcattgctggcctaatggatgggataggggagggaatgggacaggggctagaagaaggactccatagggtcatcaaggcacaggcactatacgcatggtgttggtgaagccagagccagggcgccacctggtcaacacaacgtccacatctttcttcttgtagaagcctcgggccttgccaacattcatggccaagttcagagccagcagctccatgccgtcatggctgacaacttcctggaacacagccagcaacactggcatcttttgtaccattggccctgcttcctggtctgtggagatgctgaaggagatgattaagtctggagtgaatgtgctcagccgatttttctttcatggaacccatgcgtaccatgcagagaccattaagaatgtctgtgcaacccacagaaagctttgtatctgattctattctctaccgcctggttgcggttgctctggacacaaagagacctgagatccgggactggactcatcaagggcagcggcactgcagaggtggagctgaagaagggagccactctgaagatgaccctggacaatgcctacatggagaagtgtgacgagaacattctgtggctggactgtaagaacatctgcagccgggcgtggtggcgcacgcctttagtcccagcacttgggaggcagaggcaggcagatttctgagttcgaggccagcctggtctacagagtgagttcctctatgtggacgatgggctcatttcgctgcaggtaaaggagaaaggtgctgatttcctggtgacagaggtggagaatggctgctccttgggcagcaagaagggaatgaacctgcctggagctgctgtgaaaagaggacatccttgccggcacatgcctttaatcccagcacttgggaggcagaggcagacgatttctgagttcaaggccagcctggtctacagagtaagttccaggacagccagggctacacagagaaaccctgtcggaaaaaaaaaaaaaccaaacaccaaaaaaaaaaaaaaaaaaaaaaagaggaacactcaatccaaggattgcctccattactctgggcatgttgataaagctttctcttaattgctaactgatgtaggaagacctagcccct

SEQ ID NO: 36342 - DNA, 1184 bp, Mus musculus
attgcctggagctggagagatggctcagtggttaagaacactgactgctcttccagaggtcctgagttcaattcccagcaaccacatggtggctcacaaccatctgtaatgggacccaatgccctcttctggtatgtctgaagacagctacagtgtactcacatacataaaataaataaaatctttagctgggcagtggtggcgcatgcctttaatatcagcactttggaggcagagccaggcagatctccgagttccaggccagcctggtctacagagtgagttccaagactgcttggactacacagagaaaccctgtcttgaaaaaaagaaaagaaaaaaaaaacatggaaggatggagtcaccaaccaaaaaagaaaaataaataaaatggtttttttcctttctatttaaaaaacaaacaaacacagccagctacagaaggcaagattttctgtgcttctgaagcctagaaaggctcaggagttctggaggcacactgcctctgtccctacacttccatagctatgtgatgtcagagtaggctgactctgctgcaatccagagggaagccaaggctgaggccagagctaagagttgaaacggctccagtggggctgggaattccagggatgacaatggttacaggatctcttgttttcaaaactttgtatgaagccagacgtggtggtgtacgcctttaatcccagcacttgggaggcagaggcaggtggatttctgacatgtgcaccatggccagcctagtctacaaagtgagtcccaggacagccagggctatatagagaaaccctgtctcaaaaaaaaaaaaaaaaaactttgtatgacttgacttctttttttttgtttgtttgtttggttggttttttgagacaggatttctctgtatagccctggctgtcctggaactcactttgtagttcaggctagcctggaactcagaaatctgcctgcctctgcctctgcctcccgagtactgggattaaaggcgtgtgccaccatgccctgcatgacttgatttctaaaactacgggtatcattttgtttgtttgtttgttttttaaagaaatcagttttttcccttttagacaggatttaactctttagcccaaattagcctaaactgcagttttatgtattttgcctgtgtgtatatctgtaccata

SEQ ID NO: 36343 - DNA, 1143 bp, Mus musculus
tgagaagcgagatgaaaactgggataaagaaattgagaagatgcttcaggagagttaataattgtctccgcaaaccagttcttaacattgtgtgacatgaaattctcatgatcgctgagtcagaaggcacaaaaaaagggtgtaactttatgcaatttgaaatgattctttttctagctaaaacttgcctcttaaatgaacagctattgtaataatcagaaacaacaggatattgtatgtaacatttcatacatataaaattagcattcttataagcagcagaactatctgtgccacagaaacacaggtaaatactagagtcttttttctagaaggttggcaacataatttattctttagttatgtttttctatatatgcctttttgttgataaatggttaaagtacttactatcagaaagtaatatcttactatcaaaatgaccaaattataccaaagaaatcaaaagaaagcactttcaaaatattttcttgccggatattttctaaaattctatctgaaagacaaaagctgagatatttctgttcacttgaatgacataaatatcacccagtttgacatgctgaaacactttctgtgcaggactagggagggatgtggtgaacacttgttgttcacagtgctccaggttccatttccactatctcagctaaaagtgcaagccagatttgtttaaataaagttgaacttctccctagagccttctcattttgctttgttaagtataccacaaattcaacgttgtgctttttgtaggaactgaggtcttcagtcctttttgtattaataactgtcaagaagcctgtttaccgtaaggtttgttctcctggtaatagtcactatgtataaatgtcttaaataattatcctttatagaatggtcttccttgatctagaacctactaattaatacttcttgtattctgctatgccatcaggcaactgttcatagaatgtgatgattttaaaagagcaaggtgatttaatgttagaaaactaactaccattcacctttcaagttttcacagcacttttatttcataagggaaataaaatcaagacatttctttataagagaattgtacgtatttatattcttgtactcgtaaaattcgtctccggg

SEQ ID NO: 36344 - DNA, 1252 bp, Mus musculus
tagcccttgtctccatactgatttccaagccattaaggctgtgtagtgagatctcgtcttaaaaaaaaaaatccctaatagacatgctcaaaggccaatttgatctagacagttcttagctgagattcaacctaggtgactgtagattgtaggtggtagaaagctgaaagttaaaactgaactaactctctctctctctctctctctctctctctcctccctccctccctccccctttccccaaaccatcccttgcttttttctaaaattgtgccttgctatacaactgagcctggtcttgaatttattatggtcttcttgcctcagctttctatgaagctggaattaggcctgcatcccaaagtatagctttttttcagaattttaaattaatttaaaaaaattatctttaatctgttttttttttttacagtccagttgttatccccatcctggtctgccctatgactgttcctcatcccatccctccccccccctccaaagaggatgtccccaccacactgctctaccccaccaggcctccccattggttttcttatttctgtataaacagtttcttgagttttgtcttattccaatggtgtattaaggaaaatgttttattatcattgatcaggtcatctgtatccatgatgtttcttccatctaccgagtgcctctccttttggaggagcaaggtgtggttaaatattttcaagagagattgggcctgcccatcaatgattgttcaagtaatttgcttttcaagtggaaagccatggctgacaggtacgtaaaaggaattctgtaggtaaaaaaaaaaaaaaaaaaaaaaaaatttaacataggatttctaaaaaaatcgtttcctaattctttccagacccagtttttataaacaacaaataggattgtggtattaaagatgaacatactacagcttctggttttatgtgggtttcaactgagtttctcatgcttttttggcaagtgctttactgaccttggcctctttatgtaatcatttataatgcctgggtctggaggtggaagtaagacctactttaaaggaccacttgtttagaactttgtatgcatatgttttgatgtagatgtgtacctgttgttagagtgtttctctgtattctttgaagatttctggagctgttgacttttctgtacttaaacccaagtgagttagagggatttggattctcaaaggaatatttttaattctcgcagtatttttatt

SEQ ID NO: 36345 - DNA, 1166 bp, Mus musculus
cagttttgagaaactgtcataagtgcctgtaaggttgaccttcgaagatgttcagtttggtaatctagtctgaaaatagacctcaggcattctttagtgattgtccaagcactgagtttgggaacattgaacataatgaacaaaaacacaagttttaaaaataaaagtacatgtgggctggtgagatggcttcgtaaaggtaaacgtccttgctgccaggcctgacaacgtgagttcgatccctggtaccacgtagtggaaggagagaaccagttgctataagatgttctctgaccttcacacactcacttgctcttgcacacaggcatgccgagacccacagatacacacacacacacacacacacacacacacacacacacacacacagagagagagagagagagagagagagagagagagagagagaaacatacaaacatatgcacacggtcattatttaaaaatatttagaaatggtggatagtcaaccttactttccttttgtgttgatttcagtgggattcttgtgcccggagggtttggaatccgaggaacattgggaaaactccaggcaatttcgtgggcaaggacaaagaagattccatttctgggtaaagtttttgtttattgatcctatgagtttaagttttttttttttcagtgctaggagttgaaactaggactttaagggtaaatgaaaggcaactgtgctattgaggtacatcaccagccctttttcaggtttttgacataaggtagatgttataccttagtaggggtaacatgtaataggtttattcttgtgaaggtgtgtgaacttagttttaaaagtcaggcaccaagtggcttactacacggcttatcaaactgaatgtagctcctagcttggttttgtaaataaagtttaattgaaacacatccacccaatttgttttgcatattgttcatagttgcacagtcggagaagatccaatgacttgtaaagcttagaattagtactgagtttataagaaatagttgtcttctgaatagcaaaaatctggaagaagtctgtttctatagtctttttaccggtcctcttagcatttccagcaaaagccattcaacagaacactgtaataacctttctgttggaaaatgatgtgcttaagcagtgtgtggtt

SEQ ID NO: 36346 - DNA, 1144 bp, Mus musculus
atcctagaggtagaagatctagtaaaactggcaaatcacaggagctgagtattttaaaaaatatttttaaaatattcttttattaaatgtgcatttgtatgtgtgtttctgggtgtaagtatgtgcactggttgtatgcagtacttgaagaggccagaagatgttggatttcccagagctggagttacataggtggttctgagccatctgatgtgggtgctgggaaccatcccatgtcctctgggagactgttaaatgctcttaaccactgagctttctctttaacttcttttaaaatgttttaaagaggcatagaaaaataagaacagaaaaacaagctcttattatttcttttgaatttattggctactgagtgagcgtttgatgaatttctaatcaagaatctcatcatttaagacactaaagaaaattcactttaagtcagcttaattatgggggaagactcatagtgtgtgtgtgtgtgtgtgtgtgtgtgtgtgagagagagagagagagagagagagagagagagagagactgagagactgtcttgattgctagttgatagaggagggcccagctcactgtgcactgtcggtggtacccattcctgggcaggtgggcctgggctatataagaaaactgatcaggatcagacagcaagccagtaagctacattcttccctggtttctgctttaagctcctgtcttgccttggcttttctgcatgatgaattgtgacttggaagtgtaagccaaatcaacccttttctcccaaggttgcttttgggctgagtgttttatcacatcagcagaaagcaaactaggacaccttaataaacaatctacagttctttggtagaataaagggtagacgtaaataaatcactgtacatttgtaaatacacatgcatatatttaattgtaacttccactttttgttgcctccagacttactggctgcaaatcattttaggagagtattcaccaagcccctcaaaggttaaattaaattgaggagtgtgactgcaatttgattatgttttgatattttattagtcctctaatgtattttgaagtcctgtttttatacatctctgtaggtcacccagatggcttgttgaaaatttaaaatttttacccc

SEQ ID NO: 36347 - DNA, 1199 bp, Mus musculus
ggtttggacttcccattgtgttctggatttcccggatgttttgggctaggagtttttagcattttgcgtttttttttttttttttttttttctgtggtgtctatgtgttttatggtatcttccctcttgtatctcttgtattttgttggtgatgctcacatctatgactcatgacctctttcctaggatttctttctccagaattgtctctctctgtgatttcttgatttctttattgtttctacttccatttttagatcctggatggttttgttcaattccttcacctgtttgtgttttcctgtaattctttaaggcatttttgtgtttcctctttaaggtcttctagctgtgtacctgtgttctcctgtatttctttaagggagttatttatctccttcttaaagtcctccatcagcatcatgagatgtgattttaaatccaaatcttgcttttccagtgtgttagggtatccaggacttgctgttgtgggagaactgggttctgattatgccgtgtatccttggtttctgttgttaaggttcttgtgcttgccttttaccatctggttatctctggtgttagttggtcttgctgtctctggcttgagcttgtccctcctgtgggtttgtaagcctgtgtcagcactcctgggagatgagttctcctttagcaggacccatgcatagagggctgaggaacacccccacctcctgtgtgcagatggagacaggaaggaccctgtcccagctgctccattgcttctgcagtctgtgtggtcctggctggtctaccacatgcattcctaaacaattttagttttgttttgaactttacaaaacatcatatgtaatgtcttttcattcaagcttctaacattcattgcatcattggtgtttttttgttttttggtttcttttgagatgtggtctcactatgttttagttatgttttctattgctgtgacaaaacaccatggtcagagagtgatttggggagaaaagtctttatccagcttacacttccacattgctgtttaccattaaagaaagtcaggacaataacccaagcagggcagaaacctggaggtaggagctgatgccaaggccatggaggggtgctgcttaccaacttgctcctcatggcttggtgagcctgctttcttatagaacccaggaccaccagcccagggctggctc

SEQ ID NO: 36348 - DNA, 2667 bp, Mus musculus
aattcataattgagattataatttaccttttatacagaatattgaaattgggtgagactcattgacaaagtattcttaaatattgtaaatcagtaatgttatcacagatgaagccttccctgtgagaacgaaagcttctataaagtgaagcactgttactaatgttgctttacttgttttatccttgctctattctaaatgggaaaggggcagcttttgtagcctaatattttagagttctaactttaaaattcatcggggatgctgtaaggtccatttcagaccccaccttgggatatttttgtcactttttgatgtgaaaacatctaacatcttgtcagatatatttataagcagatgtttaaaaattttagggagttccttagaatcattttgaggactttcaaaaaaattaatcttttagcttcaaagtcacatttttttaaagtaagtcaacaattaaaagctttcatacttaacaataccatatgatggctagttttaacttgttgggaggaagccttttctctggacctctccttagtgtaataggaccctgatgaatgtgacacactggtgaaagggagttttctaactgaacttgccactaattagcatttacttaaactggcaatcttctcagattagtagtaagtacagtgctttaggattctgtgaaatgtaggttatcttgtttactgttacataccatgaacttgaaaaagataaatctgaactgggcattaagaacttaagtgttcagccacaaaccaaagaacaaaagcaaatctgatgctttagatcattttactgtgaactaaacattctgattgtgtctccatcagcttgtgtactgtgtgtaagaatatatgcatttcttttgtagccacgccatgaatattttaatgtccctgtgtactaatgactgctcatcgactatgcagactttcacagaggaaatagagaactgatatacttatgaaagaaaatgtcctcagcttggtgactaattctcctgtaaaataatatatagcattttatagctagtacctttatgattgtatttttctgtgcctattcctaattctatttattctgtatatgatatgacatagttttttctgtctactactgatttcttctttacaaaatatgacttgtgaatgttttaatattctaaacacatacaagttatcattagtaaatcatctgtgattaatcttatgagggtataagagaaagaccgggaacaatcacaaatgtttaccaaagaaaatagttaggaactcaggcaaaattaggagcaccacaatatttaatgtagtttgatcttccactgttgaagaaaaccaagctttatttagcactaagattactttatagtctgtacaagctaatatgttggacagtatcacataaaaatgtgttgaagcaatataagaaaaaaatcaattgtataattctctaagatctaaggttaaaacatttcaatttttaagaaattttgtattgccaatatttattaagccacatttatgcagtgtcaaaagtcctttaagaactatcagaaagctatgtcacaaagtttcttgtattgttgctcagtaacagcccttgagtcagtagtactgagcctacttatgtgatacaaaattctgatattcattttcaatattcaaacatttatacttattagttaatggcttcctaattaatatattaagccttcttctaaacactcagtgctgtgttaacaatggttgtatattttggaatactaaaagtttttaatattaattttataaaaatatgcttttaataatatttatcaaattctactattaaaataccagataactcatttgtctatctagagagtttaaaacctaagtaaattgttactaaacagtaacttaagtggcatggtagtgcatgcctgtcatcctagtacctgggaggctgatgcaggagcaagatgagttactatagtacctagggcatccctgtctcaaaagacaaaaactaaatatgccaaaaactctaggaacttcagaaggtacccaaatgagtttcccactgaaagaagatctataaaatgtcttaggaaatgtagtgttaggcagctgtacaggtcagctctctccattaccatctgaaacttcacaaaacattggtctttcatttccatttttcccatcctcccacactacatgttgttcacctgattttaatgttgcataaatatgcattgtctcatgcctgtttgttttggatgctgtgtgctgagctgtaacaaaatgttgtgtttttgtgagggggagggggtatctgtatacagctgcttgctttaaattagcacattctcaaatagcttttcctgcatgtctgaaataaagtattgcatgtactttgtctcatgtgaatgacttctttcttctccatcctttttgataaaataacattttatattttcatctctccaggtaatttttttaagttgtgatttttaaaaaataacaatttctgagcctacaatagtactaagtatattcacattgttgtacaacagatccccagaactttttcagcttgcagaactgaaattacataactcaccagccaactacttcccatttctctcttactgaaggcaggccctggtaacaa

SEQ ID NO: 36349 - DNA, 1195 bp, Mus musculus
tgatcaattttaaaaaggaggggctagagagatggggatctgatatcttcttttgatctccatgggcaccaggcatgtatatgatgcacatatgtaaacacagtcaaaacactcacatacataaaataaaccttaaaagtttcaaaactaaataaaaaatcctgggcagtgatggtgcacatctttaatcccagcaccctggaggcagacacaggtggttctcggtgagtgtgaggccagcctgctctctacacagggggttccacgacacccagggctacacagagaaaccttgtcttgaaaaatcaatctctctctctctattatatataggaatacatacatatatatatgtgtatatatatgtgtatatatgtgtgtgtatatttgtgtgtgtatatatatgtgtgtgtgtgtatatatatgtgtgtgtgtatatatatatatgtgtgtgtgtgtatatatatatatatatggaattttcgaattccttgctaggaaaatgaaaaccactattacaccctaagattaagggttggaagctgggcggtggtggcccatgcctttaatcccagcacttgggaggcagaggcagatggatttctgagttcgaggccagcctggtctacagagtgagttccaggacagccagggctatacagagaaatcctgtcttgaaaaaccaaaaaaaaaaaaaaaaaaaaaaaagataaaagattaagggttgggtatataaacaggatggtagtatattttttttataggaagtttaattttgcaagtttctagagttctagaaatgcagggtgattccagtgatatacttgagtaaaactcaaacctcaaaccaggagttttgtttcgttaaaaccagcaacaaaatataaacagctttagtatttttctcagtaactaataactaacttttttgtctcattattctggtatatcttctttagagagatctctatttagatagttaccaacttctaatcagctacatcattttattattcagctatagttcttgatagattctctataccagtacctgatctccaaggtcatctgaaaatactttcagccacaaaagtgcctttattttgttttctttgtgtgtgtgtgtgtgtgtgtgtgtgtgtcttagagataggacctcctgtattcccagactggccttaaactcactatgtag

SEQ ID NO: 36350 - DNA, 1354 bp, Mus musculus
gctcttgccaggcatgtgcaaggccttggatcccttccccagcatgtgtaaacaaaaggagagctacatatgttaacataaaacataatagaaactgatattgtctctctttccaatgaacactttctaaagcttttcaagtatttactctgtaggccatgtgtttttaagaatgagtgaaaaaaattaccttctctttttcctttaaagagaaagttaaaggcagaatgggaagaacagcagagaaaagagcgagaggaagaggagcagaaacgacaagagaagagagaaagagaggtgacttctgtcataggaggatagaaccctgcgtatcttcttggtgtgcacgtgtgcatgtaaagagtttgcagattcaccagtgggcatgtcagggcttgcctttggttttatattttgctcatgttctgttcatttggaaggagtcagtttttgttagaaacactactagttatttggaaacactagtttccaaatggttctcctcttggggtggtgcaatgacagatacctttaccctaagtaagttatcttactgtttattttagagatgggtgaacattttccttaaggggtagatcatattttaggctgtgatatctgtatggcttctgtggacatccaggtctgccagtgtaccctaaagcagacatagataacatgtatatgaatggatgtggctgtgttgtagtaaaacatctctgtaaactgggcagctgccctgttttacactctgtaccactctgtggcaagtgttagtttcctctggttctgtcatatatgtgttgagttcttcacggaagaacagtattgtgaaaagttctaaacctactaaactcataaagagacttaatagctaatgacgtctcagcaagaattagtttaatagacattaaagaattaaaaaattattttgttattaaatctggtatcctgtctaactttgttgtcagagcaattatactcatttaagaaattctgagaaacctgtgctcgctctagggcacatgctaatgtccttttctaacatgcttctctccctgtctcttaatgcttatgcttaaatcattgttaaaacctttccttaataatccccaccattgctttaaaaaaagaaattctgtaatgtatatgtctatatcgtgtacatttcctgggattctttttaaaagcttggtttgttttgctgctggtcctcaactgtgtatttgtttcaaatataacatgcacagctcatcttgccttgaagatattttttctctttaccatcactaaatttgaatggcacgacattccatagtcactcatcttaaaatgaggagagatgtatggaaag

SEQ ID NO: 36351 - DNA, 1302 bp, Mus musculus
tcactctttatgtgaaagagagaacaggggtcaccagaggaatccttactcagactttgagactttgaaaaaggccagtgacttacctatccaagaagttacaccctgttgccagtgggtggttttcttgcctgaaagctattgctgccataatctgcttgtcaaggatgctgataagctcactctgggacagcaaatatctgtagtgacatcccacattcttgaaagcattaccaacgctcctgtgacacatcagagctttttgttgtctaaatgagtgaccttcacttcattccacctgctgtcccactgtgtgagactgcacctactcatcactgcgctgacattctggcaaaagaaatgatctgaattatcagatcagccttggcctgagggtacgagctggtacactgatgacagtagcctcaaggttaaaggtaagcaaaaggcggggacagcagtatggtggtgaacagaaagcaagtgatctaggccagcagccttcctgagggacgtcggcccagaaagctgaacttgcgactttaagacaagctctataaatggcaaaaaaaaaaagtctacactgacaacaggtatgcttttgccactgtacgggacaatatacaaagagggctgttgacatctgcagaaaaagacctaagatgctgtggctaaaaaaaaaatcagatggcagatctaaccgtcaagcaggtggctcaaagaacaatgatcctggcagtcaagaagtctaaagattattatgacatcagagagaccagctttagatacaccgctgaacactatcaagctatagacagtatttggcttggcctgggggccaagaaattcaaaggtgtagttaggtcctgtgactactatgttacaggactctctgacttggcagaaaaaatagtcaaaagcttcaaggcctgtgctataatgaggtagaatttctaaaagaaatcttcccaaggtaatggacctgcctttgttgcccaggtaaatcagagactggccaagatattagagattggttaaaagttacattgtgcatgcaggccccaaagctcaggacaggtaaaaaaattaataaaaccattaagggatccttaccaaattgacagcggagactggcgctatgattagatagctctcctaccctttatgctcttcagggataaaaacacccctggacagtttagactgacccccctataaattactctacagggggccccctccactggtaaaaatagcctctgtacatagtgctgacatgctgctttcccagcctttgttctc

SEQ ID NO: 36352 - DNA, 1101 bp, Mus musculus
gaagaattctgatggaggatggagtgctctttcattaaccttccaataactggtgttctctagggtggcggcccagggtgtcccataggtctccgtgcgactaggaggggcagcggtggcggcggtggcagcggcagcagcggcagcggcggcagcggcagcagcagcagctagcaacctggtcagggtacgctctccatccacagagatgagccgtcaggctgctacagcattatccactggcacctcaaagtgtccaccatcccagagggtacctgccttgactgacacaactgcatccaacaatgacttggcgagtctttttgagtgtcctgtctgctttgactatgtgttgccacctattcttcagtgtcagagtggccatcttgtttgtagcaactgtcgccccaaacttacatgttgtcccacctgccggggcccattgggatccattcgcaacttggctatggagaaagtggccaactcagtactcttcccctgtaaatattccgcttctggatgtgaaataactctgccacacaccaaaaaggcagagcacgaggagctgtgtgagttcaggccttactcctgcccctgccctggtgcttcctgtaaatggcaaggctccttggatgctgtcatgccccacctgatgcatcagcacaagtccattaccaccctgcaaggagaagacatagttttccttgctacagacatcaaccttcctggtgctgttgactgggtgatgatgcagtcttgttttggctttcatttcatgttagtcttggagaaacaggaaaaatatgatggtcatcagcagttctttgcaattgtacaactgataggaacacgcaaacaagctgaaaattttgcctatcgacttgagctaaatggtcataggcgccgattaacttgggaagcgactcctcgatctattcatgaggggattgcaacagccattatgaatagtgattgcctagtgtttgacaccagcattgcacagctttttgcagaaaatggtaatctaggcatcaatgtaactatttccatgtgttgaaacggcaatcaaatatttctggccagtgtttaaaatttgcattt

SEQ ID NO: 36353 - DNA, 1161 bp, Mus musculus
agggtctcctcagcggtctccctgtagagctgcggtcgaaagccggagccggagccggagcgagccagagccggattgagccggaaccggagctaccggagggcgggacttccggtttctgggcccaagacagagggcgggtcaggagtcaaggtctcgcgaggctgcggcgtgaggtaagggggcgtaagcaagctcctcataggctggcagcctcgtgccgggagcccgcgcggaggttgaattcggtaaggatgggcgactgtgtgtgaccgcggccgcggggtcgcagggcctgtctgtggggacaaggactacccctttggcctttacacgcactgtcttgaggtaccttggtccggggagacccgaaagatgtaggtccgagagtataacggaggggctactcgagcttcccccaggaaccggcttcccagggcgctctcgtcagtacagggtcactaactaacccctggggattggatccggtttggagatggggcgactgcatttctagacaccgaggctgaagacgctggaactcatccggattgggggggggggggacggataacgccaccctccagggtgggcattggtagcacagtagtgtcgggaacacaagtctgacccgtctccacttctcaagttcttaacatcttttttttttttttcttttgtgccctactccagatcgagagaccaggaacttcaaaatagtgcctgggatccggatgacagcaggcattaagggctggctactggactgaagctgctggaaacttgtaagtataactccacctcgtttgtcttttcctgaaaaagcttgagaaataatttgaatgtgtacaccttagtttgaataatctcttctgaaaaccacggttgctttttctcctgctttctggactgtaagtctgccaatctcccctttgctatccaaaagtttggttggcatgtgtgtgcccgaagaactgtgagcatgactagtatgcacaacaaagcttttctttttgaaactttaagcatgctgaagttatgcagaaacggagagagagttgcaaccagtgtcaactatctcagagtctagtgtggcctgtttgaggtcgtctttttttgataaggcaggtctctatacttctgtttatttctgtggatctc

SEQ ID NO: 36354 - DNA, 2112 bp, Mus musculus
tagggaggtacaacagttatgtgaactgttttaaggcaaggtcatgtatccttctctgggcatcattgaagtcatgttcctagacacttactgggtccactcaagggatacgtggaatgtgatttcttgagcaagaccatctattggttgccagcatgtttgaacacctgctgtgtatgaaaagttgacctagatggttcctgagactaaggactggtcaacgagaagtggtaaaactgtcaacatggcgaaatgctcaagctactgaatgacaggagatcatcgctggcatacaccaagtacctttctgacctgttctatgtatatgcattctcttaggaagagcccttctctctctctctctctctctctctctctctctctctgtatgtgtgtgtgtgtgtgtgtgcgtgtgtgtgtatgtgtgcacgcgtgcgtgtgtgttgttgctttttatgttctatggattgaccgatacaactgttgatgcttgtgctggccaaccctctgcttttatagtgcacagttcagtcccccataaatgcctttatggtttctaagcagaacagaaaaggtgtgctatctcaaaaccagctgctcttcctgccctctgtggaagccccttcctgtcactctggtcttgcccatctctgataagtattgccagtgtggggaaaggcttttctccagaatggtttatttagagcgtattaattctgaaactcgtcagagctcgcaggctttttgtgggtggaatttctcaatcgtaattaaggtttccagagccatgggtttttaaatcccaaactgtatgtgatatgtattattaatcctttgaactctttcgcatgggtttgtgtggggaacagactaaaatgagagcagcgagccacttgtgggtgttccattctgtcagtattgtgattctgtacaggagttttttttagcgacatttgcaaaacttttaaaagagtatcttaacatgcctattacttggttgccaccgatataaaagagatatatttgtgtttggtttctatggaaacaaatggtagagagtaatttttaaaatatagaagttagggcttcttttattggagaaaaatgaccttgtccaaaccgttcagtcttatttaaatctttatgcgctgagacaggcgtacaggttaacagtgccaatatccacggtagactgaggcatgtgtaacacttggctgtatttattctactctattatttcttctatgtttgcttctagcttttattaaaatatcattaaatgcttcagttgttctttatttaagatgaacatagaattgaaaattaatttgctcttgtgggcaaatatgtaatttatgaattaaaattgttttccttttttgaacaagtaaaaataaaatttgtgtgacagaaaccattttcaggcttcctggataccttagttgtcagtgttgtactggtcaggatgtgggacactcttccactgtgctactcataattatctgaaatgaaattagcgtggatgaggaatcgttggaaagatactgtgttgcttttgatgtcatacacatgaaaccagtgtgctaaaacatgctcatgtccagtaataaagatgagaacgctgttttaatagtcttatttttgtctcagtttgtcttattttgtggacaggatgttactcgtggaataacccctcctccacctttgctgagtggatctaatgtgttgcctggtctattagtaaaagaggaagtgtcctttgtctaatgtaccactctgtcatcttttatttctagaatatatgctcttttgtattcttgaaatagaaagttcaattgcacctttgtctcctgattccaataagcccttgttcctccctgccagtcatcacagaaggcaaatgaatgcatccacacactattgtgtgtgtgaactacgtaattacactttttatgttgccagctgtcttaagagatatttgaggtctggagagatggctcgatggttaagaatactgactgttcttccagaggtcttcagttcagttcccagcaaccacatggtggctcacaaccatctgtaatgggatccaatgccctcttctggtgtgtc

SEQ ID NO: 36355 - DNA, 2281 bp, Mus musculus
taaagcagcacatggaagggtgcctatcttggaaatgagttgtttggctagagagacgtttgaggcattgattattagagactatagctagttaggaaactaagtaaacgtatgtgcattgtacaaattaatagcataaacgtaatttatttttctttttgatttgaacgctttcaaagcaaatttttatcatgtaaatacactagctgaactgaaaagactaatatgctttgttgtagccaaaaaaaaaatgtagtctgcttttttaaaaattacagaattactagccaagctgacttattagtttttctatactatgtatgtaaaatatgtatattaaaaaaggaagcatacttaaataatttatgtgatcatgactttgtaacttggagaactacttccagatgatagtcgatatgcttttggaatgtaaagctatttaatgccaaacctccttagcctttgtttctcagtgtcactgagcagcctgcctcttattaaatccgggctctttaatgaatactctgttttcgatacaatatgaaaagctacatgtggttgggttttctttgatttctcttattagtgcccagaaggaacgtctctgaaagagcccccctttctagtcaattctatgcagtttccctatgtttggacactgaactttttgcctgggtttattataaggccctacttttccattgtgccatcttcatcttcattccagggcaaaggaatctcctctgtggaccacaaatgatgccaccttcaccctcgcttttaaatgaaaggcattattatataacattgtttgaaagtctagttgtccattactataaataaccgtgggttccaaatggttcttgtgaaaattgttgatgagaaggaaactttaaaagtattcatgtgtgcaaatataaaagcaaagcagaaaggcttagagaatgggaagaattatcacttcccgtggcttctctggcccactgactgctctgccttccgtatacttagactcattcatatggctcctaaattcctatagagatacaccttgcagaagcagaggctaatgaaatagctttgtgtaatcattaacatgaccagtttctgtcactttcgattcaaatccatatctgcctttttaaggaagaaagtcctctgcctagcaaatgaatattccgccatgtttggagagttgttcttctcaggagtagagttgggggctctcatcttgaagccgttgattcccagaccgagtttggaggagtgatgtaatggagctccttaagaagtcggccgaggaaagaaaaccttaaagggacactagtgtgatgctttgtcttaatgtgggtttttctgtttcagtttgccacctccagatgtgaaacagactgcagtccacactaagtactatgtccctgtatgttcacagtgacttcccaagtggtagagttgggggccttaatataatgtcatcccaaagtatctgtctatgcttttcattcctcatcagataaacaggcaattaattagccaagatgaggaatataattgtcctaacagtgtccctttaatgtttcataaggaaatcatgttgatacactaaacacccttctttgcttgttgtctggtcagttgaatttagtaacatcttgttagcatttctgtgtggtgaatgtgactaaaaaggactttgggaaattaacataatgtcaacagtaactggactcttctgctaatcttgattaatctatagagttacatttgattttgtcctgtctttatttggtttaatctaatcatatgtgcatgattatttttagtattctgatcaataattttctctttaatcatgtcattgctttttcatgatcaaattaccagagattttcattttgatttttattttcactcgggaatggaaattaatacattttccatgaaaacattaataaaagatcattagcttgatctgcaagtagcctaaaatacaaatgctggttaacctagtctcaaatttcataaaaccataacttttatatcttgccactaattttgactggatttaatagcactttattgtacaattataaaaaatatattcctggaattgttgccagtgtaatttctctaacgttctggtgcttttcatatattttcagtatttttattactatattggtattttctttgtataaattgatcaaaagaacatgttttctattttaatatgttttagaaaataattacatttatgaaataaatatcatcaggaaaaaaa

SEQ ID NO: 36356 - DNA, 1146 bp, Mus musculus
aaccacatggtggctcacaaccatttgtaatgggatccgatgccctcttgtggtgctgtctgaagacagctacagtgtgctcataaaataaataactcttttttaaaaattaaaaaaataaaactaattaaaacttattggtgtgtgattgggttcatgcatgtcacagcagtggaggttagaggacaacttgtaagagtcagttcttttccttctatcatgtggatgtgggtcctgggtatcaaactcagacttggcaccaactgcaaaaagctgccctcctaggcagttttgaaatgttagctctctcctgtaagaaaggactatggcgttggctccttcccacttctttaggccaggtacccctgttctgctccctcttcagtctgacatacagtaacgaggtcagtttgtaaaatacagggagactttttcctttacttcctagttaggacagtcacagaaattgtagtctgctttcttacaaaatttttttgggttaatttcaggacccagaagctccaagaagaaaaaattaaaagtgaggctgaggcacttgagagacgggaacagaatctgaagaatattgaagacacctatgatcagaaactcaaaactgaactgctaaagtaattgttgggtgttttaaaaagagtaatatgtttgaattaagttggtgaaaatgtagccaaaattgatgaagtaataagacgaatatttacatgacaaaattcagtgtttgagaaaaactattttctttgacaaatcatagctttgtgataaatatttaagaggtttctaaagcttacagtgtagagaattacatcagatactcttattcataactcctcgggctgtgaggaattgtgaggactttaaccttacatatgtaagtgtgtattagattatataattattccattgttttaacccttggatgttatacacattttattttatttttgagtctcttttttttctttttccaattttttattaggtgttttcttcatttacatttcaaatgctatcccgaaagtcccctataccctccccctgccctgctccccaacccacccacacccacttcttagccctggtgctcttctgtactgggccatataagtaaccttagggcaccatatg

SEQ ID NO: 36357 - DNA, 1101 bp, Mus musculus
tctagtgtgctcctacatagataccaaaatacccagaaaatttactgtccacctaccacatttccttttcagagcagaaaagtgaagtttgatgtagtttgttcttagtataagtagagaattaaatgaataataacctggatgtgatgttagtcgtggtttcttaacttatactgaatgagctactgtacagaaaacaaaaaaaggtcctgacatgctatctgaccaaaatcggccaggtaacacctacttaggttggtgttttagtctcgtgaatataccccgtcatagatgagaagatatccttttatctgtttctgaaaattggaatagcattacctgtctcttagcatatagaacctttctgtgcctatgatttctttaatgtcacttaacagtagatggagagttgttgatccaagctatataattggccaggacctgaagacttttttgaattgaaatgcttaggaagttttctaatatctaacatgcagtcttgaaatttgcatcctgcaccgcctgcctgccccgctgctgggaagttatgctttgtatgtaacagggagaatggaaattaagcagatttgcatcttttgttatttccgtgtatgtccagtgctggaagcccttcttttcctaatggtcacaacctagaagcattggcttttcttccatagtttgtacacttaagttctcctttaattttgctcttttcgtggagcctggctagctttgagcttaggacctgcctgccctagcttccgtggtgctaggatagcatgtctgctttaatctgtgtatttggggatcagctaataagcacctattttatccatagggactgtaacattttcaaaagttgtagagattaagatgcttagtggcttctatattagatagtatggttatagagcatgcctatcttggcagaaagtttactagcgtggacaacaaaagtgtggagcacctttgcccagtgcccagcatgaggtaagcctaagaacagcagctaagtctaaatgctgcatacgttctcttacatatgagagctaggttgaaaaacatttgcaaataaaagaagaagtggggactgtttga

SEQ ID NO: 36358 - DNA, 1754 bp, Mus musculus
tttctctgtttagccctggctgtcctggagaccaggctggcctcgaactgagaaatccacctgcttctgcctcccaagtgctgggactaaaggtgtccgccaccactgcccggcttgtgctctttttttttttttttaacaaaatcttaatcttatttttgcctttgggttttagttcatgaaagatgtcattatatagccaaaggtggcccagtctcatgagtgcttgcattataggcgcacctggctttatatactgctcttactacaaccctaagactaaggaaagagagttatttgccagagtgtaggccatagaaagctatcacactactttgtggccacttagtgctttactcagagtggcactgtagctccacactacctgagagcatgttagagatgaaactcttgctccttaagtcctgatctgcattttaacagagtccccaggttatcctctggggtattttgagaatcactgacatacatagcattaggcctgaagttctcaggaatgactatatattagaattttctggagaacattgaaatgtactggtgccaagggccaagcctatacagttcaatatgaacctatggcctggacccagtaatcaacactgctctggtcatttcttggttcctgttaagttgcagttagagttaggaactacctgtagatagtctctcatttgagcctttctatagttctgaagaaattaatgttattctggagtttacagatgaggaaagcagcccacttgcccaggttacacaactgtatgtagtcggcttcacactgatcccaggttttccagcttacttctcaagcaggtgtgatggcacatgcctgtggtccaaatactagggagaatgaggcaggggatttatgtgagttccggccagtttgacttgcaaagttcctgtctcaaaactgttaaaagggaatcctgtttcaagcctgtaatcatagcgttgggaatgctaaggcagaatcccatagttgagggcagcctgagttagatagagaaacactgccaaactcaaaaatattcagtctgaggatgacttaatattgactttgtaagaagtatactcttggaaataggtgctaagcaaatagtgtttgggacctctaagcttatgtgaccggagttttactcttttgtccttaattttctcattttcttttgactggtgaaaagttgcagtgtaagttagaatttggctcgaagcctgcttccttagttgaatgccctgtgttttgtttttttttttttttttgagcacttcaaaaagtatgatatatagttccttaatgttaggactctatataccttcagaggcatgtgtgttgggattgaaattcaaattctgatcatgtgaaaatggcactagttgttagaggaagtctctccttcaatctcagcatttacttacatactaactgaagagaaaatcacgtctcctagttctttgtaaacagtgtttactgatttgtatgcttattcacaagcctttttatgtgaccatgactaatttttttccttaaaaataataaaatgattgtctttctgggttttgatttttttttaccatgtaaaacaattttatacataatcaacacaaaaccttgcatatatgtgctccttttacagttaatcaggtgattagatatacattttctcttttgttgtttgacaacaatatgtgaagagtttctatttttataagactagcttcactctgtt

SEQ ID NO: 36359 - DNA, 1374 bp, Mus musculus
gacaaacccgatatggctgagatcgagaaattcgataagtcgaagttgaagaaaacagaaacgcaagagaaaaatcctctgccttcaaaagaaagtaagctgttcgcccccacccattttcagaacgggctgggcgggagcagagcagagcggggagcagcggccgggaggaggaagggaggggcagcagggaggatgggggggggggctgcgggggaggagtcgacagtttgatgatgatgaatatggcctgcaaaggttaattaaaaactgttttgcagtcaacaagcgccgggctctagtgatttaataatggaatatttcatattccatattgtgcatatacatttattgggtaactgtacttctgtttagcatgtcttgcttagcgaggctgctatgtgtctttctagaatttttatagggtttttaaatggaaatcatgtcattttatagaatgctctaagtctccttttttttttcttttcttcacagcaattgaacaagagaagcaagctggcgaatcgtaatgaggcgagcgccgccaatatgcactgtacattccacgagcattgccttcttattttacttcttttagctgtttaactttgtaagatgcaaagaggttggatcaagtttaaatgactgtgctgcccctttcacatcaaagaatcagaactactgagcaggaaggcctcccctgcctctcccacccatctgatggtctggctagcagagagggaaaagaacttgcatgttggtgaaggaaaaagctgggtgggagatgatgaaatagagaggaaaattcaagatggtcaaagatgtcctgcaggatgtaaaatgcagtttaatcagagtgccatttttttttgttcaaacaattttaattattggaatgcacaatttttttaatatgcaaataaagttttaaaacctgattggtgtgtctgcttggtgactggaaggagtagttaaatgagtgataaaacccttgcaaaactgccttgcctcttggtcactgggacatagaagagacaaacgtaaactgccttggcctaacagctctggcttagtccaggtctgtgaaataccctgtctatagcaaatgattgggaggtcatcataagagttcctcatgggttacatggaagagttaatgaaaatatttgaaattggtatagccaccatggttggaagaagggggctgtggaatgaaggggtaggggggaggaactcacgtgtagttagagcctttcaggagttttggaaagccaacattgaatttattacatatcactcaacgcaaagggtgttggtttggtacactagcattaggtatcaacatgaacttggctaaccaactatctggtattg

SEQ ID NO: 36360 - DNA, 1740 bp, Mus musculus
aataaacttcaaagaaatgcttcagaaagcattgtgaagaagaatctcattgtgggtggcattcttgataaaatgatcttttagtgaagtgtggaggtctgtgcccgtaatcccagcactttaaaactaatgcaggaagagtaccacaagtttaaggccagcctaggctacacagtgagttccagctcagcttggcctggagagctgagactgtgtgtcataaaacacaaacaaacaaaaggcatcagtaagtgcacaacctatcattttccttctcacaaagaagaggatttgcctgtgtacctaaagcttaggaatgcttaaaaaaaaatccccccccccttgctgagtattgtagataaattcccagccctaaattttgcaggtaagaaattcctatccatctgagtagcacactcaaccagcactctggaacagcagaggagcagaagtcaaatcaatgttacaaagtataatttatgttcctatagagactggcattttgataataccttatttgtaactgttctgaagaaagtggttcctataacctgggatgctcagctctgtggtacagtctgtctcaggcttggttagacatgtgtcaaaacttgtttgagatgatgcagctgttacttgtgataaatgtgcgatgtcttaatttcttgggttttatggctgtgctgaagacattcttgtgcatacccacatggagatagctcagtgtgtgtgtgtgtgtgtgtgtgtgtgtgtgtgtgtgtgtgtgtacatgtcccaaagcattggcatgacaaaagccagttggtaatcattttatctaagatatttaaagcttaatgtgtaccatggatcttaaaataagaatcttcagttttaaaaccctgtcataaaaatctgcctggctgtcctctgaatttgagaaccaattgtttctgtccttacttggcctgagttagtattttaaagtacctctgaatacatttgtgaactaattagactggactgggccttatacagtggaaatatggttttaaatattggtttcagtttggctaaaatgacgaaggctgcctcatgagcagccttatttcagaactttcttgttccttgctgcttgtggtaaagaaacataatggaaattaccaaatagatcagctctgtccaactctatgtaaggagagcatgttagtcatatctacccaaaaaggggagccaggaaatagtgaatataccaaagttgtttatcctccacataattttattagtttacttatagatgttcatatgctaactttcctttgttagatacaatgtcgactaaattcaggacatttcttgcagcgcttgccctggttttagagactagagaattttgagatctggtgccatttactaagacatttcaataaaatcatgctgactactttctttcatagttcttgtcatccttttggaattctggttttggatgaaatgatctgctgatgaagtgcctgagaatgttcattactataagttaaccatccagtttgcaaaaggagaggaaagccagaaataattaaaatgtcctcttcacgactttttctttgtgaaggacttattggctatcttctctcacaaggcatcatcgatgctccacagagcacatccaaattgatcattctagagactatctttcaaattaaagaccaggagtggggagatggtacctgccaccaagctgacctgagtttagtccct

SEQ ID NO: 36361 - DNA, 1507 bp, Mus musculus
acattgccgtgttttataaatggatgctaggattatagtaaaaacttaagaaataaaaaatgaaagttataacatagaaaaagcagatttgctatattttctagagtaaaacctctgcaaatgaataagaaaactaagttttaaacaaccagtatcccgagaagggaccatctgttgtgggtagcagcacccctgagtgttcacactgaaaatcttcccaagagcgatagttggctcagctggctgtgctgtctttgaagctaaaacccacagttgtttgttgttccccaaagaaatgactgaaggaggtttgacaaaaaacataccatatacattctggcttttcagcttttaaagaaatagaactgactccctgtcttttgtgttttccctgtgttattcaggtgattgacatttcgatgatcctggctgaagccattcgaagaacccacaatggggaatccgtgtcctatctgttcagccatgtcccactgtagtctggattggaatattgaagatggagcaagcctcctccaacttctcactgtctttgtctgcctgctgttttagaattaggactccgcaattctaggatgatcactggcaaaagcatctgatctgtgtccactctaagagccctctgtctctccttctaaagctcaagactactactttccagtcctgggggagggcagagaaaggtggtggttatttggtcgttaattgaactggtgtcaatgagaactcatcttttccctcgttcttttttagtactttgaggtaacaacttttaagcctaaaatcccattgtggaaatttgtcatacatacattttgaggatgccaaaggtgatttcaaatgaaagccttctgtgtaaatatataataatgcctgtggatatttggggggaaatcctaaataacctttatgtcagagagaaccttggaaaatttatactatcatgaattttgaaattttgttgtttttttcttaatgataactgggtttattttattgccctttatcaggactgaattttattgggcctaagatagccactgacatactgacttttcttagtagatattagacatattaaagacaatataaggctgtatcattttttaattgccactttgaagatatatcataaatgacaacttaccggaaactcccaaattatgatcagtgatcactgatttggctaccatttcaggctgtagtcaatgagtttgtgaccacgttgatgcacaactttgtctatcccaggggaatttctctttagaatgtagctcatgtcctatcaccttattctcagacgttaacaatagcctttactttccacattccccaatagtttcttgttgtagatgtccaccaaaagaaaggctccttgaaaccccctcacatattttaggttgattattattttattttttcacatacataaaatggggaggatttaagagtgccaccaaatacacttattcaaacagagcttactgag

SEQ ID NO: 36362 - DNA, 1142 bp, Mus musculus
tcctagaattgtgagtcaattaaaccccttatactgtctttgtcagggtgttttatcacagcaacagaaattaaactgacgggcaagcggtttgatatattgccagcatgattaatttgaatcaagttcatgtcctttgtattttgtgtttggctggaggataatggtacattatggcttcttcagtaaattttgttcttacaagggtcctgtccaattgtggggcatatgttcgaactccagattcttctttaaggaatacaaatattgagacacatttggtggtgattgttgacatactgatacatggtaaccttttctaaagtcaaatttcctaacttcttctttattccaaatttatgacagagaaactagctctgcctgccacctgccacctgtcatttgcattgcaggaaatgttttggtcttttgctctgtcccctgattgcaagcattgccccaactactatgccagcaaagagagctctatgggcttctcaaacaccagtaaatttgttatataattttttattatatctagtggtgtgtgtgtgtctgtctgtctgtcgtgtgtgtgtgtgtgcatgcgtggtgtggtgtgtctgtgtgtatgcatttgaaggtcaggacaacttgtggccattgcttctcgcctccaccatgtgagtcccagggattaaacacatgtcaacaggtttcattgcaagtgcctttaccaactaaatcatcttaacctcaccctctcccacccccagtggctttaattgttttcagaactgcactgtgtgaccagctatctaccagtttccccattgtcaaacatttagatatgttttccatttggagccattttgaacctgggtcccatgcctttccaaacttagctgctaatgcacaagataagactatcatcaagcagcatttgatcgaatggcatttgagagacagtaagtgcagctcaggaaactgtcacttactggtggagagaagaaacaggcctgcaacaaatggctgtaaacagaatggcttaaaacagcagccgtgtgctcttgcacaactctggagtccaacattgccaaatcagggaccaacatttgaccgatactgatggatagtaaatgaaattgatgatggataaggtg

SEQ ID NO: 36363 - DNA, 1276 bp, Mus musculus
gtgtccatagcatctcataagtcacaatcaggattatgactgcagagtcccatgactatacctactgctggattgctgaagttggaggtggtctcaggaagtctcagagactatgatattaaccaatcttgtgatgtctaattgctaattgtcaacatgacagaatctgggatcacctgagagatgagcccctggctctgcttattggggggtgtatcttaattgtgttaactgaggtggaaaggccaagtgtgtagcactgttttctgactgggccctgacctctgtcagtgggaaagagagctgggaagtagcgtgcatccatcactctgctttccgattaagagtgaagtgtgggcagctgcttcaaggcccctccatcttaagttcctagccaggatggacttcaccgtgaactgtgagccaaaataaagtcacttttcttagagtactttaaatagcaaccgacaaagaatcctaagacagatggcgttgttcttttatagtgtcgagatcggtgaaagtgtgagaggggaagatgtctacatcatccagagtggctgcggggagattaatgacaacctgatggagctactcatcatgatcaatgcgtgcaagattgcgtcctcatccagggtgacagctgtgataccctgcttcccctacgcccggcaagataaaaaggacaaggtaggcgaggtgtgtcctgccctagcaacccagtgtgctcaccactgtttcctcacctattgccttcattagactatccagaagcctcagctttcctcttcaatgtaaatatgtgccctcaccttgtctattccagatttgtcactgaacccatcacatgtatcaacacaggcaatgtatgtttcaaaggcagtcaaataccattatccttgttatcatgatagagtgttgtaaggtggtgcatagagttaaatacaaacacacacacacacacacacacacacacacacacacacacacacaccactgaatgagtacaagtgaagaggagaccatccaaattacttcactgccttggatcaaggtgaggtctccagttgaaacattgtgttctttgtttggttggttgtttttctgagacagggtttctctgtgtagccctggctatcctggaactcactttgtagaccaggctggccttgaactcagaaatctgcctgcctctgcctcccaagtgctgggattaaaggcgtgtgccaccaccgactggcgcaacattgtgctcttataagtggtttccattgta

SEQ ID NO: 36364 - DNA, 1193 bp, Mus musculus
gtccatcatgagctccagatgcgggccatagagctgcaggatctgatgtttgccctgctgggtgtcggtctttctttggacacacccttgcttgctgtaattcccactcttcctgttgggaatgggagtttttcttctttgccattgtttattgagacattgttagttgtttttgattttatagatgttcacaaataagagattgccttgagtctcagagaagacattgaactgcttaacactgctgggactgctaaagactatggagagttttagagagggactaaatgtattttgaattgtgagatgaaaatgagaatttgggggccagaggtggaatgctatggtgtagtggtgtgtttgggtgtcaggttggctggggtagactagagatgcttgattttgattattaacttgggtggaatcagaatcaccctggaaacatgcctttggatatgtctctatgaagtttaactgaagagggaagacccaccctaaatgtggatgacactattttaggacttggggtcttaaactgaatgaaaaggacaaagtgagcggaaaatcaaaattcgtctctctttgcttcctaactgtcagtcttgctgccgtgacttcccctaccatatggaatgcttctcttcaaactgtaagccaaaataaatgtttcctcccttaagctctttttgtcgggtattttgttacaggaattggtggggatgaggagatggaggttgggtgagtagtaattaggattcctctccatttgacttatgtggtgctggcttaatgcttgtgcacctgcagtatcctcctcactgttttcagtgctgaaatatttgctcctggtagatccagggaggggcaaatcagttgagtacccactgatgactacactgctctgcagtgggtagcgccaattcagttgtcacacagatggcccttattaaactaaataggccacaaaccaaaagcaaaggtcatgaagctgggaaaggaagtgtgtgtgtgtgtgtgtgtgtgtgtgtgtgtgtgtgtttgtagtgtgtggtgtgacatggatggaacagggataagaggcgtgtggtagaaggtaattagaatacattatactcatgtattcaattgtcagactacaaaattgttttttaaaaaggtgcagtcatggacccaggaggtgaagcagaagttga

SEQ ID NO: 36365 - DNA, 1116 bp, Mus musculus
gtgatcgacagaagccgctttaatgagtgttgtggaagtaatcaatagaatcatgttttctttctagtacaaaaagtgttgaaatgttttcacagttcattggctgacagctaatatttagcttcagggtgttcagttcttaatatgatgctcattggtgcctttttaattattctttctataggtttttagcagaataccatgatgacttcttcccggagtcggcttatgtcgctgcctgtgaggcacactacagcaccaagaaccccagggcaatttattaaacttttgatggttctgtaaaaacaactgcactatgtggctttatactttaggtcccaggtgaagtgttaatgagatgctagacctatcctgggggtactctgacagaaacaggctctggttttttttttgagttcgtcacattctattatttctgttaagaattattttctgagctcaccatggtggtccttgcctatggggagggagtcgatttaattaattaattcatcatttttttaaaaaaaatgtactgattacttcctgggtgcctgaacatattccaaagtaacactgctacacaagctgtgtgtgctagcaggctaaaaacagccatagctgtcttcatagggatatgtccatgaacgtatacttaggttaaacattattctggtagacagcgcaggtggttgttagcaaggaccatactgtttgattacttgttaatgttaaacaaaaatggttttgaaaactgttttctgttcaacagatcttagtcagtgcttggaagccgcaaagcactctcaaagtatttctgagggaattgatatgggtggcaaaagagaacttacagctatgcattgcttgtagcagttccctttctcagaaacattatttttgttgctctaaataaagcattgcctgtcttgtttgagattttacagccatactctgctatgtaatgttatagttccttttctatgaaatgttattttgggtgatctaaataaagctttgccagttttgtttgaaagaagcaagaggagttttgctctggcctttcctggttctttttactgcagggcaactagtcgggtaacctcttcactccca

SEQ ID NO: 36366 - DNA, 1470 bp, Mus musculus
gtcattgagggtacttttcgagtgagtgatcatatttgatcttgtatttaacaaagatgccatgctcctttaaattttgaatcacattttccattgcagatgataggtcagtttaatttttttccctatttggtataagttccttagttttcccactaagtccagtatttcatgttattttctttagacatcttaacaatctctgaaaaagaggttttaaaagcataaaaagttgtttttattcttactgtttcctcaggagtatttgagatataaaacctgaaagtgtgtgatgcttttacctgccaaataatttaactatattcattataaataagaagcacttgttcttgttttaaaagtaactaatatttctaaaatccctttggtctgaacaaaatatacaagtatataccgaatgaagtctgcaagactgatatgtctatgtttaaatgtgatttcagatttgaccctgatagaaatttcaacttgatacataaaaatttcaaaatacttgttttttcaattctgtcccaatatgtaactatcaatgaaaagctgatcacaccatccctagaagatgacaaattatcttatctcatcccattccctcttcctacttggagcttgccaccagtcgtgtaatgtaaaccttgagagccgggctccaatcacagtgccagaagtgtttctttgacgaataagattatatttggctaagtgttagaattcacaagaagtgcattttttttcagatatgaaatgtttgcaccaattcaccatcattttgatgttttaagcatgtgctgagtttgctgttgaaaactggttgttttgctgggcagtagtagcacaagcctttaaccccagcattccatagatctctgagtttgagactagcctggtctacagagtgagttccatgacagccagaaaaatcctctctctaaaaaaacaaaagaaaaagaaaagaaaactggttgtttttattttaattatagcaacaccttagaaatagctttttcttaaatgttgataatatgaaaaatatttaatttatcttaaatactgtaacatttagtggacagaatttgtgtttttgagttatttgacgtagatttctttgttgtatgatgctttaaaaatctaacatgtgaaaatatttgtattttttaaataaagctgacagttaaaaggttctgaaacttcttagagtgatttttgtagttacttaatttttgagataaaaatttatctttactaaatgcagcagtggtctcatctgttaatcacataattttaaactgcataagaatgtaatctcttttggcccttctcaggtcacaactggattaggactggaaagtaaattaaagtgtatagtgacagggtattgtgaaagtcaactgtcgtataaactcaattattaagatcaacaatttttcctatgccctttcaccacttctagaa

SEQ ID NO: 36367 - DNA, 1149 bp, Mus musculus
cccctcggaagcgacaccccgcggttccctaacttctcaccctgagcggcttaccggccggccggcggagttaaaaaacaccgcctggcccgtaggggcggagacggagagaaggctcgggcgcctataggccgcggagcgagaaggggtggaccgacccgcccttaaacacaccgccccgcacgtaggggcggagacggagagaaggctcgggcggctcgaggcctcggagcggaagggggtgggagcgatccgcccgacctgacgaccgttcctctcctcagcgcgagcttgcctcgtgctcccggaagtcccgccttcggaacaggaagtaacggcgcccgagaacgccggctgtgaccggacgttagcggtgaccccgcgtgaggaaaaaccgcgggtgcagccgagcgacttcggctgggcggttcgacgcgctcgcggccgcgccgcgcgggacaagtcggagcggagacttgggggcagggcggcgcccgggttcggctggagccggcggctgccgagtgagttcggctgggcaggttgacgcgctcggggccgcgcggcgcgggacagtcggcgaggtgacttggggacaggacggcgtccgggtccggctggagccggtgcactgtgcagaccgcggtgccggtgggacgcgcatagacgggaaggcaacactggtggcttcctgcccttcgccgctccttgcctcccgttttggtgacttttttttttttaaccttcctattttccctgaggcgcctgccctactgggaacacgggttcgaggctagttcagtgtattttcccttggaccccaccatcaagactacacccgtcttcacgacgtggttgcatcttacaagtttccagactctggcacgggtccccaaatggtggcataggcttcaaggtattttcccaatggaggcactgttttcaaagtgtcccctcaccaccccccacccccacccccgaaccagtgccctacctcttactctcccaagggatggtgaaaaaaagccagggccagccaggatcagaataacaaggggatatcaactgtttagcctccacgttttaatctgatttcttgctttggcagctgggtattttagattgggagtgacccctgtgattccagcc

SEQ ID NO: 36368 - DNA, 1146 bp, Mus musculus
caggccctgtggctgttttgtaaataagattttatgagagtctggtcgtactctttaagtacaaatcatctacatccgctctaatggcagggttaagtaggtgcgagagcagaagtctgtccgacaatacctaaaatgtcgatcctatagtccttgattagtaagatttccaccccccaccccctaccaaatgagaatgacattatgaaagtctgtcatggttactttttctctgatctatctttcttcatacacaagaagctattgttctcttactctcataaatatcttctcatgataaatcgagatgacgtcttagcggccggctggctggctttagtcacaccgctcagaaaaatcaacaacagataaaccaagaaaacattctttaagtagacggctaagcgctctggaaccaaaacctcctgttagtaaatgtgctagacctgtttaggaagaagacctgcttcgacagtcgaatacctccaaattgtcgtcctaatggtatctgctgctccgctgacatgcgtgtgatgtccacagctcccaaccctcccgcgattagagaagagctctgcaccgcttcctacgacaccatcaccgtccactggacctcagaggacgagttcagcgtggtctcctacgagctccagtacaccatattcaccggacaagccaatgttgtcagtgagtatctctcggctgattcccttccgcgttcgacgactgttttcagatgagctgggtgaagggatctcaacacagaaaggagatgatgaggactgaacatgatgacaatatttatcggcttctctttcctgttcaaggaatggataatgctcacttgtatcgcagtcatgagaacagctgactaaatacccatgaaattaacaacctccggaaaaccacatggatgtagttttttttttttttttttaaagatttatttattattatatgtaagtacactgtagctgtcttcagacactccagaagagggagtcagatcttgttacagatggttgtgagccaccatgtggttgctgggatttgaactctggaccttcggaagagcagtcgggtgctcttacccactgagccatctcaccagcccggatgtagttttaaaaaagaagccggtaacca

SEQ ID NO: 36369 - protein, 15 aa, Artificial
  biotinylation sequence
GLNDIFEAQKIEWHE

SEQ ID NO: 36370 - protein, 14 aa, Artificial
  Biotinylation sequence
GLNDIFEAQKIEWH

SEQ ID NO: 36371 - protein, 321 aa, Escherichia coli
MKDNTVPLKLIALLANGEFHSGEQLGETLGMSRAAINKHIQTLRDWGVDVFTVPGKGYSLPEPIQLLNAKQILGQLDGGSVAVLPVIDSTNQYLLDRIGELKSGDACIAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 36372 - DNA, 22 bp, Artificial
  LNA sequence targeting Dusp9
cctacagttccaagaagtctaa

SEQ ID NO: 36373 - DNA, 22 bp, Artificial
  LNA targeting Dusp9
gaagcaggaaggagtctacacg

SEQ ID NO: 36374 - DNA, 22 bp, Artificial
  LNA targeting Dusp9
cagtttgaccaccctcagtcac

SEQ ID NO: 36375 - DNA, 22 bp, Artificial
  LNA targeting Dusp9
aaagaaacagtcagggcaccag

SEQ ID NO: 36376 - DNA, 22 bp, Artificial
  LNA targeting Dusp9
cacaggtattgccagctccagg

SEQ ID NO: 36377 - DNA, 22 bp, Artificial
  LNA targeting Dusp9
cacacacacagagtctacaacg

SEQ ID NO: 36378 - DNA, 22 bp, Artificial
  LNA targeting Dcaf12L1
cctgtctgccatacattctaca

SEQ ID NO: 36379 - DNA, 22 bp, Artificial
  LNA targeting Dcaf12L1
gctcagacttcttcctttgcac

SEQ ID NO: 36380 - DNA, 22 bp, Artificial
  LNA targeting Dcaf12L1
gtaacagatctattctacttga

SEQ ID NO: 36381 - DNA, 22 bp, Artificial
  LNA targeting Dcaf12L1
cattatctctatttatctgaac

SEQ ID NO: 36382 - DNA, 22 bp, Artificial
  LNA targeting Dcaf12L1
ggagaaaaccaatctatccgca

SEQ ID NO: 36383 - DNA, 22 bp, Artificial
  LNA targeting Calm2
gccagagtaagccacatgcaac

SEQ ID NO: 36384 - DNA, 22 bp, Artificial
  LNA targeting Calm2
ttagatgtgcagacgggcttag

SEQ ID NO: 36385 - DNA, 23 bp, Artificial
  LNA targeting Calm2
ttacagctccacacttcaacaac

SEQ ID NO: 36386 - DNA, 22 bp, Artificial
  LNA targeting Calm2
acatgctgacagttcctaaaag

SEQ ID NO: 36387 - DNA, 22 bp, Artificial
  Scrambled Control LNA
gtgtaacacgtctatacgccca

SEQ ID NO: 36388 - DNA, 23 bp, Artificial
  LNA targeting Tsix
agagtacagttaacaagctgggt

SEQ ID NO: 36389 - DNA, 20 bp, Artificial
  LNA targeting Tsix
tgttttgtgacagggattct

SEQ ID NO: 36390 - DNA, 21 bp, Artificial
  LNA targeting Tsix
ttcttccttgcattgtgtcta

SEQ ID NO: 36391 - DNA, 22 bp, Artificial
  LNA targeting Tsix
ggtgtgtcctatggtcctatgt

SEQ ID NO: 36392 - DNA, 22 bp, Artificial
  LNA targeting Tsix
ccatgtaacagaatgttgagat

SEQ ID NO: 36393 - DNA, 22 bp, Artificial
  LNA targeting Tsix
cataatctgtgaccagtacctc

SEQ ID NO: 36394 - DNA, 20 bp, Artificial
  LNA targeting Tsix
catcagaagaggttagatat

SEQ ID NO: 36395 - DNA, 22 bp, Artificial
  LNA targeting Tsix
tggaggcaggtggatttctaac

SEQ ID NO: 36396 - DNA, 22 bp, Artificial
  LNA targeting Tsix
ccaacatgcgccagcctcctca

SEQ ID NO: 36397 - DNA, 22 bp, Artificial
  LNA targeting Tsix
aagtgctgggattacaggcgtg

SEQ ID NO: 36398 - DNA, 22 bp, Artificial
  LNA targeting Tsix
atcatgactcactgcagcctcg

SEQ ID NO: 36399 - DNA, 22 bp, Artificial
  LNA targeting Tsix
tcgctataccacagtccacagg

SEQ ID NO: 36400 - DNA, 22 bp, Artificial
  LNA targeting Tsix
tgaagcagagagcaggaagaag

SEQ ID NO: 36401 - DNA, 22 bp, Artificial
  LNA targeting Tsix
acacctcaaatctcaagaggct

SEQ ID NO: 36402 - DNA, 22 bp, Artificial
  LNA targeting Tsix
gattactccctagagcaaggcc

SEQ ID NO: 36403 - DNA, 22 bp, Artificial
  LNA targeting Tsix
cacaaggaaagggctcggcaca

SEQ ID NO: 36404 - DNA, 22 bp, Artificial
  LNA targeting Tsix
ccacttccctcccttcaaatgc
